United States Patent 12,569,549 (FLAVIVIRUS VACCINE) - sequence listing, part 41

SEQ ID NO: 15354 - RNA, 9873 nt, synthetic construct
  misc_feature 1..9873: note = derived and/or modified CDS sequence (opt3) from DENV-3__KJ189273__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggtgaccctcccagaatatggaactcttggcctggagtgctctccgcgaaccggtttggacttcaatgagatgatcctactgacaatgaaaaacaaggcctggatggtacatagacagtggtttttcgatctccccctgccttggaccagcggggcgactacagaaacgccaacctggaataggaaagagcttctggttacttttaagaacgcccacgcaaaaaagcaagaagtggtcgtgttgggctcccaggagggagctatgcacacagccctcaccggcgctacagaaatccagaattcagggggaactagtattttcgccggtcatctgaagtgtcggttaaaaatggacaagctggagctaaaaggcatgagctacgcaatgtgcaccaacacgtttgtcctcaagaaagaggtgtctgaaacccagcacgggacaatactgatcaaggttgagtacaagggagaagatgccccctgtaaaattcctttctccactgaggacggccatggtaaggctcacaacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccatcaaatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccacacctggactgaacagtacaaatttcaggcagattctcccaagcggctagccaccgctattgccggtgcatgggagaatggcgtttgtgggatccgaagcacaacgcgcatggaaaacctcctgtggaaacaaatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcagaacagttccttcataattgatggccccaataccccagagtgccccagcgcctctagggcttggaacgtttgggaagtggaggactatggttttggggtcttcacgacaaatatctggctgcggcttcgcgaagtgtacacccaattgtgtgaccacagactcatgtcagcagccgttaaagatgagagggctgtgcatgccgacatgggatactggattgagagtcagaagaacggcagctggaaactggaaaaggcatccctaatcgaggtaaaaacttgcacctggcctaagtctcacacactgtggtcgaatggtgtcctcgaaagcgatatgataatcccaaagtccctggcgggcccgatttcacagcataaccaccgtcccgggtatcacactcagaccgccggaccttggcatcttggcaaattggagctggactttaattactgcgaggggacaacggtggtgatcaccgaaaactgtggaactcggggcccaagtttacgaacaaccactgtctctggtaagctcattcacgagtggtgctgtagaagctgcacactgccccctcttaggtatatgggggaagatggatgttggtacggcatggagatccgcccaatatccgaaaaagaggagaatatggttaagtcactggtgagcgctggttctggcaaagtagacaacttcaccatgggggtgttgtgcctcgccattctgtttgaagaggtcatgcggggaaagttcggcaagaaacatatgatcgcaggggtgttctttacgttcgttctactgctctccggacaaatcacttggagagatatggctcacaccctgattatgatcggcagtaatgccagcgacaggatgggtatgggggtgacatatcttgcattgattgccacctttaagatacagcccttcctggctttaggatttttcctccgcaaactgacttctcgagaaaaccttctgctaggcgtcggcctcgcgatggccacaaccctgcagttgccggaggatatcgaacaaatggcaaatgggattgctctgggattaatggccctcaagctgatcacacagtttgagatttaccagctttggactgccctgatctccttgacctgttcaaacacgatattcacactcaccgtggcttggcggactgcaaccctgatcctagccggtgttagtctgcttcctgtgtgccagagctcgtccatgcgtaaaacagactggctcccaatggcggtcgctgccatgggcgtaccccctctgcccttgtttattttctctctgaaggatactttaaagagaaggagctggccactcaatgagggggtgatggcagttggactggtgtcaatccttgccagttccctgttgcgcaacgacgtccctatggctggccccctcgtggcaggtgggctgctaattgcctgttatgtaatcaccggaacgtctgcggatctgacagtggaaaaagctgccgacataacctgggaggaagaggcagaacaaactggcgtcagccataaccttatgattacagttgacgatgacggcaccatgcggatcaaggatgacgagactgagaatatcctcacagtgctgttgaaaaccgccttactgattgtgtccgggatatttccatactcaatcccggctacgctcctggtctggcacacttggcagaagcagacccagagaagcggagtgctttgggatgttcctagtcccccagaaacacaaaaagccgagctggaagagggtgtatacaggattaagcagcagggcatcttcgggaaaacccaggtgggagtcggcgtgcaaaaggagggtgtttttcacacaatgtggcatgtgactcgaggggcagtcttgacctataacggaaagcgcctagaacccaattgggcttctgtgaaaaaggacctgatttcctacggcggcgggtggcggctcagcacgcagtggcagaaaggagaggaagtacaagtcatcgccgtggagcctggtaagaacccaaaaaatttccagacaatgcccggcactttccagaccacaaccggggaaataggagcgatcgccctggattttaagcctggcacttcgggttcaccgattatcaacagagaggggaaggttgtgggactttatggcaatggcgtcgtgaccaaaaacgggggatacgtttctggtattgcacagacaaatgctgagccagacggccccacgcctgaattagaggaagagatgttcaagaaaaggaacctgactatcatggatctccacccagggagtggaaagacccgtaaatatttgcccgccatagtgcgcgaagctattaagcggagactgaggacactcatcctggcacctacccgagtcgtggccgccgagatggaggaagctcttaagggcctgccgatccggtaccaaactacagcgaccaaatccgagcatacgggtcgcgaaattgtagacttgatgtgccacgcaacttttacaatgagactactgagccccgtgagggttccaaattataacctcatcataatggatgaggcccatttcaccgaccctgcttctattgccgcacgggggtacatcagcacccgagtcggaatgggcgaagccgctgcgatttttatgactgccacacccccaggcaccgcagatgctttccctcagtccaatgcccccatccaggacgaggagagagacataccagaacgctcatggaacagtgggaatgagtggattacagattttgcaggaaagactgtgtggttcgtgccgagcatcaaagccggtaacgacatcgctaactgtttaaggaagaatggcaaaaaggtcattcagctgtctcgtaagacgtttgataccgaataccaaaaaacaaagcttaacgactgggatttcgtagtgactaccgacatctccgagatgggggccaattttaaagcggatcgggttattgaccctagaaggtgcctgaagcccgtgatactcacagatggaccagagcgcgtcatcttggcaggccccatgcctgtgaccgccgcttcagccgctcagcgaagaggtcgggttgggaggaacccacagaaagaaaatgaccagtatattttcactggccaacccctgaacaatgatgaggaccacgcacactggacggaagccaagatgctcctggacaacatcaatacccctgagggaatcattccggctcttttcgaaccagagcgcgagaagagtgccgcaatagatggcgaataccgtctaaaaggggagagcagaaagacatttgtggaactgatgcggaggggagacttgcccgtctggttagcgcataaagtggcctccgagggtatcaagtatactgatcgcaaatggtgcttcgacggccagcgaaacaatcagattctggaagagaacatggatgtagagatctggaccaaggaaggggagaaaaagaagctcagacctcggtggctggacgctaggacatactctgatccccttgccctgaaagaatttaaggacttcgcagctggacgcaaatcgattgccctcgatttggtgaccgagatcggcagagttccaagccacctggcacataggactcggaatgccctagacaacctggtcatgctccacacatcagaacacggtgggcgtgcttatcgccatgcggtggaggagcttcctgaaacgatggagaccctgttattgctgggcctcatgatactgcttactggaggcgccatgctgtttctcatctccgggaagggaattggtaaaacaagtatcggcttgatttgtgtgatcgcatctagcgggatgctgtggatggctgaaatacccttacagtggattgcctccgccatcgtcctagagttctttatgatggttctgctcattccagagcctgaaaagcaacgaaccccgcaggataatcagcttgcatacgtggtaatcggaatactgaccttggctgccatcattgcggctaacgagatgggcctgctcgaaacaactaagagagacctgggtatgtcaaaagagcccggggtggtctctccaacgagctatcttgatgtggacctccaccctgccagtgcatggaccctgtacgccgttgctacaactgtgatcacccccatgttgaggcatacaattgaaaattccaccgcaaacgtcagcctggccgcgatcgctaaccaagccgtagtgttaatgggcctagacaagggatggccaatatctaaaatggatctgggcgttcctctccttgcactggggtgctactcacaggtgaatcccttgactctgacggccgctgtcctcctgcttattacacactatgccatcatcggaccgggcttacaggcaaaggctacccgggaggcccagaaacgcactgcggccggtattatgaagaacccaaccgtggacgggatcatgacaatagatctggaccctgtcatttacgattccaagttcgagaaacaactcggacaggtgatgttgctggttctatgtgcagtgcagctgctccttatgagaactagttgggctctgtgcgaagccttgaccctggcaacaggccccatcacgaccctctgggagggtagcccaggcaagttttggaatactacaattgctgtatcgatggccaacatcttcagggggtcttatctggccggagcgggcttagctttttccataatgaaaagcgtggggaccggaaagcggggcactggttcacagggggaaacacttggagagaaatggaagaagaaactgaatcaactcagtcgaaaggaattcgacctatacaaaaagtctggcatcaccgaggtcgatagaacggaggcaaaagaaggtctgaagcgcggcgagattacccatcacgccgtttccagggggagcgctaaattgcagtggtttgtggaacggaacatggtcatccccgagggacgtgtgattgacctgggctgtgggagaggaggctggtcatattactgcgccggtctcaagaaggtaacagaagtgagggggtatactaaaggaggccctggccacgaggagccggttcccatgagtacctacgggtggaatatcgtgaagcttatgagcggaaaagatgtcttctacctgccacctgaaaagtgtgacacattgctgtgcgatattggtgagtcctctcccagccctactgtggaagagtcccgcaccatccgggtcctcaaaatggtggagccatggttaaagaacaatcagttctgtataaaggttctgaacccctatatgcctacagtaattgaacatcttgagcgactgcagagaaaacacggcgggatgctagtgaggaatccactctcacgcaactctacccatgaaatgtactggatcagtaatggaactggcaacatcgtcgcatcggtgaatatggttagccggctgttgctgaacagatttacgatgacacaccgtaggcccaccattgagaaggacgtggatctcggtgccgggactcggcacgtcaacgctgaaccggagacccctaatatggacgtgataggagagcgcatcaaacgaattaaggaagagcataactccacatggcactatgacgatgaaaatccatacaaaacgtgggcgtatcatggctcttacgaggtaaaggccaccggctcagcaagctccatgatcaacggggtggttaagcttctgactaaaccctgggacgtcgtgcctatggtgacacaaatggctatgaccgatactacaccattcggacagcagagagtctttaaggaaaaagttgacaccaggacaccccggagtatgccgggtactcgcagagtgatgggcattaccgccgagtggttatggaggacgctggggcgaaataagaaacctcggttgtgcacccgtgaggaattcacaaagaaggtaagaactaacgcagccatgggagctgtgtttaccgaggaaaatcaatgggattctgccaaagcggcagtcgaggacgaagatttctggaagctcgtggaccgcgagagggagctgcacaaactaggcaagtgtggtagctgcgtttataacatgatggggaaacgggaaaagaaacttggagagtttggcaaggccaagggctcaagagctatctggtacatgtggctgggggcccgctacctcgaattcgaggcactgggatttttgaatgaggatcattggttctccagggaaaacagttatagcggtgtggagggcgaagggctgcacaaactcggatacatacttcgagacatctctaagattcccggcggtgctatgtatgccgatgacacagctgggtgggacactcggatcaccgaggatgacctgcacaatgaagagaaaattacgcagcagatggatccagagcatagacagttagccaacgcaatctttaagctgacataccaaaataaagtcgtgaaggtacagaggcctacccccactggaacagttatggacataatttcccgcaaggatcagcgtggctcaggccaggtggggacctatggattgaacactttcaccaatatggaagcgcaactcatccggcagatggagggtgaaggcgtcctgagcaaagccgacctagagaacccacaccttcccgaaaagaaaatcacacagtggctggagacgaagggggtggagagactcaaaaggatggctatttcgggagatgactgcgtggtcaagcctatagatgaccgctttgccaacgcactgttggctttaaatgatatgggcaaggttcgaaaagacatcccacagtggcaaccgtctaagggttggcatgattggcagcaggtgcccttctgtagtcaccacttccatgaactgattatgaaagacgggcggaagctcgtagtgccttgcagaccacaggacgagcttatcggaagggcccgcatttcccaaggcgcaggctggagcctgagagaaaccgcctgtctagggaaagcgtacgctcagatgtggtcactgatgtattttcaccggagggatctccgtttggcctccaacgcaatctgctctgccgtccccgtgcattgggttcctactagccgaacaacctggagtatacacgctcatcaccagtggatgactacagaggacatgctgaccgtgtggaatcgcgtctggatcgaagataacccatggatggaggacaagacgcccgtgacaacctgggaggatgtaccttaccttggaaagagagaagaccaatggtgtggttccctgattggcctcactagccgggccacctgggcacagaatatcccgacagctattcagcaggttaggtctttaatcgggaacgaggaattcctggattacatgccatcaatgaaacgctttagaaaggaggaggaaagtgagggagccatttggtga

SEQ ID NO: 15355 - RNA, 9873 nt, synthetic construct
  misc_feature 1..9873: note = derived and/or modified CDS sequence (opt3) from DENV-3__KJ189274__SS-prME
  source 1..9873: mol_type = other RNA
accagcctgtgcctcatgatgatccttcccgcagctctggcattccacttgacttccagagacggagaacctaggatgattgtggggaagaacgaacggggaaaatctttactgtttaagactgcctcaggtataaatatgtgtacgttaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccaaaattcagggggaacaagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgactaagaaagaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgccggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggagaaggactctgacaccacagcctatggagttaaaatactcatggaagacctggggaaaagcgaagatcgtcacagccgaaactcagaacagttccttcataattgatggccccaataccccagagtgccccagcgcttctcgggcatggaacgtgtgggaagttgaggactatggttttggggtgttcacgacaaatatctggctgcgccttagagaagtctacacccaattgtgtgaccacaggctcatgtcagccgctgtgaaggatgagcgtgccgttcatgcagacatgggatactggattgagagtcagaaaaacggcagctggaagctggaaaaagcgtccctaatcgaggtgaagacttgcacctggcctaaatctcacacactgtggtcgaatggtgtactcgaaagcgatatgataatcccaaagtccctggccggcccgatttcacagcataaccaccggcccgggtatcacactcagaccgctggaccttggcatcttggcaagttggagctggactttaattactgcgaggggacaacggtcgtgatcaccgaaaactgtggaactcgaggcccaagtttaagaacaaccactgtgtctggtaaactcattcacgagtggtgctgtaggagctgcacactgccccctcttcgctatatgggggaagatggatgttggtacggcatggagatccggccaatatccgaaaaggaggagaatatggtcaaatcactggttagcgccggttctggcaaggtggacaacttcaccatgggggtattgtgcctcgcaattctgtttgaagaggtgatgagaggaaaattcggcaagaagcatatgatcgctggggtcttctttacgttcgtgctactgctctccggacaaatcacttggagggatatggcccacaccctgattatgatcggcagtaatgcaagcgaccgcatgggtatgggggttacatatcttgccttgattgctacctttaaaatacagcccttcctggcgttaggatttttcctccgaaagctgacttctcgggaaaaccttctgctaggcgtgggcctcgccatggcaacaaccctgcagttgccggaggatatcgaacaaatggctaatgggattgccctgggattaatggccctcaaactgatcacacagtttgagatttaccagctttggactgctctgatctccttgacctgttcaaacacgatattcacactcaccgtcgcatggcgtactgccaccctgatcctagcgggtgtgagtctgcttcctgtttgccagagctcgtccatgagaaagacagactggctcccaatggctgtggccgcaatgggcgtaccccctctgcccttgtttattttctctctgaaagatactttaaagaggcgcagctggccactcaatgagggggtaatggccgtgggactggtttcaatccttgctagttccctgttgcggaacgacgtgcctatggcaggccccctcgtcgccggtgggctgctaattgcgtgttatgtgatcaccggaacgtctgctgatctgacagtagaaaaggccgcagacataacctgggaggaagaggccgaacaaactggcgtgagccataaccttatgattacagtcgacgatgacggcaccatgagaatcaaagatgacgagactgagaatatcctcacagttctgttgaagaccgctttactgattgtgtccgggatatttccatactcaatcccggccacgctcctggtgtggcacacttggcagaaacagacccagaggagcggagtcctttgggatgtgcctagtcccccagaaacacaaaaggcagagctggaagagggtgtttaccgaattaaacagcagggcatcttcgggaagacccaggtaggagtgggcgtccaaaaagagggtgtgtttcacacaatgtggcatgttactcgcggggctgtgttgacctataacggaaagcggctagaacccaattgggcctctgtcaagaaagacctgatttcctacggcggcgggtggagactcagcacgcagtggcagaagggagaggaagtgcaagtaatcgcggtcgagcctggtaaaaacccaaagaatttccagacaatgcccggcactttccagaccacaaccggggaaataggagccatcgcactggattttaaacctggcacttcgggttcaccgattatcaacagggaggggaaggtggttggactttatggcaatggcgtggtcaccaagaacgggggatacgtgtctggtattgctcagacaaatgccgagccagacggccccacgcctgaattagaggaagagatgttcaaaaagcgtaacctgactatcatggatctccacccagggagtggaaaaacccgcaagtatttgcccgctatagttcgggaagcaattaaaagaaggctgcgaacactcatcctggcccctacccgggtggtcgccgctgagatggaggaagcgcttaagggcctgccgatccgctaccaaactacagcaaccaagtccgagcatacgggtagagaaattgtggacttgatgtgccacgccacttttacaatgaggctactgagccccgtacgggtgccaaattataacctcatcataatggatgaggctcatttcaccgaccctgcctctattgcagcccgagggtacatcagcaccagagttggaatgggcgaagctgcggccatttttatgactgcaacacccccaggcaccgctgatgccttccctcagtccaatgcacccatccaggacgaggagcgcgacataccagaaaggtcatggaacagtgggaatgagtggattacagattttgccggaaaaactgtctggttcgtgccgagcatcaaggctggtaacgacatcgccaactgtttacgtaaaaatggcaagaaagtgattcagctgtctcggaagacgtttgataccgaataccaaaagacaaaacttaacgactgggatttcgtcgtaactaccgacatctccgagatgggggcgaattttaaggcagatagagtgattgaccctaggcgctgcctgaaacccgttatactcacagatggaccagagcgagtgatcttggccggccccatgcctgtcaccgctgcctcagctgcacagagacggggtagggtggggcgcaacccacagaaggaaaatgaccagtatattttcactggccaacccctgaacaatgatgaggaccacgcccactggacggaagctaaaatgctcctggacaacatcaatacccctgagggaatcattccggcccttttcgaaccagagcgtgagaagagtgcagcgatagatggcgaatacagactaaagggggagagccggaaaacatttgttgaactgatgaggcgcggagacttgcccgtgtggttagcccataaggtcgcttccgagggtatcaaatatactgatcgaaagtggtgcttcgacggccagagaaacaatcagattctggaagagaacatggatgtggagatctggaccaaagaaggggagaagaaaaagctccggcctaggtggctggacgcccgcacatactctgatccccttgcactgaaggaatttaaagacttcgctgccggaagaaagtcgattgcactcgatttggtaaccgagatcggcagggtgccaagccacctggcccatcggactcgtaatgctctagacaacctggttatgctccacacatcagaacacggtgggcgcgcgtatcgacatgccgtcgaggagcttcctgaaacgatggagaccctgttattgctgggcctcatgatactgcttactggaggcgcaatgctgtttctcatctccgggaaaggaattggtaagacaagtatcggcttgatttgtgtgatcgcttctagcgggatgctgtggatggccgaaatacccttacagtggattgcctccgcaatcgtgctagagttctttatgatggtcctgctcattccagagcctgaaaaacaaagaaccccgcaggataatcagcttgcttacgttgtgatcggaatactgaccttggccgcgatcattgctgccaacgagatgggcctgctcgaaacaactaagagggacctgggtatgtcaaaggagcccggggtagtgtctccaacgagctatcttgatgtcgacctccaccctgcaagtgcctggaccctgtacgctgtggcaacaactgttatcacccccatgttgcggcatacaattgaaaattccaccgccaacgtgagcctggcggctatcgccaaccaagcagtcgtattaatgggcctagacaaaggatggccaatatctaagatggatctgggcgtgcctctccttgccctggggtgctactcacaggttaatcccttgactctgacggctgccgtgctcctgcttattacacactatgcaatcatcggaccgggcttacaggctaaagccacccgcgaggcgcagaagagaactgccgcaggtattatgaaaaacccaaccgtcgacgggatcatgacaatagatctggaccctgtgatttacgattccaagttcgagaagcaactcggacaggtcatgttgctggtgctatgtgctgttcagctgctccttatgaggacaagttgggccctgtgcgaagcattgaccctggctacaggccccatcacgaccctctgggagggtagcccaggcaaattttggaatactacaattgccgtgtcgatggccaacatcttccgggggtcttatctggcgggagctggcttagcattttccataatgaaaagcgtagggaccggaaaacgaggcactggttcacagggggaaacacttggagagaagtggaaaaagaagctgaatcaactcagtagaaaagagttcgacctatacaagaaatctggcatcaccgaggtggatcgcacggaggccaaggaaggtctgaaaaggggcgagattacccatcacgctgtctcccgggggagcgccaagttgcagtggtttgttgaacgtaacatggtgatccccgagggaagagtcattgacctgggctgtgggaggggaggctggtcatattactgcgcaggtctcaaaaaggtgacagaagtacgcgggtatactaagggaggccctggccacgaggagccggtgcccatgagtacctacgggtggaatatcgttaaacttatgagcggaaaggatgtgttctacctgccacctgaaaaatgtgacacattgctgtgcgatattggtgagtcctctcccagccctactgtcgaagagtcccggaccatccgagtgctcaagatggtcgagccatggctgaaaaacaatcagttctgtataaaggtgctaaacccctatatgcctacagttattgaacatcttgagagactgcagaggaagcacggcgggatgctagtacgcaatccactctcacggaactctacccatgaaatgtactggatcagtaatggaactggcaacatcgtggcctcggtcaatatggtgagcagactgttgctgaaccgttttacgatgacacacaggcggcccaccattgagaaagacgttgatctcggtgctgggactcgccacgtgaacgcggaaccggagacccctaatatggacgtcataggagagcgaatcaagagaattagggaagaacataactccacatggcactatgacgatgaaaatccatacaaaacgtgggcctatcatggctcttacgaggtgaaggcaaccggctcagctagctccatgatcaacggggtagtgaaacttctgactaagccctgggacgttgtccctatggtgacacaaatggccatgaccgatactacaccattcggacagcagcgggtgtttaaggaaaaagtcgacacccgcacacccagaagtatgccgggtactaggcgagttatgggcattaccgcagagtggttatggcggacgctggggcgtaataagaaacctagattgtgcacccgcgaggagttcacaaagaaagtgaggactaacgccgctatgggagccgtatttaccgaggaaaatcaatgggattctgcgaaggcagccgtggaggacgaagatttctggaagctcgtcgaccgggagagagagctgcacaaactaggcaagtgtggtagctgcgtgtataacatgatggggaaacgcgaaaagaaacttggagagtttggcaaggctaaaggctcaagggccatctggtacatgtggctgggggcacgatacctcgagttcgaggctctgggatttttgaatgaggatcattggttctcccgggaaaacagttatagcggtgttgagggcgaagggctgcacaagctcggatacatacttagagacatctctaagattcccggcggtgccatgtatgctgatgacacagccgggtgggacactaggatcaccgaggatgacctgcacaatgaagagaaaattacgcagcagatggatccagagcatcgccagttagcaaacgcgatctttaagctgacataccaaaataaagtggtcaaggtgcagcgtcctacccccactggaacagtaatggacataatttcccggaaagatcagagaggctcaggccaggttgggacctatggattgaacactttcaccaatatggaagcccaactcatcaggcagatggagggtgaaggcgtgctgagcaaggctgacctagagaacccacaccttcccgaaaagaaaatcacacagtggctggagacgaagggggtcgagcgcctcaaacgaatggccatttcgggagatgactgcgtggtgaagcctatagatgaccggtttgcaaacgctctgttggccttaaatgatatgggcaaagtcagaaaggacatcccacagtggcaaccgtctaagggttggcatgattggcagcaggttcccttctgtagtcaccacttccatgaactgattatgaaagacgggaggaagctcgtggtaccttgccgcccacaggacgagcttatcggcagagcacggatttcccaaggcgccggctggagcctgagggaaaccgcgtgtctagggaaggcttacgcccagatgtggtcactgatgtattttcaccgtcgagatctccgcttggcatccaacgccatctgctctgctgtgcccgtccattgggtgcctactagcagaacaacctggagtatacacgcccatcaccagtggatgactacagaggacatgctgaccgtttggaatcgggtgtggatcgaagataacccatggatggaggacaagacgcccgtcacaacctgggaggatgtgccttaccttggaaaaagggaagaccaatggtgtggttccctgattggcctcactagccgcgcaacctgggctcagaatatcccgacagccattcagcaggtaagatctttaatcgggaacgaggagttcctggattacatgccatcaatgaagcggtttaggaaggaggaggaaagtgagggagcgatttggtga

SEQ ID NO: 15356 - RNA, 9873 nt, synthetic construct
  misc_feature 1..9873: note = derived and/or modified CDS sequence (opt3) from DENV-3__KJ189275__SS-prME
  source 1..9873: mol_type = other RNA
accagcctgtgcctcatgatgatccttcccgcagctctggcattccacttgacatccagagacggagaacctaggatgattgtggggaagaacgaacggggaaaatctttactgtttaagactgcctcaggtataaatatgtgtacgttaatcgcgatggatctcggcgaaatgtgcgacgataccgtcacctacaaatgtccacatattactgaagttgaaccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccaaaattcagggggaacaagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgactaagaaagaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgccggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggagaaggactctgacaccacagcctatggagttaaaatactcatggaagacctggggaaaagcgaagatcgtcacagccgaaactcagaacagttccttcataattgatggccccaataccccagagtgccccagcgcttctcgggcatggaacgtgtgggaagttgaggactatggttttggggtgttcacgacaaatatctggctgcgccttagagaagtctacacccaattgtgtgaccacaggctcatgtcagccgctgtgaaggatgagcgtgccgttcatgcagacatgggatactggattgagagtcagaaaaacggcagctggaagctggaaaaagcgtccctaatcgaggtgaagacttgcacctggcctaaatctcacacactgtggtcgaatggtgtactcgaaagcgatatgataatcccaaagtccctggccggcccgatttcacagcataaccaccggcccgggtatcacactcagaccgctggaccttggcatcttggcaagttggagctggactttaattactgcgaggggacaacggtcgtgatcaccgaaaactgtggaactcgaggcccaagtttaagaacaaccactgtgtctggtaaactcattcacgagtggtgctgtaggagctgcacactgccccctcttcgctatatgggggaagatggatgttggtacggcatggagatccggccaatatccgaaaaggaggagaatatggtcaaatcactggttagcgccggttctggcaaggtggacaacttcaccatgggggtattgtgcctcgcaattctgtttgaagaggtgatgagaggaaaattcggcaagaagcatatgatcgctggggtcttctttacgttcgtgctactgctctccggacaaatcacttggagggatatggcccacaccctgattatgatcggcagtaatgcaagcgaccgcatgggtatgggggttacatatcttgccttgattgctacctttaaaatacagcccttcctggcgttaggatttttcctccgaaagctgacttctcgggaaaaccttctgctaggcgtgggcctcgccatggcaacaaccctgcagttgccggaggatatcgaacaaatggctaatgggattgccctgggattaatggccctcaaactgatcacacagtttgagacttaccagctttggaccgctctgatttccttgacgtgttcaaacacaatcttcaccctcactgtcgcatggcgtaccgccacactgatactagcgggtgtgagtctgcttcctgtttgccagagctcgtccatgagaaagactgactggctcccaatggctgtggccgcaatgggcgtaccccctctgcccttgtttatcttctctctgaaagataccttaaagaggcgcagctggccactcaatgagggggtaatggccgtgggactggtttcaattcttgctagttccctgttgcggaacgacgtgcctatggcaggccccctcgtcgccggtgggctgctaatcgcgtgttatgtgattacgggaacatctgctgatctgaccgtagaaaaggccgcagacatcacttgggaggaagaggccgaacaaacaggcgtgagccataaccttatgataaccgtcgacgatgacggcactatgagaattaaagatgacgagacagagaatatcctcaccgttctgttgaagacggctttactgatcgtgtccgggatttttccatactcaataccggccactctcctggtgtggcacacctggcagaaacagacacagaggagcggagtcctttgggatgtgcctagtcccccagaaacccaaaaggcagagctggaagagggtgtttaccgaatcaaacagcagggcattttcgggaagacacaggtaggagtgggcgtccaaaaagagggtgtgtttcacactatgtggcatgttacccgcggggctgtgttgacgtataacggaaagcggctagaacccaattgggcctctgtcaagaaagacctgatctcctacggcggcgggtggagactcagcacacagtggcagaagggagaggaagtgcaagtaattgcggtcgagcctggtaaaaacccaaagaatttccagactatgcccggcaccttccagacaaccactggggaaatcggagccatagcactggattttaaacctggcacctcgggttcaccgatcattaacagggaggggaaggtggttggactttatggcaatggcgtggtcacaaagaacgggggatacgtgtctggtatcgctcagacgaatgccgagccagacggccccactcctgaattagaggaagagatgttcaaaaagcgtaacctgaccattatggatctccacccagggagtggaaaaacacgcaagtatttgcccgctatcgttcgggaagcaataaaaagaaggctgcgaaccctcattctggcccctactcgggtggtcgccgctgagatggaggaagcgcttaagggcctgccgatccgctaccaaacaaccgcaacgaagtccgagcatactggtagagaaatcgtggacttgatgtgccacgccacatttaccatgaggctactgagccccgtacgggtgccaaattataacctcattatcatggatgaggctcatttcaccgaccctgcctctatagcagcccgagggtacattagcactagagttggaatgggcgaagctgcggccatctttatgacagcaacacccccaggcacagctgatgccttccctcagtccaatgcacccattcaggacgaggagcgcgacatcccagaaaggtcatggaacagtgggaatgagtggataactgattttgccggaaaaacggtctggttcgtgccgagcattaaggctggtaacgacatcgccaactgtttacgtaaaaatggcaagaaagtgatccagctgtctcggaagacctttgatacagaataccaaaagactaaacttaacgactgggatttcgtcgtaaccacagacatttccgagatgggggcgaattttaaggcagatagagtgatcgaccctaggcgctgcctgaaacccgttattctcaccgatggaccagagcgagtgatattggccggccccatgcctgtcactgctgcctcagctgcacagagacggggtagggtggggcgcaacccacagaaggaaaatgaccagtatatcttcacgggccaacccctgaacaatgatgaggaccacgcccactggaccgaagctaaaatgctcctggacaacattaatacacctgagggaatcatcccggcccttttcgaaccagagcgtgagaagagtgcagcgattgatggcgaatacagactaaagggggagagccggaaaacttttgttgaactgatgaggcgcggagacttgcccgtgtggttagcccataaggtcgcttccgagggtataaaatataccgatcgaaagtggtgcttcgacggccagagaaacaatcagatcctggaagagaacatggatgtggagatttggacaaaagaaggggagaagaaaaagctccggcctaggtggctggacgcccgcacctactctgatccccttgcactgaaggaatttaaagacttcgctgccggaagaaagtcgatcgcactcgatttggtaactgagattggcagggtgccaagccacctggcccatcggacacgtaatgctctagacaacctggttatgctccacacgtcagaacacggtgggcgcgcgtatcgacatgccgtcgaggagcttcctgaaaccatggagactctgttattgctgggcctcatgatcctgcttacaggaggcgcaatgctgtttctcatatccgggaaaggaatcggtaagaccagtattggcttgatctgtgtgattgcttctagcgggatgctgtggatggccgaaatccccttacagtggatagcctccgcaattgtgctagagttctttatgatggtcctgctcatcccagagcctgaaaaacaaagaaccccgcaggataatcagcttgcttacgttgtgattggaatcctgacattggccgcgataatcgctgccaacgagatgggcctgctcgaaactacgaagagggacctgggtatgtcaaaggagcccggggtagtgtctccaaccagctatcttgatgtcgacctccaccctgcaagtgcctggacactgtacgctgtggcaactaccgttattacacccatgttgcggcataccatcgaaaattccactgccaacgtgagcctggcggctattgccaaccaagcagtcgtattaatgggcctagacaaaggatggccaatctctaagatggatctgggcgtgcctctccttgccctggggtgctactcacaggttaatcccttgacgctgacagctgccgtgctcctgcttataacccactatgcaattatcggaccgggcttacaggctaaagccactcgcgaggcgcagaagagaaccgccgcaggtatcatgaaaaacccaacagtcgacgggattatgactatcgatctggaccctgtgatatacgattccaagttcgagaagcaactcggacaggtcatgttgctggtgctatgtgctgttcagctgctccttatgaggaccagttgggccctgtgcgaagcattgacactggctacgggccccattaccactctctgggagggtagcccaggcaaattttggaatacaaccatcgccgtgtcgatggccaacattttccgggggtcttatctggcgggagctggcttagcattttccatcatgaaaagcgtagggactggaaaacgaggcacaggttcacagggggaaacccttggagagaagtggaaaaagaagctgaatcaactcagtagaaaagagttcgacctatacaagaaatctggcataacggaggtggatcgcaccgaggccaaggaaggtctgaaaaggggcgagatcacacatcacgctgtctcccgggggagcgccaagttgcagtggtttgttgaacgtaacatggtgattcccgagggaagagtcatcgacctgggctgtgggaggggaggctggtcatattactgcgcaggtctcaaaaaggtgactgaagtacgcgggtataccaagggaggccctggccacgaggagccggtgcccatgagtacatacgggtggaatattgttaaacttatgagcggaaaggatgtgttctacctgccacctgaaaaatgtgacactttgctgtgcgatatcggtgagtcctctcccagccctaccgtcgaagagtcccggacaattcgagtgctcaagatggtcgagccatggctgaaaaacaatcagttctgtatcaaggtgctaaacccctatatgcctaccgttatagaacatcttgagagactgcagaggaagcacggcgggatgctagtacgcaatccactctcacggaactctactcatgaaatgtactggattagtaatggaacgggcaacatcgtggcctcggtcaatatggtgagcagactgttgctgaaccgttttacaatgacccacaggcggcccactatcgagaaagacgttgatctcggtgctgggacccgccacgtgaacgcggaaccggagacacctaatatggacgtcattggagagcgaataaagagaatcagggaagaacataactccacgtggcactatgacgatgaaaatccatacaaaacctgggcctatcatggctcttacgaggtgaaggcaactggctcagctagctccatgattaacggggtagtgaaacttctgacaaagccctgggacgttgtccctatggtgacccaaatggccatgactgatacaaccccattcggacagcagcgggtgtttaaggaaaaagtcgacacacgcactcccagaagtatgccgggtaccaggcgagttatgggcatcacggcagagtggttatggcggaccctggggcgtaataagaaacctagattgtgcacacgcgaggagttcactaagaaagtgaggaccaacgccgctatgggagccgtatttacagaggaaaatcaatgggattctgcgaaggcagccgtggaggacgaagatttctggaagctcgtcgaccgggagagagagctgcacaaactaggcaagtgtggtagctgcgtgtataacatgatggggaaacgcgaaaagaaacttggagagtttggcaaggctaaaggctcaagggccatttggtacatgtggctgggggcacgatacctcgagttcgaggctctgggatttttgaatgaggatcattggttctcccgggaaaacagttatagcggtgttgagggcgaagggctgcacaagctcggatacatccttagagacatatctaagatccccggcggtgccatgtatgctgatgacactgccgggtgggacaccaggattacggaggatgacctgcacaatgaagagaaaatcacacagcagatggatccagagcatcgccagttagcaaacgcgatttttaagctgacctaccaaaataaagtggtcaaggtgcagcgtcctactcccacaggaaccgtaatggacatcatatcccggaaagatcagagaggctcaggccaggttgggacttatggattgaacaccttcacaaatatggaagcccaactcattaggcagatggagggtgaaggcgtgctgagcaaggctgacctagagaacccacaccttcccgaaaagaaaatcacgcagtggctggagaccaagggggtcgagcgcctcaaacgaatggccatctcgggagatgactgcgtggtgaagcctattgatgaccggtttgcaaacgctctgttggccttaaatgatatgggcaaagtcagaaaggacataccacagtggcaaccgtctaagggttggcatgattggcagcaggttcccttctgtagtcaccacttccatgaactgatcatgaaagacgggaggaagctcgtggtaccttgccgcccacaggacgagcttattggcagagcacggatctcccaaggcgccggctggagcctgagggaaactgcgtgtctagggaaggcttacgcccagatgtggtcactgatgtattttcaccgtcgagatctccgcttggcatccaacgccatttgctctgctgtgcccgtccattgggtgcctacaagcagaaccacttggagtatccacgcccatcaccagtggatgacaaccgaggacatgctgacggtttggaatcgggtgtggatagaagataacccatggatggaggacaagacacccgtcaccacttgggaggatgtgccttaccttggaaaaagggaagaccaatggtgtggttccctgatcggcctcaccagccgcgcaacatgggctcagaatattccgactgccatccagcaggtaagatctttaattgggaacgaggagttcctggattacatgccatcaatgaagcggtttaggaaggaggaggaaagtgagggagcgatctggtga

SEQ ID NO: 15357 - RNA, 9873 nt, synthetic construct
  misc_feature 1..9873: note = derived and/or modified CDS sequence (opt3) from DENV-3__KJ189276__SS-prME
  source 1..9873: mol_type = other RNA
accagcctgtgcctcatgatgatccttcccgcagctctggcattccacttgacttccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctgcagtgctctccgcgaaccggtttggacttcaatgagatgatcctactgacaatgaaaaacaaggcgtggatggtgcatagacaatggtttttcgatctccccctgccttggaccagcggggccacttccgagacaccaacgtggaataggaaagaacttctggtaacctttaagaacgcacacgctaaaaagcaggaggttgtggtcttgggctcacaggaaggagccatgcacactgctctcacaggcgccaccgagatccagaatagtgggggaacaagcattttcgcaggtcatctgaagtgtcggttaaaaatggacaagctggaactaaaaggcatgtcttacgccatgtgcactaacacctttgtgctcaagaaagaggtctccgagacgcaacacgggaccatactgatcaaggtggaatacaagggagaggatgctccctgtaaaattcctttctcaacagaagacggccatggtaaggcgcacaacgggcgtcttatcactgcaaatccagttgtgaccaaaaaggaggagcccgtaaacatagaagccgagccgcctttcggcgaaagcaatattgtcatcggaatcggcgataacgctttgaaaattaattggtataagaaggggagttctatcggaaaaatgtttgaggccacagcacgcggtgccagaaggatggctattctgggcgacactgcctgggatttcgggtccgtgggaggcgttctcaacagcctgggtaagatggtgcatcagatatttgggtcggcatacaccgcgcttttctctggcgtctcctgggtgatgaaaatcggaattggcgtactgttgacgtggatcgggctcaattcaaagaacacaagtatgagcttttcctgcatcgctattggaataatcaccctgtatttaggcgccgtggttcaggcagacatgggttgtgtcattaattggaaagggaaggaactgaagtgcggatctggcatcttcgtgactaacgaggtgcacacatggaccgagcagtacaaatttcaagccgatagccccaagcggctagctactgccattgccggtgcttgggaaaatggcgtctgtgggatccgatcaaccacacgcatggagaacctcctgtggaaacagatagccaatgaacttaactatatcttgtgggagaataacattaagctgacggttgtggtgggagacatcattggcgtactcgaacaggggaaaagaaccctgactccacagcctatggagttaaagtacagttggaaaacatggggaaaggcgaagatcgtcaccgccgagacacaaaactccagcttcataattgatggccccaatactccagaatgcccctctgcttcaagggcatggaacgtgtgggaggttgaagactatggttttggggtgttcaccacgaatatctggctgcggcttcgcgaggtctacacacagttgtgtgaccacagactcatgagtgccgctgtgaaagatgaaagggccgttcatgcagacatgggatactggattgagagccagaagaacggctcctggaaactggagaaggcgtctctaatcgaagtgaaaacctgcacttggcctaagtcgcacaccctgtggagcaatggtgtactcgagtccgatatgataatcccaaagtcactggccggcccgattagtcagcataaccaccgtcccgggtatcacacacaaactgctggaccttggcatcttggcaaattggaactggactttaattactgcgaggggaccacagtcgtgatcacggagaactgtggaacccggggcccatctttacgaactacaaccgtgagcggtaagctcattcacgaatggtgctgtagatcctgcactctgccccctcttaggtatatgggggaggatggatgttggtacggcatggaaatccgcccaatatcagagaaagaagagaatatggtcaagagcctggtttctgccggttccggcaaagtggacaacttcacaatgggggtattgtgcctcgcaattctgtttgaggaagtgatgcggggaaagttcggcaagaaacatatgatcgctggggtcttctttaccttcgtgctactgctcagtggacagatcacgtggagagatatggcccacactctgattatgatcggcagcaatgcatctgacaggatgggtatgggggttacctatcttgccttgattgctacatttaagatacagcccttcctggcgttaggatttttcctccgcaaactgacctcccgagagaaccttctgctaggcgtgggcctcgccatggcaactacactgcaattgccggaagatatcgagcagatggctaatgggattgccctgggattaatggccctcaagctgatcacccagtttgaaacataccagctttggactgctctgatttcattgacctgtagtaacacgatcttcacactcaccgtcgcatggcggactgccaccctgatactagcgggtgtgagcctgcttcctgtttgccaatcgtcctctatgcgtaaaacagactggctcccaatggctgtggccgcaatgggcgtcccacctctgcccttgtttatcttcagcctgaaggatactttaaagagaaggtcatggccactcaatgagggggtaatggccgtgggactggttagtattcttgcttcctctctgttgcgcaacgacgtgcctatggcaggccccctcgtcgccggtgggctgctaatcgcgtgttatgtgattaccggaacgagcgctgatctgacagtagagaaagccgcagacatcacctgggaagaggaagccgagcagactggcgtgtcccataaccttatgataacagtcgacgatgacggcaccatgcggattaaggatgacgaaactgagaatatcctcacagttctgttgaaaaccgctttactgatcgtgtcagggatttttccatacagcataccggccacgctcctggtgtggcacacttggcagaagcagacccaaagaagtggagtcctttgggatgtgccttctcccccagagacacagaaagcagaactggaggaaggtgtttacaggatcaagcagcagggcattttcgggaaaacccaagtaggagtgggcgtccagaaggagggtgtgtttcacacaatgtggcatgttactcgaggggctgtgttgacctataacggaaagcgcctagagcccaattgggcctccgtcaaaaaggacctgatcagctacggcggcgggtggcggctctcgacgcagtggcaaaaaggagaagaggtgcaggtaattgcggtcgaacctggtaagaaccccaagaatttccagacaatgcccggcactttccagaccacaaccggggagatcggagccatagcactggattttaagcctggcacttcaggttctccgatcattaacagagaagggaaggtggttggactttatggcaatggcgtggtcaccaaaaacgggggatacgtgagtggtatcgctcaaacaaatgccgagccagacggccccacgcctgagttagaagaggaaatgttcaagaaaaggaacctgactattatggatctccacccagggtccggaaagacccgtaaatatttgcccgctatcgttcgcgaggcaataaagcggagactgaggacactcattctggcccctacccgagtggtcgccgctgaaatggaggaggcgcttaagggcctgccgatccggtaccagactacagcaaccaaaagcgaacatacgggtcgcgagatcgtggacttgatgtgccacgccacttttacaatgagactactgtctcccgtaagggtgccaaattataacctcattatcatggatgaagctcatttcaccgaccctgccagcatagcagcccgggggtacatttccacccgagttggaatgggcgaggctgcggccatctttatgactgcaacacccccaggcaccgctgatgccttccctcagtcaaatgcacccattcaggacgaagagagagacatcccagagcgcagttggaacagcgggaatgaatggataacagattttgccggaaagactgtctggttcgtgccgtctattaaagctggtaacgacatcgccaactgtttaaggaagaatggcaaaaaggtgatccaactgtcccgtaagacgtttgataccgagtaccagaaaacaaaacttaacgactgggatttcgtcgtaactaccgacatttcagaaatgggggcgaattttaaagcagatcgggtgatcgaccctagaaggtgcctgaagcccgttattctcacagatggaccagagcgcgtgatattggccggccccatgcctgtcaccgctgccagtgctgcacagcgaagaggtcgggtggggaggaacccacagaaagagaatgaccaatatatcttcactggccagcccctgaacaatgatgaagaccacgcccactggacggaggctaagatgctcctggacaacattaatacccctgaaggaatcatcccggcccttttcgagccagaacgcgagaaaagcgcagcgattgatggcgaataccgtctaaaaggggaatccagaaagacatttgttgagctgatgcggaggggagacttgcccgtgtggttagcccataaagtcgcttctgaaggtataaagtatactgatcgcaaatggtgcttcgacggccagcgaaacaatcagatcctggaggaaaacatggatgtggagatttggaccaaggagggggagaagaagaagctcagacctcggtggctggacgccaggacatactcggatccccttgcactgaaagagtttaaggacttcgctgccggacgcaaaagcatcgcactcgatttggtaaccgaaattggcagagtgccatcacacctggcccataggactcggaatgctctagacaacctggttatgctccacacatccgagcacggtgggcgtgcgtatcgccatgccgtcgaagaacttcctgagacgatggaaaccctgttattgctgggcctcatgatcctgcttactggaggcgcaatgctgtttctcataagtgggaagggaatcggtaaaacatctattggcttgatctgtgtgattgctagctccgggatgctgtggatggccgagatccccttacaatggatagcctcagcaattgtgctagagttctttatgatggtcctgctcatcccagagcctgagaagcagcgaaccccgcaggataatcaacttgcttacgttgtgattggaatcctgaccttggccgcgataatcgctgccaacgaaatgggcctgctcgagacaactaagagagacctgggtatgtctaaagaacccggggtagtgagcccaacgagttatcttgatgtcgacctccaccctgcatccgcctggaccctgtacgctgtggcaacaactgttattacccccatgttgaggcatacaatcgagaatagcaccgccaacgtgtctctggcggctattgccaaccaggcagtcgtattaatgggcctagacaagggatggccaatctcaaaaatggatctgggcgtgcctctccttgccctggggtgctactcccaggttaatcccttgactctgacggctgccgtgctcctgcttataacacactatgcaattatcggaccgggcttacaggctaaggccacccgggaagcgcaaaaacgcactgccgcaggtatcatgaagaacccaaccgtcgacgggattatgacaatcgatctggaccctgtgatatacgatagtaagttcgagaaacagctcggacaggtcatgttgctggtgctatgtgctgttcagctgctccttatgagaactagctgggccctgtgcgaggcattgaccctggctacaggccccattacgaccctctgggaaggttcgccaggcaagttttggaatactacaatcgccgtgtctatggccaacattttcagggggtcctatctggcgggagctggcttagcatttagcatcatgaaatcagtagggaccggaaagcggggcactggtagtcaaggggagacacttggagaaaaatggaagaagaaactgaatcagctctctcgaaaggagttcgacctatacaaaaagtccggcataaccgaagtggatagaacggaggccaaagagggtctgaagcgcggcgaaatcacccatcacgctgtcagcagggggtcagccaaattgcagtggtttgttgagcggaacatggtgattcccgaaggacgtgtcatcgacctgggctgtgggagaggaggctggagttattactgcgcaggtctcaagaaggtgacagaggtaagggggtatactaaaggaggccctggccacgaagaaccggtgcccatgagcacctacgggtggaatattgttaaacttatgtccggaaaagatgtgttctacctgccacctgagaagtgtgacacattgctgtgcgatatcggtgaatctagcccctcccctactgtcgaggaatcacgcaccattcgggtgctcaaaatggtcgagccatggttaaagaacaatcagttctgtatcaaggtgctgaacccctatatgcctacagttatagagcatcttgaacgactgcaaagaaaacacggcgggatgctagtaaggaatccactctctcgcaacagtacccatgagatgtactggatttcgaatggaactggcaacatcgtggccagcgtcaatatggtgtcccggctgttgctgaacagatttacgatgacacaccgtaggcccaccatcgaaaaggacgttgatctcggtgctgggactcggcacgtgaacgcggagccggaaacccctaatatggacgtcattggagagcgcataaaacgaatcaaggaggaacataactctacatggcactatgacgatgagaatccatacaaaacgtgggcctatcatggctcatacgaagtgaaggcaaccggcagcgcttccagtatgattaacggggtagtgaaacttctgactaaaccctgggacgttgtccctatggtgacacagatggccatgaccgatactacaccattcggacagcaaagagtgtttaaggagaaagtcgacaccaggacaccccggtctatgccgggtactcgcagagttatgggcatcaccgcagaatggttatggaggacgctggggcgaaataagaaacctcggttgtgcacccgtgaggagttcacaaagaaggtgagaactaacgccgctatgggagccgtatttaccgaagagaatcagtggaacagcgcgaaagcagccgtggaagatgaggacttctggaagctcgtcgatcgcgaaagggagctgcacaaactaggcaagtgtggttcatgcgtgtataatatgatggggaaacgggagaagaaacttggagaatttggcaaggctaagggctccagagccatttggtacatgtggctgggggcacgctacctcgagttcgaagctctgggatttttgaacgaggaccattggttcagtagggagaatagctattctggtgttgaaggcgaggggctgcacaaactcggatacatccttcgagatatatccaagatccccggcggtgccatgtatgctgacgatacagccgggtgggacactcggattaccgaagacgatctgcacaacgaggagaagatcacgcagcagatggacccagagcatagaaggttagcaaatgcgatttttaagctgacataccaaaacaaagtggtcaaggtgcagcgccctacccccactggaacagtaatggatatcatatcacgtaaggaccagcggggcagcggccaggttgggacctatggattgaatactttcaccaacatggaggcccaactcattagacagatggaaggtgagggcgtgctgtcgaaagctgatctagaaaacccacaccttcccgagaagaaaatcacacagtggctggaaacgaagggggtcgagaggctcaaacgcatggccatctctggagacgattgcgtggtgaagcctattgacgatcgatttgcaaatgctctgttggccttaaacgacatgggcaaggtccggaaagatataccacagtggcaaccgagtaagggttggcatgactggcagcaggttcccttctgttcccaccacttccatgagctgatcatgaaagatgggagaaagctcgtggtaccttgcaggccacaggacgaacttattggacgcgcaagaatcagccaaggcgccggctggtcactgcgggagaccgcgtgtctagggaaggcttacgcccagatgtggtccctgatgtattttcacaggcgtgacctccgattggcatctaatgccatttgcagcgctgtgcccgtccattgggtgcctacaagtcgcacaacctggtccatccacgcccatcaccagtggatgactacagaagatatgctgaccgtttggaacagagtgtggatagaggacaatccatggatggaagataagacgcccgtcacaacctgggaggacgtgccttaccttggaaagcgggaggatcaatggtgtggtagcctgatcggcctcacttctagggcaacctgggctcagaacattccgacagccatccagcaggtacgctcattaattgggaatgaagagttcctggactacatgccaagtatgaaaagatttcggaaggaagaggagtccgaaggagcgatctggtga

SEQ ID NO: 15358 - RNA, 9873 nt, synthetic construct
  misc_feature 1..9873: note = derived and/or modified CDS sequence (opt3) from DENV-3__KJ189277__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctgcagtgctctccgcgaaccggtttggacttcaatgagatgatcctactgacaatgaaaaacaaggcgtggatggtgcatagacaatggtttttcgatctccccctgccttggaccagcggggccacttccgagacaccaacgtggaataggaaagaacttctggtaacctttaagaacgcacacgctaaaaagcaggaggttgtggtcttgggctcacaggaaggagccatgcacactgctctcacaggcgccaccgagatccagaatagtgggggaacaagcattttcgcaggtcatctgaagtgtcggttaaaaatggacaagctggaactaaaaggcatgtcttacgccatgtgcactaacacctttgtgctcaagaaagaggtctccgagacgcaacacgggaccatactgatcaaggtggaatacaagggagaggatgctccctgtaaaattcctttctcaacagaagacggccatggtaaggcgcacaacgggcgtcttatcactgcaaatccagttgtgaccaaaaaggaggagcccgtaaacatagaagccgagccgcctttcggcgaaagcaatattgtcatcggaatcggcgataacgctttgaaaattaattggtataagaaggggagttctatcggaaaaatgtttgaggccacagcacgcggtgccagaaggatggctattctgggcgacactgcctgggatttcgggtccgtgggaggcgttctcaacagcctgggtaagatggtgcatcagatatttgggtcggcatacaccgcgcttttctctggcgtctcctgggtgatgaaaatcggaattggcgtactgttgacgtggatcgggctcaattcaaagaacacaagtatgagcttttcctgcatcgctattggaataatcaccctgtatttaggcgccgtggttcaggcagacatgggttgtgtcattaattggaaagggaaggaactgaagtgcggatctggcatcttcgtgactaacgaggtgcacacatggaccgagcagtacaaatttcaagccgatagccccaagcggctagctactgccattgcaggtgcttgggaaaatggcgtctgtgggatccgatcaaccacacgcatggagaacctcctgtggaaacagatagccaatgaacttaactatatcttgtgggagaataacattaagctgacggttgtggtgggagacatcattggcgtactcgaacaggggaaaagaaccctgactccacagcctatggagttaaagtacagttggaaaacatggggaaaggcgaagatcgtcaccgccgagacacaaaactccagcttcataattgatggccccaatactccagaatgcccctctgcttcaagggcatggaacgtgtgggaggttgaagactatggttttggggtgttcaccacgaatatctggctgcggcttcgcgaggcctacacacagttgtgtgaccacagactcatgagtgctgccgtcaaagatgaaagggcagtgcatgcggacatgggatactggattgagagccagaagaacggctcctggaaactggagaaggcctctctaatcgaagttaaaacctgcacttggcctaagtcgcacaccctgtggagcaatggtgtgctcgagtccgatatgataatcccaaagtcactggctggcccgattagtcagcataaccaccgtcccgggtatcacacacaaactgccggaccttggcatcttggcaaattggaactggactttaattactgcgaggggaccacagtagtcatcacggagaactgtggaacccggggcccatctttacgaactacaaccgtgagcggtaagctcattcacgaatggtgctgtagatcctgcactctgccccctcttaggtatatgggggaggatggatgttggtacggcatggaaatccgcccaatatcagagaaagaagagaatatggtgaagagcctggtctctgcaggttccggcaaagttgacaacttcacaatgggggtgttgtgcctcgctattctgtttgaggaagtaatgcggggaaagttcggcaagaaacatatgatcgccggggtgttctttaccttcgtcctactgctcagtggacagatcacgtggagagatatggcacacactctgattatgatcggcagcaatgcctctgacaggatgggtatgggggtgacctatcttgctttgattgcgacatttaagatacagcccttcctggccttaggatttttcctccgcaaactgacctcccgagagaaccttctgctaggcgttggcctcgcaatggctactacactgcaattgccggaagatatcgagcagatggccaatgggattgccctgggattaatggctctcaagctgatcacccagtttgaaacataccagctttggactgcactgatttcattgacctgtagtaacacgatcttcacactcaccgtggcctggcggactgcgaccctgatactagctggtgtcagcctgcttcctgtgtgccaatcgtcctctatgcgtaaaacagactggctcccaatggccgttgcagccatgggcgtgccccctctgcccttgtttatcttcagcctgaaggatactttaaagagaaggtcatggccactcaatgagggggtcatggctgtaggactggtgagtattcttgcatcctctctgttgcgcaacgacgttcctatggccggccccctcgtggcgggtgggctgctaatcgcttgttatgtcattaccggaacgagcgccgatctgacagtggagaaagcagccgacatcacctgggaagaggaagctgagcagactggcgtatcccataaccttatgataacagtggacgatgacggcaccatgcggattaaggatgacgaaactgagaatatcctcacagtcctgttgaaaaccgccttactgatcgtttcagggatttttccatacagcataccggcaacgctcctggtgtggcacacttggcagaagcagacccaaagaagtggagtgctttgggatgtcccttctcccccagagacacagaaagctgaactggaggaaggtgtgtacaggatcaagcagcagggcattttcgggaaaacccaagttggagtaggcgtgcagaaggagggtgtctttcacacaatgtggcatgtgactcgaggggccgttttgacctataacggaaagcgcctagagcccaattgggcgtccgtgaaaaaggacctgatcagctacggcggcgggtggcggctctcgacgcagtggcaaaaaggagaagaggtccaggtgattgccgtagaacctggtaagaacccaaaaaatttccagacaatgcccggcactttccagaccacaaccggggagatcggagcaatagctctggattttaagcctggcacttcaggttctccgatcattaacagagaagggaaggtcgtgggactttatggcaatggcgttgtgaccaaaaacgggggatacgtcagtggtatcgcccaaacaaatgctgagccagacggccccacgcctgagttagaagaggaaatgttcaagaaaaggaacctgactattatggatctccacccagggtccggaaagacccgtaaatatttgcccgcaatcgtgcgcgaggccataaagcggagactgaggacactcattctggcccctacccgagttgtggctgcggaaatggaggaggcacttaagggcctgccgatccggtaccagactacagccaccaaaagcgaacatacgggtcgcgagatcgtcgacttgatgtgccacgctacttttacaatgagactactgtctcccgtgagggtaccaaattataacctcattatcatggatgaagcccatttcaccgaccctgcaagcatagccgctcgggggtacatttccacccgagtgggaatgggcgaggcggccgcaatctttatgactgctacacccccaggcaccgccgatgcattccctcagtcaaatgcccccattcaggacgaagagagagacatcccagagcgcagttggaacagcgggaatgaatggataacagattttgctggaaagactgtttggttcgtcccgtctattaaagccggtaacgacatcgcgaactgtttaaggaagaatggcaaaaaggtgatccaactgtcccgtaagacgtttgataccgagtaccagaaaacaaagcttaacgactgggatttcgtggtcactaccgacatttcagaaatgggggcaaattttaaagccgatcgggtaatcgaccctagaaggtgcctgaagcccgtgattctcacagatggaccagagcgcgttatattggctggccccatgcctgtgaccgccgctagtgcagcccagcgaagaggtcgggtcgggaggaacccacagaaagagaatgaccaatatatcttcactggccagcccctgaacaatgatgaagaccacgctcactggacggaggccaagatgctcctggacaacattaatacccctgaaggaatcatcccggcacttttcgagccagaacgcgagaagagcgcggccattgatggcgagtaccgtctaaaaggggaatccagaaagacatttgtggagctgatgcggaggggagacttgcccgtttggttagctcataaagtggcctctgaaggtataaagtatactgatcgcaaatggtgcttcgacggccagcgaaacaatcagatcctggaggaaaacatggatgtcgagatttggaccaaggagggggaaaaaaagaagctcagacctcggtggctggacgcaaggacatactcggatccccttgctctgaaagagtttaaggacttcgccgcaggacgcaaaagcatcgccctcgatttggtgaccgaaattggcagagtaccatcacacctggctcataggactcggaatgcgctagacaacctggtgatgctccacacatccgagcacggtgggcgtgcctatcgccatgcagttgaagagcttcctgagacgatggaaaccctgttattgctgggcctcatgatcctgcttactggaggcgctatgctgtttctcataagtgggaagggaatcggtaaaacatctattggcttgatctgtgtcattgccagctccgggatgctgtggatggccgagatccccttacaatggatagcatcagctattgtgctagaattctttatgatggtgctgctcatcccagagcctgagaagcagcgaaccccgcaggataatcaacttgcctacgtcgttattggaatcctgaccttggcggctataatcgccgcaaacgaaatgggcctgctcgagacaactaagagagacctgggtatgtctaaagaacccggggtggtaagcccaacgagttatcttgatgtggacctccaccctgcctccgcttggaccctgtacgcagtcgccacaactgtgattacccccatgttgaggcatacaatcgagaatagcaccgcgaacgtttctctggctgccattgcaaaccaggccgtggtcttaatgggcctagacaagggatggccaatctcaaaaatggatctgggcgtacctctccttgctctggggtgctactcccaggtgaatcccttgactctgacggccgcagttctcctgcttataacacactatgctattatcggaccgggcttacaggccaaggcgacccgggaagcccaaaaacgcactgcagctggtatcatgaagaacccaaccgtggacgggattatgacaatcgatctggaccctgtcatatacgatagtaagttcgagaaacagctcggacaggtgatgttgctggtcctatgtgccgtgcagctgctccttatgagaactagctgggcactgtgcgaggctttgaccctggccacaggccccattacgaccctctgggaaggttcgccaggcaagttttggaatactacaatcgccgtttctatggcgaacattttcagggggtcctatctggctggagcaggcttagcctttagcatcatgaaatcagtggggaccggaaagcggggcactggtagtcaaggggagacacttggagaaaaatggaagaagaaactgaatcagctctctcgaaaggagttcgacctatacaaaaagtccggcataaccgaagtagatagaacggaggctaaagagggtctgaagcgcggcgaaatcacccatcacgccgtgagcagggggtcagcaaaattgcagtggtttgtcgagcggaacatggttattcccgaaggacgtgtgatcgacctgggctgtgggagaggaggctggagttattactgcgccggtctcaagaaggtcacagaggtgagggggtatactaaaggaggccctggccacgaagagccggtacccatgagcacctacgggtggaatattgtgaagcttatgtccggaaaagatgttttctacctgccacctgagaagtgtgacacattgctgtgcgatatcggtgaatctagcccctcccctactgtggaggaatcacgcaccattcgggtcctcaaaatggtggagccatggttaaagaacaatcagttctgtatcaaggtcctgaacccctatatgcctacagtgatagagcatcttgaacgactgcaaagaaaacacggcgggatgctagttaggaatccactctctcgcaacagtacccatgagatgtactggatttcgaatggaactggcaacatcgtagctagcgtgaatatggtctcccggctgttgctgaacagatttacgatgacacaccgtaggcccaccatcgaaaaggacgtggatctcggtgcggggactcggcacgttaacgccgagccggaaacccctaatatggacgtgattggagagcgcataaaacgaatcaaggaggaacataactctacatggcactatgacgatgagaatccatacaaaacgtgggcatatcatggctcatacgaagtcaaggctaccggcagcgcctccagtatgattaacggggtggtaaagcttctgactaaaccctgggacgtggttcctatggtcacacagatggcaatgaccgatactacaccattcggacagcaaagagtgtttaaggagaaagtggacaccaggacaccccggtctatgccgggtactcgcagagtcatgggcatcaccgccgaatggttatggaggacgctggggcgaaataagaaacctcggttgtgcacccgtgaggagttcacaaagaaggttagaactaacgctgccatgggagcggtgtttaccgaagagaatcagtggaacagcgcaaaagccgctgtagaagatgaggacttctggaagctcgtggatcgcgaaagggagctgcacaaactaggcaagtgtggttcatgcgtctataatatgatggggaaacgggagaagaaacttggagaatttggcaaggccaagggctccagagcaatttggtacatgtggctgggggctcgctacctcgagttcgaagccctgggatttttgaacgaggaccattggttcagtagggagaatagctattctggtgtggaaggcgaggggctgcacaaactcggatacatccttcgagatatatccaagatccccggcggtgctatgtatgccgacgatacagcagggtgggacactcggattaccgaagacgatctgcacaacgaggaaaaaatcacgcagcagatggacccagagcatagaaggttagcgaatgccatttttaagctgacataccaaaacaaagttgtgaaggtccagcgccctacccccactggaacagtgatggatatcatatcacgtaaggaccagcggggcagcggccaggtagggacctatggattgaatactttcaccaacatggaggctcaactcattagacagatggaaggtgagggcgttctgtcgaaagccgatctagaaaacccacaccttcccgagaagaaaatcacacagtggctggaaacgaagggggtggagaggctcaaacgcatggcaatctctggagacgattgcgtcgtgaagcctattgacgatcgatttgctaatgccctgttggcattaaacgacatgggcaaggtgcggaaagatataccacagtggcaaccgagtaagggttggcatgactggcagcaggtccccttctgttcccaccacttccatgagctgatcatgaaagatgggagaaagctcgttgtgccttgcaggccacaggacgaacttattggacgcgccagaatcagccaaggcgcgggctggtcactgcgggagaccgcttgtctagggaaagcctacgcacagatgtggtccctgatgtattttcacaggcgtgacctccgattggcctctaatgctatttgcagcgccgtacccgtgcattgggtccctactagtcgcacaacctggtccatccacgcacatcaccagtggatgactacagaagatatgctgaccgtgtggaacagagtttggatagaggacaatccatggatggaagataagacgcccgtgacaacctgggaggacgtcccttaccttggaaagcgggaggatcaatggtgtggtagcctgatcggcctcacttctagggctacctgggcccagaacattccgacagcgatccagcaggtgcgctcattaattgggaatgaagagttcctggactacatgccaagtatgaaaagatttcggaaggaagaggagtccgaaggagctatctggtga

SEQ ID NO: 15359 - RNA, 9873 nt, synthetic construct
  misc_feature 1..9873: note = derived and/or modified CDS sequence (opt3) from DENV-3__KJ189278__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcaccgccgagacaagcgtagcgtagcccttgcaccccatgtgggcatgggtctggataccagaacgcaaacttggatgtccgccgagggggcttggaggcaggtcgaaaaagtggagacctgggcattgcggcaccctggattcacaatcctcgccctgtttctggctcattacattggcacttctctcacccagaaggttgtgatcttcatattactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccactctcccagaatatggaacccttggcctggagtgctctccgcgaacaggtttggacttcaatgagatgattctactgaccatgaaaaacaaggcgtggatggtgcatagacagtggtttttcgatctccccctgccttggactagcggggccacaacggaaaccccaacttggaataggaaagagcttctggtaacatttaagaacgcacacgctaaaaagcaagaagttgtggtcttgggctcccaggagggagccatgcacaccgctctcacaggcgccactgaaatccagaattcagggggaaccagtatcttcgcaggtcatctgaagtgtcggttaaaaatggacaagctggagctaaaaggcatgagctacgccatgtgcacgaacacctttgtgctcaagaaagaggtctctgaaacacagcacgggactattctgataaaggtggagtacaagggagaagatgctccctgtaaaatccctttctccaccgaggacggccatggtaaggcgcacaacgggcgtcttattacagcaaatccagttgtgactaaaaaggaggaacccgtaaacatcgaggccgaaccgcctttcggcgagtcaaatatagtcattggaatcggcgataacgctttgaaaatcaattggtataagaaggggagcagtattggaaaaatgtttgaagccaccgcacgcggtgccagaaggatggctatcctgggcgacacggcctgggatttcgggtctgtgggaggcgttctcaactccctgggtaagatggtgcatcaaatttttgggagcgcatacacagcgcttttctcgggcgtctcttgggtgatgaaaataggaatcggcgtactgttgacctggattgggctcaattccaagaacacttcaatgagttttagctgcatcgctatcggaattataacactgtatttaggcgccgtggttcaggcagacatgggttgtgtcatcaattggaaagggaaggagctgaagtgcggatccggcattttcgtgaccaacgaggtgcacacttggaccgaacagtacaaatttcaggccgattctcccaagcggctagctacagccatcgcaggtgcttgggagaatggcgtctgtgggattcgaagcacgacccgcatggaaaacctcctgtggaaacaaatcgccaatgagcttaactatatattgtgggaaaataacgttaagctgactgtggtggtaggagacatcattggcgtcctcgagcaggggaaaagaacactgaccccacagcctatggagttaaagtactcatggaaaacatggggaaaggcgaagatcgtgactgccgaaacccagaacagttccttcattatcgatggccccaatacgccagagtgccccagcgcttctagggcatggaacgtttgggaagtggaggactatggttttggggtcttcacaaccaatatatggctgcggcttcgcgaagtgtacactcaattgtgtgaccacagactcatgtcagccgctgttaaagatgagagggccgtgcatgcagacatgggatactggattgagagtcagaagaacggcagctggaaactggaaaaggcgtccctaatcgaggtaaaaacctgcacatggcctaagtctcacactctgtggtcgaatggtgtcctcgaaagcgatatgattatcccaaagtccctggccggcccgatatcacagcataaccaccgtcccgggtatcacacccagacagctggaccttggcatcttggcaaattggagctggactttaattactgcgaggggacgaccgtggtgatcactgaaaactgtggaacacggggcccaagtttacgaaccactacagtctctggtaagctcattcacgagtggtgctgtagaagctgcaccctgccccctcttaggtatatgggggaagatggatgttggtacggcatggagatccgcccaatttccgaaaaagaggagaatatggttaagtcactggtgagcgccggttctggcaaagtagacaacttcacgatgggggtgttgtgcctcgcaatcctgtttgaagaggtcatgcggggaaagttcggcaagaaacatatgatagctggggtgttctttactttcgttctactgctctccggacaaattacctggagagatatggcccacacactgatcatgatcggcagtaatgcaagcgacaggatgggtatgggggtgacctatcttgccttgattgctacttttaagatccagcccttcctggcgttaggatttttcctccgcaaactgacatctcgagaaaaccttctgctaggcgtcggcctcgccatggcaaccacactgcagttgccggaggatattgaacaaatggctaatgggatagccctgggattaatggccctcaagctgatcactcagtttgagacctaccagctttggacggctctgatttccttgacatgttcaaacaccatcttcactctcaccgtggcatggcggacagccactctgattctagcgggtgttagtctgcttcctgtgtgccagagctcgtccatgcgtaaaaccgactggctcccaatggctgtcgccgcaatgggcgtaccccctctgcccttgtttatcttctctctgaaggatacgttaaagagaaggagctggccactcaatgagggggtgatggccgttggactggtgtcaatacttgctagttccctgttgcgcaacgacgtccctatggcaggccccctcgtggccggtgggctgctaatcgcgtgttatgtaattacaggaacctctgctgatctgactgtggaaaaagccgcagacatcacatgggaggaagaggccgaacaaaccggcgtcagccataaccttatgattactgttgacgatgacggcacaatgcggatcaaggatgacgagaccgagaatatactcacggtgctgttgaaaactgctttactgattgtgtccgggatctttccatactcaatcccggccaccctcctggtctggcacacatggcagaagcagacccagagaagcggagtgctttgggatgttcctagtcccccagaaacacaaaaagcagagctggaagagggtgtatacaggattaagcagcagggcatattcgggaaaactcaggtgggagtcggcgtgcaaaaggagggtgtttttcacaccatgtggcatgtgacgcgaggggctgtcttgacatataacggaaagcgcctagaacccaattgggcctctgtgaaaaaggacctgatctcctacggcggcgggtggcggctcagcactcagtggcagaaaggagaggaagtacaagtcattgcggtggagcctggtaagaacccaaaaaatttccagaccatgcccggcacattccagaccactaccggggaaatcggagccattgcactggattttaagcctggcacatcgggttcaccgatcataaacagagaggggaaggttgtgggactttatggcaatggcgtcgtgacgaaaaacgggggatacgtttctggtatcgctcagactaatgccgagccagacggccccacccctgaattagaggaagagatgttcaagaaaaggaacctgacaattatggatctccacccagggagtggaaagacccgtaaatatttgcccgctatcgtgcgcgaagcaattaagcggagactgaggactctcatcctggcccctacacgagtcgtggccgctgagatggaggaagcgcttaagggcctgccgatacggtaccaaaccacggcaactaaatccgagcatacaggtcgcgaaattgtagacttgatgtgccacgccacctttaccatgagactactgagccccgtgagggttccaaattataacctcatcatcatggatgaggctcatttcactgaccctgcctctattgcagcccgggggtacatcagcacacgagtcggaatgggcgaagctgcggccatatttatgaccgcaacacccccaggcactgctgatgccttccctcagtccaatgcacccattcaggacgaggagagagacatcccagaacgctcatggaacagtgggaatgagtggattacggattttgccggaaagaccgtgtggttcgtgccgagcatcaaagctggtaacgacatagccaactgtttaaggaagaatggcaaaaaggtcattcagctgtctcgtaagacatttgatactgaataccaaaaaaccaagcttaacgactgggatttcgtagtgacaaccgacatctccgagatgggggcgaattttaaagcagatcgggttatcgaccctagaaggtgcctgaagcccgtgattctcactgatggaccagagcgcgtcatcttggccggccccatgcctgtgacggctgcctcagctgcacagcgaagaggtcgggttgggaggaacccacagaaagaaaatgaccagtatattttcaccggccaacccctgaacaatgatgaggaccacgcccactggacagaagctaagatgctcctggacaacataaatactcctgagggaatcattccggcccttttcgaaccagagcgcgagaagagtgcagcgatcgatggcgaataccgtctaaaaggggagagcagaaagacctttgtggaactgatgcggaggggagacttgcccgtctggttagcccataaagtggcttccgagggtatcaagtatacagatcgcaaatggtgcttcgacggccagcgaaacaatcagattctggaagagaacatggatgtagagatatggaccaaggaaggggagaaaaagaagctcagacctcggtggctggacgccaggacttactctgatccccttgcactgaaagaatttaaggacttcgctgccggacgcaaatcgatcgcactcgatttggtgacagagattggcagagttccaagccacctggcccataggacgcggaatgctctagacaacctggtcatgctccacacctcagaacacggtgggcgtgcgtatcgccatgccgtggaggagcttcctgaaactatggagacactgttattgctgggcctcatgatcctgcttaccggaggcgcaatgctgtttctcatttccgggaagggaatcggtaaaaccagtataggcttgatctgtgtgattgcttctagcgggatgctgtggatggccgaaatccccttacagtggattgcctccgcaatcgtcctagagttctttatgatggttctgctcataccagagcctgaaaagcaacgaacaccgcaggataatcagcttgcttacgtggtaattggaatcctgactttggccgcgattatcgctgccaacgagatgggcctgctcgaaacgaccaagagagacctgggtatgtcaaaagagcccggggtggtctctccaacaagctatcttgatgtggacctccaccctgcaagtgcctggactctgtacgctgttgcaaccacagtgataacccccatgttgaggcatactatcgaaaattccacggccaacgtcagcctggcggctattgccaaccaagcagtagtgttaatgggcctagacaagggatggccaatctctaaaatggatctgggcgttcctctccttgccctggggtgctactcacaggtgaatcccttgacactgaccgctgccgtcctcctgcttattactcactatgcaatcataggaccgggcttacaggctaaggccacccgggaggcgcagaaacgcacagccgcaggtattatgaagaacccaactgtggacgggatcatgaccatcgatctggaccctgtcatttacgattccaagttcgagaaacaactcggacaggtgatgttgctggttctatgtgctgtgcagctgctccttatgagaacaagttgggccctgtgcgaagcattgacgctggctaccggccccatcactacactctgggagggtagcccaggcaagttttggaataccactatagccgtatcgatggccaacattttcagggggtcttatctggcgggagctggcttagcattttccatcatgaaaagcgtggggacaggaaagcggggcaccggttcacagggggaaacgcttggagagaaatggaagaagaaactgaatcaactcagtcgaaaggaattcgacctatacaaaaagtctggcattaccgaggtcgatagaacagaggccaaagaaggtctgaagcgcggcgagatcactcatcacgctgtttccagggggagcgccaaattgcagtggtttgtggaacggaacatggtcatacccgagggacgtgtgatcgacctgggctgtgggagaggaggctggtcatattactgcgcaggtctcaagaaggtaaccgaagtgagggggtatacaaaaggaggccctggccacgaggagccggttcccatgagtacttacgggtggaatattgtgaagcttatgagcggaaaagatgtcttctacctgccacctgaaaagtgtgacaccttgctgtgcgatatcggtgagtcctctcccagccctacagtggaagagtcccgcaccattcgggtcctcaaaatggtggagccatggttaaagaacaatcagttctgtatcaaggttctgaacccctatatgcctactgtaattgaacatcttgagcgactgcagagaaaacacggcgggatgctagtgaggaatccactctcacgcaactctacgcatgaaatgtactggatcagtaatggaacaggcaacatagtcgcctcggtgaatatggttagccggctgttgctgaacagatttaccatgactcaccgtaggcccaccattgagaaggacgtggatctcggtgctgggacacggcacgtcaacgcggaaccggagacgcctaatatggacgtgatcggagagcgcatcaaacgaattaaggaagagcataactccacctggcactatgacgatgaaaatccatacaaaacttgggcctatcatggctcttacgaggtaaaggcaacaggctcagctagctccatgataaacggggtggttaagcttctgaccaaaccctgggacgtcgtgcctatggtgactcaaatggccatgacagataccacaccattcggacagcagagagtctttaaggaaaaagttgacactaggaccccccggagtatgccgggtacgcgcagagtgatgggcatcaccgcagagtggttatggaggacactggggcgaaataagaaacctcggttgtgcactcgtgaggaattcaccaagaaggtaagaacaaacgccgctatgggagccgtgtttactgaggaaaatcaatgggattctgcgaaagcagccgtcgaggacgaagatttctggaagctcgtggaccgcgagagggagctgcacaaactaggcaagtgtggtagctgcgtttataacatgatggggaaacgggaaaagaaacttggagagtttggcaaggctaagggctcaagagccatttggtacatgtggctgggggcacgctacctcgaattcgaggctctgggatttttgaatgaggatcattggttctccagggaaaacagttatagcggtgtggagggcgaagggctgcacaaactcggatacatccttcgagacatttctaagatccccggcggtgccatgtatgctgatgacaccgccgggtgggacacgcggataacagaggatgacctgcacaatgaagagaaaatcacccagcagatggatccagagcatagacagttagcaaacgcgatttttaagctgacttaccaaaataaagtcgtgaaggtacagaggcctacacccaccggaactgttatggacatcatttcccgcaaggatcagcgtggctcaggccaggtggggacctatggattgaacacattcacgaatatggaagcccaactcatccggcagatggagggtgaaggcgtcctgagcaaagctgacctagagaacccacaccttcccgaaaagaaaataacccagtggctggagactaagggggtggagagactcaaaaggatggccatttcgggagatgactgcgtggtcaagcctatcgatgaccgctttgcaaacgctctgttggccttaaatgatatgggcaaggttcgaaaagacatcccacagtggcaaccgtctaagggttggcatgattggcagcaggtgcccttctgtagtcaccacttccatgaactgattatgaaagacgggcggaagctcgtagtgccttgcagaccacaggacgagcttataggaagggcacgcatctcccaaggcgccggctggagcctgagagaaacagcgtgtctagggaaagcttacgcccagatgtggtcactgatgtattttcaccggagggatctccgtttggcatccaacgccatttgctctgctgtccccgtgcattgggttcctaccagccgaactacatggagtatccacgcccatcaccagtggatgaccacggaggacatgctgacagtgtggaatcgcgtctggattgaagataacccatggatggaggacaagacccccgtgactacctgggaggatgtaccttaccttggaaagagagaagaccaatggtgtggttccctgatcggcctcacaagccgggcaacttgggctcagaatataccgaccgccatccagcaggttaggtctttaattgggaacgaggaattcctggattacatgccatcaatgaaacgctttagaaaggaggaggaaagtgagggagcgatctggtga

SEQ ID NO: 15360 - RNA, 9873 nt, synthetic construct
  misc_feature 1..9873: note = derived and/or modified CDS sequence (opt3) from DENV-3__KJ189279__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggtgaccctcccagaatatggaactcttggcctggagtgctctccgcgaaccggtttggacttcaatgagatgatcctactgacaatgaaaaacaaggcctggatggtacatagacagtggtttttcgatctccccctgccttggaccagcggggcgactacagaaacgccaacctggaataggaaagagcttctggttacttttaagaacgcccacgcaaaaaagcaagaagtggtcgtgttgggctcccaggagggagctatgcacacagccctcaccggcgctacagaaatccagaattcagggggaactagtattttcgccggtcatctgaagtgtcggttaaaaatggacaagctggagctaaaaggcatgagctacgcaatgtgcaccaacacgtttgtcctcaagaaagaggtgtctgaaacccagcacgggacaatactgatcaaggttgagtacaagggagaagatgccccctgtaaaattcctttctccactgaggacggccatggtaaggctcacaacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccatcaaatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccacacctggactgaacagtacaaatttcaggcagattctcccaagcggctagccaccgctattgccggtgcatgggagaatggcgtttgtgggatccgaagcacaacgcgcatggaaaacctcctgtggaaacaaatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcagaacagttccttcataattgatggccccaataccccagagtgccccagcgcctctagggcttggaacgtttgggaagtggaggactatggttttggggtcttcacgacaaatatctggctgcggcttcgcgaagtgtacacccaattgtgtgaccacagactcatgtcagcagccattaaagatgagagggctgttcatgccgacatgggatactggatcgagagtcagaagaacggcagctggaaactggaaaaggcatccctaatagaggtgaaaacttgcacctggcctaagtctcacacactgtggtcgaatggtgtactcgaaagcgatatgatcattccaaagtccctggcgggcccgatctcacagcataaccaccgtcccgggtatcacactcagaccgccggaccttggcatcttggcaaattggagctggactttaattactgcgaggggacaacggtcgtgattaccgaaaactgtggaactcggggcccaagtttacgaacaaccactgtgtctggtaagctcatccacgagtggtgctgtagaagctgcacactgccccctcttaggtatatgggggaagatggatgttggtacggcatggagatacgcccaatttccgaaaaagaggagaatatggtcaagtcactggttagcgctggttctggcaaagtggacaacttcaccatgggggtattgtgcctcgccatcctgtttgaagaggtgatgcggggaaagttcggcaagaaacatatgatcgcaggggtcttctttacgttcgtgctactgctctccggacaaattacttggagagatatggctcacaccctgatcatgattggcagtaatgccagcgacaggatgggtatgggggttacatatcttgcattgatagccacctttaagatccagcccttcctggctttaggatttttcctccgcaaactgacttctcgagaaaaccttctgctaggcgtgggcctcgcgatggccacaaccctgcagttgccggaggatattgaacaaatggcaaatgggatcgctctgggattaatggccctcaagctgattacacagtttgagacttaccagctttggaccgccctgatctccttgacgtgttcaaacacaatattcaccctcactgtcgcttggcggaccgcaacactgatcctagccggtgtgagtctgcttcctgtttgccagagctcgtccatgcgtaaaactgactggctcccaatggcggtggctgccatgggcgtcccccctctgcccttgtttattttctctctgaaggataccttaaagagaaggagctggccactcaatgagggggtaatggcagtgggactggtttcaatccttgccagttccctgttgcgcaacgacgtgcctatggctggccccctcgtcgcaggtgggctgctaattgcctgttatgtgatcacgggaacatctgcggatctgaccgtagaaaaagctgccgacataacttgggaggaagaggcagaacaaacaggcgtgagccataaccttatgattaccgtcgacgatgacggcactatgcggatcaaggatgacgagacagagaatatcctcaccgttctgttgaaaacggccttactgattgtgtccgggatatttccatactcaatcccggctactctcctggtgtggcacacctggcagaagcagacacagagaagcggagtcctttgggatgtgcctagtcccccagaaacccaaaaagccgagctggaagagggtgtttacaggattaagcagcagggcatcttcgggaaaacacaggtaggagtgggcgtccaaaaggagggtgtgtttcacactatgtggcatgttacccgaggggcagtgttgacgtataacggaaagcgcctagaacccaattgggcttctgtcaaaaaggacctgatttcctacggcggcgggtggcggctcagcacacagtggcagaaaggagaggaagtgcaagtaatcgccgtcgagcctggtaagaacccaaaaaatttccagactatgcccggcaccttccagacaaccactggggaaataggagcgatcgccctggattttaagcctggcacctcgggttcaccgattatcaacagagaggggaaggtggttggactttatggcaatggcgtggtcacaaaaaacgggggatacgtgtctggtattgcacagacgaatgctgagccagacggccccactcctgaattagaggaagagatgttcaagaaaaggaacctgaccatcatggatctccacccagggagtggaaagacacgtaaatatttgcccgccatagttcgcgaagctattaagcggagactgaggaccctcatcctggcacctactcgagtggtcgccgccgagatggaggaagctcttaagggcctgccgatccggtaccaaacaaccgcgacgaaatccgagcatactggtcgcgaaattgtggacttgatgtgccacgcaacatttaccatgagactactgagccccgtaagggtgccaaattataacctcatcataatggatgaggcccatttcaccgaccctgcttctattgccgcacgggggtacatcagcactcgagttggaatgggcgaagccgctgcgatttttatgacagccacccccccaggcacagcagatgctttccctcagtccaatgcccccatccaggacgaggagagagacataccagaacgctcatggaacagtgggaatgagtggattactgattttgcaggaaagacggtctggttcgtgccgagcatcaaagccggtaacgacatcgctaactgtttaaggaagaatggcaaaaaggtgattcagctgtctcgtaagacctttgatacagaataccaaaaaactaagcttaacgactgggatttcgtcgtaaccacagacatctccgagatgggggccaattttaaagcggatcgggtgattgaccctagaaggtgcctgaagcccgttatactcaccgatggaccagagcgcgtgatcttggcaggccccatgcctgtcactgccgcttcagccgctcagcgaagaggtcgggtggggaggaacccacagaaagaaaatgaccagtatattttcacgggccaacccctgaacaatgatgaggaccacgcacactggaccgaagccaagatgctcctggacaacatcaatacacctgagggaatcattccggctcttttcgaaccagagcgcgagaagagtgccgcaatagatggcgaataccgtctaaaaggggagagcagaaagacttttgttgaactgatgcggaggggagacttgcccgtgtggttagcgcataaagtcgcctccgagggtatcaagtataccgatcgcaaatggtgcttcgacggccagcgaaacaatcagattctggaagagaacatggatgtggagatctggacaaaggaaggggagaaaaagaagctcagacctcggtggctggacgctaggacctactctgatccccttgccctgaaagaatttaaggacttcgcagctggacgcaaatcgattgccctcgatttggtaactgagatcggcagagtgccaagccacctggcacataggacacggaatgccctagacaacctggttatgctccacacgtcagaacacggtgggcgtgcttatcgccatgcggtcgaggagcttcctgaaaccatggagactctgttattgctgggcctcatgatactgcttacaggaggcgccatgctgtttctcatctccgggaagggaattggtaaaaccagtatcggcttgatttgtgtgatcgcatctagcgggatgctgtggatggctgaaatacccttacagtggattgcctccgccatcgtgctagagttctttatgatggtcctgctcattccagagcctgaaaagcaacgaaccccgcaggataatcagcttgcatacgttgtgatcggaatactgacattggctgccatcattgcggctaacgagatgggcctgctcgaaactacgaagagagacctgggtatgtcaaaagagcccggggtagtgtctccaaccagctatcttgatgtcgacctccaccctgccagtgcatggacactgtacgccgtggctactaccgttatcacacccatgttgaggcataccattgaaaattccactgcaaacgtgagcctggccgcgatcgctaaccaagccgtcgtattaatgggcctagacaagggatggccaatatctaaaatggatctgggcgtgcctctccttgcactggggtgctactcacaggttaatcccttgacgctgacagccgctgtgctcctgcttattacccactatgccatcatcggaccgggcttacaggcaaaggctactcgggaggcccagaaacgcaccgcggccggtattatgaagaacccaacagtcgacgggatcatgactatagatctggaccctgtgatttacgattccaagttcgagaaacaactcggacaggtcatgttgctggtgctatgtgcagttcagctgctccttatgagaaccagttgggctctgtgcgaagccttgacactggcaacgggccccatcaccactctctgggagggtagcccaggcaagttttggaatacaaccattgctgtgtcgatggccaacatcttcagggggtcttatctggccggagcgggcttagctttttccataatgaaaagcgtagggactggaaagcggggcacaggttcacagggggaaacccttggagagaaatggaagaagaaactgaatcaactcagtcgaaaggaattcgacctatacaaaaagtctggcatcacggaggtggatagaaccgaggcaaaagaaggtctgaagcgcggcgagattacacatcacgccgtctccagggggagcgctaaattgcagtggtttgttgaacggaacatggtgatccccgagggacgtgtcattgacctgggctgtgggagaggaggctggtcatattactgcgccggtctcaagaaggtgactgaagtaagggggtataccaaaggaggccctggccacgaggagccggtgcccatgagtacatacgggtggaatatcgttaagcttatgagcggaaaagatgtgttctacctgccacctgaaaagtgtgacactttgctgtgcgatattggtgagtcctctcccagccctaccgtcgaagagtcccgcacaatccgggtgctcaaaatggtcgagccatggttaaagaacaatcagttctgtataaaggtgctgaacccctatatgcctaccgttattgaacatcttgagcgactgcagagaaaacacggcgggatgctagtaaggaatccactctcacgcaactctactcatgaaatgtactggatcagtaatggaacgggcaacatcgtggcatcggtcaatatggtgagccggctgttgctgaacagatttacaatgacccaccgtaggcccactattgagaaggacgttgatctcggtgccgggacccggcacgtgaacgctgaaccggagacacctaatatggacgtcataggagagcgcatcaaacgaattaaggaagagcataactccacgtggcactatgacgatgaaaatccatacaaaacctgggcgtatcatggctcttacgaggtgaaggccactggctcagcaagctccatgatcaacggggtagtgaagcttctgacaaaaccctgggacgttgtccctatggtgacccaaatggctatgactgatacaaccccattcggacagcagagagtgtttaaggaaaaagtcgacacaaggactccccggagtatgccgggtacccgcagagttatgggcattacggccgagtggttatggaggaccctggggcgaaataagaaacctcggttgtgcacacgtgaggaattcactaagaaggtgagaaccaacgcagccatgggagctgtatttacagaggaaaatcaatgggattctgccaaagcggcagtggaggacgaagatttctggaagctcgtcgaccgcgagagggagctgcacaaactaggcaagtgtggtagctgcgtgtataacatgatggggaaacgggaaaagaaacttggagagtttggcaaggccaagggctcaagagctatctggtacatgtggctgggggcccgctacctcgaattcgaggcactgggatttttgaatgaggatcattggttctccagggaaaacagttatagcggtgttgagggcgaagggctgcacaaactcggatacatacttcgagacatctctaagattcccggcggtgctatgtatgccgatgacactgctgggtgggacacccggatcacggaggatgacctgcacaatgaagagaaaattacacagcagatggatccagagcatagacagttagccaacgcaatctttaagctgacctaccaaaataaagtggtcaaggtgcagaggcctactcccacaggaaccgtaatggacataatttcccgcaaggatcagcgtggctcaggccaggttgggacttatggattgaacaccttcacaaatatggaagcgcaactcatccggcagatggagggtgaaggcgtgctgagcaaagccgacctagagaacccacaccttcccgaaaagaaaatcacgcagtggctggagaccaagggggtcgagagactcaaaaggatggctatttcgggagatgactgcgtggtgaagcctatagatgaccgctttgccaacgcactgttggctttaaatgatatgggcaaggtccgaaaagacatcccacagtggcaaccgtctaagggttggcatgattggcagcaggttcccttctgtagtcaccacttccatgaactgattatgaaagacgggcggaagctcgtggtaccttgcagaccacaggacgagcttatcggaagggcccgcatttcccaaggcgcaggctggagcctgagagaaactgcctgtctagggaaagcgtacgctcagatgtggtcactgatgtattttcaccggagggatctccgtttggcctccaacgcaatctgctctgccgtgcccgtccattgggtgcctacaagccgaaccacttggagtatacacgctcatcaccagtggatgacaaccgaggacatgctgacggtttggaatcgcgtgtggatcgaagataacccatggatggaggacaagacacccgtcaccacttgggaggatgtgccttaccttggaaagagagaagaccaatggtgtggttccctgattggcctcaccagccgggccacatgggcacagaatatcccgactgctattcagcaggtaaggtctttaatcgggaacgaggaattcctggattacatgccatcaatgaaacgctttagaaaggaggaggaaagtgagggagccatttggtga

SEQ ID NO: 15361 - RNA, 9873 nt, synthetic construct
  misc_feature 1..9873: note = derived and/or modified CDS sequence (opt3) from DENV-3__KJ189280__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagagatatggcccacaccctgattatgatcggcagtaatgcaagcgacaggatgggtatgggggttacatatcttgccttgattgctacctttaagatacagcccttcctggcgttaggatttttcctccgcaaactgacttctcgagaaaaccttctgctaggcgtgggcctcgccatggcaacaaccctgcagttgccggaggatatcgaacaaatggctaatgggattgccctgggattaatggccctcaagctgatcacacagtttgagacttaccagctttggaccgctctgatttccttgacgtgttcaaacacaatcttcaccctcactgtcgcatggcggaccgccacactgatactagcgggtgtgagtctgcttcctgtttgccagagctcgtccatgcgtaaaactgactggctcccaatggctgtggccgcaatgggcgtcccccctctgcccttgtttatcttctctctgaaggataccttaaagagaaggagctggccactcaatgagggggtaatggccgtgggactggtttcaattcttgctagttccctgttgcgcaacgacgtgcctatggcaggccccctcgtcgccggtgggctgctaatcgcgtgttatgtgattacgggaacatctgctgatctgaccgtagaaaaagccgcagacatcacttgggaggaagaggccgaacaaacaggcgtgagccataaccttatgataaccgtcgacgatgacggcactatgcggattaaggatgacgagacagagaatatcctcaccgttctgttgaaaacggctttactgatcgtgtccgggatttttccatactcaataccggccactctcctggtgtggcacacctggcagaagcagacacagagaagcggagtcctttgggatgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataacggaaagcgcctagaacccaattgggcctctgtcaaaaaggacctgatctcctacggcggcgggtggcggctcagcacacagtggcagaaaggagaggaagtgcaagtaattgcggtcgagcctggtaagaacccaaaaaatttccagactatgcccggcaccttccagacaaccactggggaaatcggagccatagcactggattttaagcctggcacctcgggttcaccgatcattaacagagaggggaaggtggttggactttatggcaatggcgtggtcacaaaaaacgggggatacgtgtctggtatcgctcagacgaatgccgagccagacggccccactcctgaattagaggaagagatgttcaagaaaaggaacctgaccattatggatctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggacttgatgtgccacgccacatttaccatgagactactgagccccgtaagggtgccaaattataacctcattatcatggatgaggctcatttcaccgaccctgcctctatagcagcccgggggtacattagcactcgagttggaatgggcgaagctgcggccatctttatgacagcaacccccccaggcacagctgatgccttccctcagtccaatgcacccattcaggacgaggagagagacatcccagaacgctcatggaacagtgggaatgagtggataactgattttgccggaaagacggtctggttcgtgccgagcattaaagctggtaacgacatcgccaactgtttaaggaagaatggcaaaaaggtgatccagctgtctcgtaagacctttgatacagaataccaaaaaactaagcttaacgactgggatttcgtcgtaaccacagacatttccgagatgggggcgaattttaaagcagatcgggtgatcgaccctagaaggtgcctgaagcccgttattctcaccgatggaccagagcgcgtgatattggccggccccatgcctgtcactgctgcctcagctgcacagcgaagaggtcgggtggggaggaacccacagaaagaaaatgaccagtatatcttcacgggccaacccctgaacaatgatgaggaccacgcccactggaccgaagctaagatgctcctggacaacattaatacacctgagggaatcatcccggcccttttcgaaccagagcgcgagaagagtgcagcgattgatggcgaataccgtctaaaaggggagagcagaaagacttttgttgaactgatgcggaggggagacttgcccgtgtggttagcccataaagtctcctctgagggtataaagtataccgatcgcaaatggtgcttcgacggccagcgaaacaatcagatcctggaagagaacatggatgtggagatttggacaaaggaaggggagaaaaagaagctcagacctcggtggctggacgctaggacctactcggatccccttgccctgaaagaatttaaggacttcgcagctggacgcaaaagcatcgccctcgatttggtaactgagattggcagagtgccatcacacctggcacataggacacggaatgccctagacaacctggttatgctccacacgtccgaacacggtgggcgtgcttatcgccatgcggtcgaggagcttcctgaaaccatggagactctgttattgctgggcctcatgatcctgcttacaggaggcgccatgctgtttctcataagtgggaagggaatcggtaaaacctctattggcttgatctgtgtgattgcaagctccgggatgctgtggatggctgaaatccccttacagtggatagcctcagccattgtgctagagttctttatgatggtcctgctcatcccagagcctgaaaagcaacgaaccccgcaggataatcagcttgcatacgttgtgattggaatcctgacattggctgccataatcgcggctaacgagatgggcctgctcgaaactacgaagagagacctgggtatgtctaaagagcccggggtagtgagcccaaccagttatcttgatgtcgacctccaccctgcctccgcatggacactgtacgccgtggctactaccgttattacacccatgttgaggcataccatcgaaaatagcactgcaaacgtgtctctggccgcgattgctaaccaagccgtcgtattaatgggcctagacaagggatggccaatctcaaaaatggatctgggcgtgcctctccttgcactggggtgctactcccaggttaatcccttgacgctgacagccgctgtgctcctgcttataacccactatgccattatcggaccgggcttacaggcaaaggctactcgggaggcccagaaacgcaccgcggccggtatcatgaagaacccaacagtcgacgggattatgactatcgatctggaccctgtgatatacgatagtaagttcgagaaacaactcggacaggtcatgttgctggtgctatgtgcagttcagctgctccttatgagaaccagctgggctctgtgcgaagccttgacactggcaacgggccccattaccactctctgggagggttcgccaggcaagttttggaatacaaccatcgctgtgtctatggccaacattttcagggggtcctatctggccggagcgggcttagcttttagcatcatgaaatcagtagggactggaaagcggggcacaggtagtcagggggaaacccttggagagaaatggaagaagaaactgaatcaactctctcgaaaggaattcgacctatacaaaaagtccggcataacggaggtggatagaaccgaggcaaaagaaggtctgaagcgcggcgagatcacacatcacgccgtcagcagggggtcagctaaattgcagtggtttgttgaacggaacatggtgattcccgagggacgtgtcatcgacctgggctgtgggagaggaggctggagttattactgcgccggtctcaagaaggtgactgaagtaagggggtataccaaaggaggccctggccacgaggagccggtgcccatgagcacatacgggtggaatattgttaagcttatgtccggaaaagatgtgttctacctgccacctgaaaagtgtgacactttgctgtgcgatatcggtgagtctagcccctcccctaccgtcgaagagtcacgcacaattcgggtgctcaaaatggtcgagccatggttaaagaacaatcagttctgtatcaaggtgctgaacccctatatgcctaccgttatagaacatcttgagcgactgcagagaaaacacggcgggatgctagtaaggaatccactctctcgcaacagtactcatgaaatgtactggatttcgaatggaacgggcaacatcgtggcaagcgtcaatatggtgtcccggctgttgctgaacagatttacaatgacccaccgtaggcccactatcgagaaggacgttgatctcggtgccgggacccggcacgtgaacgctgaaccggagacacctaatatggacgtcattggagagcgcataaaacgaatcaaggaagagcataactctacgtggcactatgacgatgaaaatccatacaaaacctgggcgtatcatggctcatacgaggtgaaggccactggcagcgcatccagtatgattaacggggtagtgaagcttctgacaaaaccctgggacgttgtccctatggtgacccaaatggctatgactgatacaaccccattcggacagcagagagtgtttaaggaaaaagtcgacacaaggactccccggtctatgccgggtacccgcagagttatgggcatcacggccgagtggttatggaggaccctggggcgaaataagaaacctcggttgtgcacacgtgaggaattcactaagaaggtgagaaccaacgcagccatgggagctgtatttacagaggaaaatcaatgggatagcgccaaagcggcagtggaggacgaagatttctggaagctcgtcgaccgcgagagggagctgcacaaactaggcaagtgtggttcatgcgtgtataacatgatggggaaacgggaaaagaaacttggagagtttggcaaggccaagggctccagagctatttggtacatgtggctgggggcccgctacctcgaattcgaggcactgggatttttgaatgaggatcattggttcagtagggaaaacagctattctggtgttgagggcgaagggctgcacaaactcggatacatccttcgagacatatccaagatccccggcggtgctatgtatgccgatgacactgctgggtgggacacccggattacggaggatgacctgcacaatgaagagaaaatcacacagcagatggatccagagcatagacagttagccaacgcaatttttaagctgacctaccaaaataaagtggtcaaggtgcagaggcctactcccacaggaaccgtaatggacatcatatcacgcaaggatcagcgtggcagcggccaggttgggacttatggattgaacaccttcacaaatatggaagcgcaactcattcggcagatggagggtgaaggcgtgctgtcgaaagccgacctagagaacccacaccttcccgaaaagaaaatcacgcagtggctggagaccaagggggtcgagagactcaaaaggatggctatctctggagatgactgcgtggtgaagcctattgatgaccgctttgccaacgcactgttggctttaaatgatatgggcaaggtccgaaaagacataccacagtggcaaccgagtaagggttggcatgattggcagcaggttcccttctgttcccaccacttccatgaactgatcatgaaagacgggcggaagctcgtggtaccttgcagaccacaggacgagcttattggaagggcccgcatcagccaaggcgcaggctggtcactgagagaaactgcctgtctagggaaagcgtacgctcagatgtggtccctgatgtattttcaccggagggatctccgtttggcctctaacgcaatttgcagcgccgtgcccgtccattgggtgcctacaagtcgaaccacttggtccatccacgctcatcaccagtggatgacaaccgaggacatgctgacggtttggaatcgcgtgtggatagaagataacccatggatggaggacaagacacccgtcaccacttgggaggatgtgccttaccttggaaagagagaagaccaatggtgtggtagcctgatcggcctcacctctcgggccacatgggcacagaatattccgactgctatccagcaggtaaggtcattaattgggaacgaggaattcctggattacatgccaagtatgaaacgctttagaaaggaggaggaatccgagggagccatctggtga

SEQ ID NO: 15362 - RNA, 9873 nt, synthetic construct
  misc_feature 1..9873: note = derived and/or modified CDS sequence (opt3) from DENV-3__KJ189281__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagagatatggcccacaccctgattatgatcggcagtaatgcaagcgacaggatgggtatgggggttacatatcttgccttgattgctacctttaagatacagcccttcctggtgttaggatttttcctccgcaaactgacttctcgagaaaaccttctgctaggcgtcggcctcgcgatggccacaaccctgcagttgccggaggatatcgaacaaatggcaaatgggattgctctgggattaatggccctcaagctgatcacacagtttgagacttaccagctttggaccgccctgatttccttgacgtgttcaaacacaatcttcaccctcactgtggcttggcggaccgcaacactgatactagccggtgttagtctgcttcctgtgtgccagagctcgtccatgcgtaaaactgactggctcccaatggcggtcgctgccatgggcgtaccccctctgcccttgtttatcttctctctgaaggataccttaaagagaaggagctggccactcaatgagggggtgatggcagttggactggtgtcaattcttgccagttccctgttgcgcaacgacgtccctatggctggccccctcgtggcaggtgggctgctaatcgcctgttatgtaattacgggaacatctgcggatctgaccgtggaaaaagctgccgacatcacttgggaggaagaggcagaacaaacaggcgtcagccataaccttatgataaccgttgacgatgacggcactatgcggattaaggatgacgagacagagaatatcctcaccgtgctgttgaaaacggccttactgatcgtgtccgggatttttccatactcaataccggctactctcctggtctggcacacctggcagaagcagacacagagaagcggagtgctttgggatgttcctagtcccccagaaacccaaaaagccgagctggaagagggtgtatacaggatcaagcagcagggcattttcgggaaaacacaggtgggagtcggcgtgcaaaaggagggtgtttttcacactatgtggcatgtgacccgaggggcagtcttgacgtataacggaaagcgcctagaacccaattgggcttctgtgaaaaaggacctgatctcctacggcggcgggtggcggctcagcacacagtggcagaaaggagaggaagtacaagtcattgccgtggagcctggtaagaacccaaaaaatttccagactatgcccggcaccttccagacaaccactggggaaatcggagcgatagccctggattttaagcctggcacctcgggttcaccgatcattaacagagaggggaaggttgtgggactttatggcaatggcgtcgtgacaaaaaacgggggatacgtttctggtatcgcacagacgaatgctgagccagacggccccactcctgaattagaggaagagatgttcaagaaaaggaacctgaccattatggatctccacccagggagtggaaagacacgtaaatatttgcccgccatcgtgcgcgaagctataaagcggagactgaggaccctcattctggcacctactcgagtcgtggccgccgagatggaggaagctcttaagggcctgccgatccggtaccaaacaaccgcgacgaaatccgagcatactggtcgcgaaatcgtagacttgatgtgccacgcaacatttaccatgagactactgagccccgtgagggttccaaattataacctcattatcatggatgaggcccatttcaccgaccctgcttctatagccgcacgggggtacattagcactcgagtcggaatgggcgaagccgctgcgatctttatgacagccacccccccaggcacagcagatgctttccctcagtccaatgcccccattcaggacgaggagagagacatcccagaacgctcatggaacagtgggaatgagtggataactgattttgcaggaaagacggtgtggttcgtgccgagcattaaagccggtaacgacatcgctaactgtttaaggaagaatggcaaaaaggtcatccagctgtctcgtaagacctttgatacagaataccaaaaaactaagcttaacgactgggatttcgtagtgaccacagacatttccgagatgggggccaattttaaagcggatcgggttatcgaccctagaaggtgcctgaagcccgtgattctcaccgatggaccagagcgcgtcatattggcaggccccatgcctgtgactgccgcttcagccgctcagcgaagaggtcgggttgggaggaacccacagaaagaaaatgaccagtatatcttcacgggccaacccctgaacaatgatgaggaccacgcacactggaccgaagccaagatgctcctggacaacattaatacacctgagggaatcatcccggctcttttcgaaccagagcgcgagaagagtgccgcaattgatggcgaataccgtctaaaaggggagagcagaaagacttttgtggaactgatgcggaggggagacttgcccgtctggttagcgcataaagtggcctccgagggtataaagtataccgatcgcaaatggtgcttcgacggccagcgaaacaatcagatcctggaagagaacatggatgtagagatttggacaaaggaaggggagaaaaagaagctcagacctcggtggctggacgctaggacctactctgatccccttgccctgaaagaatttaaggacttcgcagctggacgcaaatcgatcgccctcgatttggtgactgagattggcagagttccaagccacctggcacataggacacggaatgccctagacaacctggtcatgctccacacgtcagaacacggtgggcgtgcttatcgccatgcggtggaggagcttcctgaaaccatggagactctgttattgctgggcctcatgatcctgcttacaggaggcgccatgctgtttctcatatccgggaagggaatcggtaaaaccagtattggcttgatctgtgtgattgcatctagcgggatgctgtggatggctgaaatccccttacagtggatagcctccgccattgtcctagagttctttatgatggttctgctcatcccagagcctgaaaagcaacgaaccccgcaggataatcagcttgcatacgtggtaattggaatcctgacattggctgccataatcgcggctaacgagatgggcctgctcgaaactacgaagagagacctgggtatgtcaaaagagcccggggtggtctctccaaccagctatcttgatgtggacctccaccctgccagtgcatggacactgtacgccgttgctactaccgtgattacacccatgttgaggcataccatcgaaaattccactgcaaacgtcagcctggccgcgattgctaaccaagccgtagtgttaatgggcctagacaagggatggccaatctctaaaatggatctgggcgttcctctccttgcactggggtgctactcacaggtgaatcccttgacgctgacagccgctgtcctcctgcttataacccactatgccattatcggaccgggcttacaggcaaaggctactcgggaggcccagaaacgcaccgcggccggtatcatgaagaacccaacagtggacgggattatgactatcgatctggaccctgtcatatacgattccaagttcgagaaacaactcggacaggtgatgttgctggttctatgtgcagtgcagctgctccttatgagaaccagttgggctctgtgcgaagccttgacactggcaacgggccccattaccactctctgggagggtagcccaggcaagttttggaatacaaccatcgctgtatcgatggccaacattttcagggggtcttatctggccggagcgggcttagctttttccatcatgaaaagcgtggggactggaaagcggggcacaggttcacagggggaaacccttggagagaaatggaagaagaaactgaatcaactcagtcgaaaggaattcgacctatacaaaaagtctggcataacggaggtcgatagaaccgaggcaaaagaaggtctgaagcgcggcgagatcacacatcacgccgtttccagggggagcgctaaattgcagtggtttgtggaacggaacatggtcattcccgagggacgtgtgatcgacctgggctgtgggagaggaggctggtcatattactgcgccggtctcaagaaggtaactgaagtgagggggtataccaaaggaggccctggccacgaggagccggttcccatgagtacatacgggtggaatattgtgaagcttatgagcggaaaagatgtcttctacctgccacctgaaaagtgtgacactttgctgtgcgatatcggtgagtcctctcccagccctaccgtggaagagtcccgcacaattcgggtcctcaaaatggtggagccatggttaaagaacaatcagttctgtatcaaggttctgaacccctatatgcctaccgtaatagaacatcttgagcgactgcagagaaaacacggcgggatgctagtgaggaatccactctcacgcaactctactcatgaaatgtactggattagtaatggaacgggcaacatcgtcgcatcggtgaatatggttagccggctgttgctgaacagatttacaatgacccaccgtaggcccactatcgagaaggacgtggatctcggtgccgggacccggcacgtcaacgctgaaccggagacacctaatatggacgtgattggagagcgcataaaacgaatcaaggaagagcataactccacgtggcactatgacgatgaaaatccatacaaaacctgggcgtatcatggctcttacgaggtaaaggccactggctcagcaagctccatgattaacggggtggttaagcttctgacaaaaccctgggacgtcgtgcctatggtgacccaaatggctatgactgatacaaccccattcggacagcagagagtctttaaggaaaaagttgacacaaggactccccggagtatgccgggtacccgcagagtgatgggcatcacggccgagtggttatggaggaccctggggcgaaataagaaacctcggttgtgcacacgtgaggaattcactaagaaggtaagaaccaacgcagccatgggagctgtgtttacagaggaaaatcaatgggattctgccaaagcggcagtcgaggacgaagatttctggaagctcgtggaccgcgagagggagctgcacaaactaggcaagtgtggtagctgcgtttataacatgatggggaaacgggaaaagaaacttggagagtttggcaaggccaagggctcaagagctatttggtacatgtggctgggggcccgctacctcgaattcgaggcactgggatttttgaatgaggatcattggttctccagggaaaacagttatagcggtgtggagggcgaagggctgcacaaactcggatacatccttcgagacatatctaagatccccggcggtgctatgtatgccgatgacactgctgggtgggacacccggattacggaggatgacctgcacaatgaagagaaaatcacacagcagatggatccagagcatagacagttagccaacgcaatttttaagctgacctaccaaaataaagtcgtgaaggtacagaggcctactcccacaggaaccgttatggacatcatatcccgcaaggatcagcgtggctcaggccaggtggggacttatggattgaacaccttcacaaatatggaagcgcaactcattcggcagatggagggtgaaggcgtcctgagcaaagccgacctagagaacccacaccttcccgaaaagaaaatcacgcagtggctggagaccaagggggtggagagactcaaaaggatggctatctcgggagatgactgcgtggtcaagcctattgatgaccgctttgccaacgcactgttggctttaaatgatatgggcaaggttcgaaaagacataccacagtggcaaccgtctaagggttggcatgattggcagcaggtgcccttctgtagtcaccacttccatgaactgatcatgaaagacgggcggaagctcgtagtgccttgcagaccacaggacgagcttattggaagggcccgcatctcccaaggcgcaggctggagcctgagagaaactgcctgtctagggaaagcgtacgctcagatgtggtcactgatgtattttcaccggagggatctccgtttggcctccaacgcaatttgctctgccgtccccgtgcattgggttcctacaagccgaaccacttggagtatccacgctcatcaccagtggatgacaaccgaggacatgctgacggtgtggaatcgcgtctggatagaagataacccatggatggaggacaagacacccgtgaccacttgggaggatgtaccttaccttggaaagagagaagaccaatggtgtggttccctgatcggcctcaccagccgggccacatgggcacagaatattccgactgctatccagcaggttaggtctttaattgggaacgaggaattcctggattacatgccatcaatgaaacgctttagaaaggaggaggaaagtgagggagccatctggtga

SEQ ID NO: 15363 - RNA, 9873 nt, synthetic construct
  misc_feature 1..9873: note = derived and/or modified CDS sequence (opt3) from DENV-3__KJ189282__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcatcctcgagcaggggaaaagaactctgacaccacagcctatggagttaaagtactcatggaaaacctggggaaaggcgaagatagtaacagccgaaactcagaacagttccttcattatcgatggccccaataccccagagtgccccagcgcttctagggcatggaacgtctgggaagtggaggactatggttttggggttttcacgacaaatatttggctgcggcttcgcgaagcctacacccaattgtgtgaccacagactcatgtcagctgccgtgaaagatgagagggcagtccatgcggacatgggatactggatcgagagtcagaagaacggcagctggaaactggaaaaggcctccctaatagaggtgaaaacttgcacctggcctaagtctcacacactgtggtcgaatggtgttctcgaaagcgatatgatcattccaaagtccctggctggcccgatctcacagcataaccaccgtcccgggtatcacactcagaccgccggaccttggcatcttggcaaattggagctggactttaattactgcgaggggacaacggtggtaattaccgaaaactgtggaactcggggcccaagtttacgaacaaccactgtctctggtaagctcatccacgagtggtgctgtagaagctgcacactgccccctcttaggtatatgggggaagatggatgttggtacggcatggagatacgcccaatttccgaaaaagaggagaatatggtgaagtcactggtgagcgcaggttctggcaaagtcgacaacttcaccatgggggttttgtgcctcgctatcctgtttgaagaggtgatgcggggaaagttcggcaagaaacatatgatcgccggggtattctttacgttcgtgctactgctctccggacaaattacttggagagatatggcacacaccctgatcatgattggcagtaatgccagcgacaggatgggtatgggggtcacatatcttgctttgatagcgacctttaagatccagcccttcctggccttaggatttttcctccgcaaactgacttctcgagaaaaccttctgctaggcgtgggcctcgcaatggctacaaccctgcagttgccggaggatattgaacaaatggccaatgggatcgccctgggattaatggctctcaagctgattacacagtttgagacttaccagctttggaccgcactgatctccttgacgtgttcaaacacaatattcaccctcactgttgcctggcggaccgcgacactgatcctagctggtgtgagtctgcttcctgtctgccagagctcgtccatgcgtaaaactgactggctcccaatggccgtggcagccatgggcgttccccctctgcccttgtttattttctctctgaaggataccttaaagagaaggagctggccactcaatgagggggtgatggctgtcggactggtatcaatccttgcaagttccctgttgcgcaacgacgtgcctatggccggccccctcgttgcgggtgggctgctaattgcttgttatgtgatcacgggaacatctgccgatctgaccgtcgaaaaagcagccgacataacttgggaggaagaggctgaacaaacaggcgtgagccataaccttatgattaccgtagacgatgacggcactatgcggatcaaggatgacgagacagagaatatcctcaccgtgctgttgaaaacggccttactgattgtctccgggatatttccatactcaatcccggcaactctcctggtttggcacacctggcagaagcagacacagagaagcggagtgctttgggatgtgcctagtcccccagaaacccaaaaagctgagctggaagagggtgtctacaggattaagcagcagggcatcttcgggaaaacacaggtgggagttggcgtacaaaaggagggtgtgtttcacactatgtggcatgtcacccgaggggccgtgttgacgtataacggaaagcgcctagaacccaattgggcgtctgttaaaaaggacctgatttcctacggcggcgggtggcggctcagcacacagtggcagaaaggagaggaagtgcaagtcatcgccgtggagcctggtaagaacccaaaaaatttccagactatgcccggcaccttccagacaaccactggggaaataggagcaatcgctctggattttaagcctggcacctcgggttcaccgattatcaacagagaggggaaggtagtcggactttatggcaatggcgtggttacaaaaaacgggggatacgtgtctggtattgcccagacgaatgctgagccagacggccccactcctgaattagaggaagagatgttcaagaaaaggaacctgaccatcatggatctccacccagggagtggaaagacacgtaaatatttgcccgcaatagtccgcgaagccattaagcggagactgaggaccctcatcctggcccctactcgagtggttgctgcggagatggaggaagcacttaagggcctgccgatccggtaccaaacaaccgccacgaaatccgagcatactggtcgcgaaattgtggacttgatgtgccacgctacatttaccatgagactactgagccccgtcagggtgccaaattataacctcatcataatggatgaggcccatttcaccgaccctgcatctattgccgctcgggggtacatcagcactcgagtaggaatgggcgaagcggccgcaatttttatgacagctacccccccaggcacagccgatgcattccctcagtccaatgcccccatccaggacgaggagagagacataccagaacgctcatggaacagtgggaatgagtggattactgattttgctggaaagacggtgtggttcgttccgagcatcaaagccggtaacgacatcgcgaactgtttaaggaagaatggcaaaaaggtcattcagctgtctcgtaagacctttgatacagaataccaaaaaactaagcttaacgactgggatttcgtggtgaccacagacatctccgagatgggggcaaattttaaagccgatcgggtcattgaccctagaaggtgcctgaagcccgtaatactcaccgatggaccagagcgcgtgatcttggctggccccatgcctgttactgccgcttcagcagcccagcgaagaggtcgggtggggaggaacccacagaaagaaaatgaccagtatattttcacgggccaacccctgaacaatgatgaggaccacgctcactggaccgaagccaagatgctcctggacaacatcaatacacctgagggaatcattccggcacttttcgaaccagagcgcgagaagagtgcggccatagatggcgaataccgtctaaaaggggagagcagaaagacttttgtcgaactgatgcggaggggagacttgcccgtgtggttagctcataaagttgcctccgagggtatcaagtataccgatcgcaaatggtgcttcgacggccagcgaaacaatcagattctggaagagaacatggatgtggagatctggacaaaggaaggggagaaaaagaagctcagacctcggtggctggacgcaaggacctactctgatccccttgctctgaaagaatttaaggacttcgccgcaggacgcaaatcgattgccctcgatttggtcactgagatcggcagagtgccaagccacctggctcataggacacggaatgcgctagacaacctggtaatgctccacacgtcagaacacggtgggcgtgcctatcgccatgcagtggaggagcttcctgaaaccatggagactctgttattgctgggcctcatgatactgcttacaggaggcgctatgctgtttctcatctccgggaagggaattggtaaaaccagtatcggcttgatttgtgttatcgcctctagcgggatgctgtggatggccgaaatacccttacagtggattgcatccgctatcgtcctagagttctttatgatggtgctgctcattccagagcctgaaaagcaacgaaccccgcaggataatcagcttgcctacgtggtcatcggaatactgacattggcggctatcattgccgcaaacgagatgggcctgctcgaaactacgaagagagacctgggtatgtcaaaagagcccggggttgtgtctccaaccagctatcttgatgtagacctccaccctgccagtgcttggacactgtacgcagtggccactaccgtcatcacacccatgttgaggcataccattgaaaattccactgcgaacgtgagcctggctgccatcgcaaaccaagccgttgtgttaatgggcctagacaagggatggccaatatctaaaatggatctgggcgtccctctccttgctctggggtgctactcacaggtaaatcccttgacgctgacagccgcagtgctcctgcttattacccactatgctatcatcggaccgggcttacaggccaaggcgactcgggaggcccagaaacgcaccgcagctggtattatgaagaacccaacagttgacgggatcatgactatagatctggaccctgtgatttacgattccaagttcgagaaacaactcggacaggtcatgttgctggtgctatgtgccgtccagctgctccttatgagaaccagttgggcactgtgcgaagctttgacactggccacgggccccatcaccactctctgggagggtagcccaggcaagttttggaatacaaccattgccgtgtcgatggcgaacatcttcagggggtcttatctggctggagcaggcttagccttttccataatgaaaagcgttgggactggaaagcggggcacaggttcacagggggaaacccttggagagaaatggaagaagaaactgaatcaactcagtcgaaaggaattcgacctatacaaaaagtctggcatcacggaggtggatagaaccgaggctaaagaaggtctgaagcgcggcgagattacacatcacgccgtatccagggggagcgcaaaattgcagtggtttgtggaacggaacatggtcatccccgagggacgtgttattgacctgggctgtgggagaggaggctggtcatattactgcgccggtctcaagaaggtgactgaagtcagggggtataccaaaggaggccctggccacgaggagccggtgcccatgagtacatacgggtggaatatcgtaaagcttatgagcggaaaagatgtgttctacctgccacctgaaaagtgtgacactttgctgtgcgatattggtgagtcctctcccagccctaccgttgaagagtcccgcacaatccgggtgctcaaaatggtcgagccatggttaaagaacaatcagttctgtataaaggtgctgaacccctatatgcctaccgtcattgaacatcttgagcgactgcagagaaaacacggcgggatgctagtgaggaatccactctcacgcaactctactcatgaaatgtactggatcagtaatggaacgggcaacatcgttgcttcggtaaatatggtgagccggctgttgctgaacagatttacaatgacccaccgtaggcccactattgagaaggacgtcgatctcggtgcggggacccggcacgtgaacgccgaaccggagacacctaatatggacgttataggagagcgcatcaaacgaattaaggaagagcataactccacgtggcactatgacgatgaaaatccatacaaaacctgggcatatcatggctcttacgaggtgaaggctactggctcagccagctccatgatcaacggggtcgtgaagcttctgacaaaaccctgggacgtagtgcctatggttacccaaatggcaatgactgatacaaccccattcggacagcagagagtctttaaggaaaaagtggacacaaggactccccggagtatggccggtacccgcagagtgatgggcattacggctgagtggttatggaggaccctggggcgaaataagaaaccgcggttgtgcacacgtgaggaattcactaagaaggtcagaaccaacgccgcgatgggagcagtttttacagaggaaaatcaatgggattctgccaaagctgccgtggaggacgaagatttctggaagctcgtagaccgcgagagggagctgcacaaactaggcaagtgtggtagctgcgtgtataacatgatggggaaacgggaaaagaaacttggagagtttggcaaggcaaagggctcaagagctatctggtacatgtggctgggggcccgctacctcgaattcgaggctctgggatttttgaatgaggatcattggttctccagggaaaacagttatagcggtgtcgagggcgaagggctgcacaaactcggatacatacttcgagacatctctaagattcctggcggtgccatgtatgcagatgacactgcggggtgggacacccggatcacggaggatgacctgcacaatgaagagaaaattacacagcagatggatcccgagcatagacagttagccaacgctatctttaagctgacctaccaaaataaagtggttaaggtgcagaggccaactcctacaggaaccgtcatggacataatttcccgcaaggatcagcgtggctcaggccaggtggggacttatggattgaacaccttcacaaatatggaagcccaactcatccggcagatggagggtgaaggcgtactgagcaaagcagacctagagaacccccaccttccagaaaagaaaatcacgcagtggctggagaccaagggggttgagagactcaaaaggatggctatttcgggagatgactgcgtggtcaagcccatagatgaccgctttgccaacgcactgttggccttaaatgatatgggcaaggtgcgaaaagacatccctcagtggcaaccatctaagggttggcatgattggcagcaggtgccgttctgtagtcaccacttccatgaactgattatgaaagacgggcggaagctcgtcgttccctgcagacctcaggacgagcttatcggaagggcgcgcatttcccaaggcgctggctggagcctgagagaaactgcctgtctagggaaagcatacgcccagatgtggtcactgatgtattttcaccggagggatctccgtttggcttccaacgccatctgctctgcagtgccagtacattgggtgcccacaagccgaaccacttggagtatacacgctcatcaccagtggatgacaaccgaggacatgctgacggtctggaatcgcgtgtggatcgaagataacccttggatggaggacaagacaccagttaccacttgggaggatgtgccctaccttggaaagagagaagaccaatggtgtggttccctgattggcctcaccagccgggccacatgggcgcagaatatccctactgctattcagcaggtcaggtctttaatcgggaacgaggaattcctggattacatgccgtcaatgaaacgctttagaaaggaggaggaaagtgagggagccatttggtga

SEQ ID NO: 15364 - RNA, 9873 nt, synthetic construct
  misc_feature 1..9873: note = derived and/or modified CDS sequence (opt3) from DENV-3__KJ189283__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagagatatggcccacaccctgattatgatcggcagtaatgcaagcgacaggatgggtatgggggttacatatcttgccttgattgctacctttaagatacagcccttcctggcgttaggatttttcctccgcaaactgacttctcgagaaaaccttctgctaggcgtgggcctcgccatggcaacaaccctgcagttgccggaggatatcgaacaaatggctaatgggattgccctgggattaatggccctcaagctgatcacacagtttgagacttaccagctttggaccgctctgatttccttgacgtgttcaaaaacaatcttcaccctcactgtcgcatggcggaccgccacactgatactagcgggtgtgagtctgcttcctgtttgccagagctcgtccatgcgtaagactgactggctcccaatggctgtggccgcaatgggcgtcccccctctgcccttgtttatcttctctctgaaggataccttaaaaagaaggagctggccactcaacgagggggtaatggccgtgggactggtttcaattcttgctagttccctgttgcgcaatgacgtgcctatggcaggccccctcgtcgccggtgggctgctaatcgcgtgttatgtgattacgggaacatctgctgatctgaccgtagaaaaggccgcagacatcacttgggaggaagaggccgaacaaacaggcgtgagccataaccttatgataaccgtcgacgatgacggcactatgcggattaaagatgacgagacagagaacatcctcaccgttctgttgaagacggctttactgatcgtgtccgggatttttccatactcaataccggccactctcctggtgtggcacacctggcagaaacagacacagagaagcggagtcctttgggatgtgcctagtcccccagaaacccaaaaggcagagctggaagagggtgtttacaggatcaaacagcagggcattttcgggaagacacaggtaggagtgggcgtccaaaaggagggtgtgtttcacactatgtggcatgttacccgaggggctgtgttgacgtataatggaaaacgcctagaacccaactgggcctctgtcaagaaagacctgatctcctacggcggcgggtggcggctcagcacacagtggcagaagggagaggaagtgcaagtaattgcggtcgagcctggtaaaaatccaaagaacttccagactatgcccggcaccttccagacaaccactggggaaatcggagccatagcactggattttaagcctggcacctcgggttcaccgatcattaatagagaggggaaagtggttggactttatggcaacggcgtggtcacaaagaatgggggatacgtgtctggtatcgctcagacgaacgccgagccagacggccccactcctgaattagaggaagagatgttcaaaaagaggaatctgaccattatggatctccacccagggagtggaaaaacacgtaagtatttgcccgctatcgttcgcgaagcaataaagcggagactgaggaccctcattctggcccctactcgagtggtcgccgctgagatggaggaagcgcttaaaggcctgccgatccggtaccaaacaaccgcaacgaagtccgagcatactggtcgcgaaatcgtggacttgatgtgccacgccacatttaccatgagactactgagccccgtaagggtgccaaactataatctcattatcatggatgaggctcatttcaccgaccctgcctctatagcagcccgggggtacattagcactcgagttggaatgggcgaagctgcggccatctttatgacagcaacccccccaggcacagctgatgccttccctcagtccaacgcacccattcaggacgaggagagagacatcccagaacgctcatggaatagtgggaacgagtggataactgattttgccggaaaaacggtctggttcgtgccgagcattaaggctggtaatgacatcgccaactgtttaaggaaaaacggcaagaaggtgatccagctgtctcgtaaaacctttgatacagaataccaaaagactaaacttaatgactgggatttcgtcgtaaccacagacatttccgagatgggggcgaactttaaggcagatcgggtgatcgaccctagaaggtgcctgaaacccgttattctcaccgatggaccagagcgcgtgatattggccggccccatgcctgtcactgctgcctcagctgcacagcgaagaggtcgggtggggaggaatccacagaaggaaaacgaccagtatatcttcacgggccaacccctgaataacgatgaggaccacgcccactggaccgaagctaagatgctcctggacaatattaacacacctgagggaatcatcccggcccttttcgaaccagagcgcgagaaaagtgcagcgattgatggcgaataccgtctaaagggggagagcagaaaaacttttgttgaactgatgcggaggggagacttgcccgtgtggttagcccataaggtcgcttccgagggtataaaatataccgatcgcaagtggtgcttcgacggccagcgaaataaccagatcctggaagagaatatggatgtggagatttggacaaaagaaggggagaagaagaaactcagacctcggtggctggacgccaggacctactctgatccccttgcactgaaggaatttaaagacttcgctgccggacgcaagtcgatcgcactcgatttggtaactgagattggcagagtgccaagccacctggcccataggacacggaacgctctagacaatctggttatgctccacacgtcagaacacggtgggcgtgcgtatcgccatgccgtcgaggagcttcctgaaaccatggagactctgttattgctgggcctcatgatcctgcttacaggaggcgcaatgctgtttctcatatccgggaaaggaatcggtaagaccagtattggcttgatctgtgtgattgcttctagcgggatgctgtggatggccgaaatccccttacagtggatagcctccgcaattgtgctagagttctttatgatggtcctgctcatcccagagcctgaaaagcaacgaaccccgcaggataaccagcttgcttacgttgtgattggaatcctgacattggccgcgataatcgctgccaatgagatgggcctgctcgaaactacgaaaagagacctgggtatgtcaaaggagcccggggtagtgtctccaaccagctatcttgatgtcgacctccaccctgcaagtgcctggacactgtacgctgtggcaactaccgttattacacccatgttgaggcataccatcgaaaactccactgccaatgtgagcctggcggctattgccaaccaagcagtcgtattaatgggcctagacaaaggatggccaatctctaagatggatctgggcgtgcctctccttgccctggggtgctactcacaggttaaccccttgacgctgacagctgccgtgctcctgcttataacccactatgcaattatcggaccgggcttacaggctaaagccactcgggaggcgcagaagcgcaccgccgcaggtatcatgaagaatccaacagtcgacgggattatgactatcgatctggaccctgtgatatacgattccaaattcgagaagcaactcggacaggtcatgttgctggtgctatgtgctgttcagctgctccttatgagaaccagttgggccctgtgcgaagcattgacactggctacgggccccattaccactctctgggagggtagcccaggcaaattttggaacacaaccatcgccgtgtcgatggccaatattttcagggggtcttatctggcgggagctggcttagcattttccatcatgaagagcgtagggactggaaaacggggcacaggttcacagggggaaacccttggagagaagtggaagaaaaagctgaaccaactcagtcgaaaagaattcgacctatacaagaaatctggcataacggaggtggatagaaccgaggccaaggaaggtctgaaacgcggcgagatcacacatcacgctgtctccagggggagcgccaagttgcagtggtttgttgaacggaatatggtgattcccgagggacgtgtcatcgacctgggctgtgggagaggaggctggtcatattactgcgcaggtctcaagaaagtgactgaagtaagggggtataccaagggaggccctggccacgaggagccggtgcccatgagtacatacgggtggaacattgttaaacttatgagcggaaaggatgtgttctacctgccacctgaaaaatgtgacactttgctgtgcgatatcggtgagtcctctcccagccctaccgtcgaagagtcccgcacaattcgggtgctcaagatggtcgagccatggttaaagaataaccagttctgtatcaaagtgctgaatccctatatgcctaccgttatagaacatcttgagcgactgcagagaaagcacggcgggatgctagtaaggaacccactctcacgcaattctactcatgaaatgtactggattagtaacggaacgggcaatatcgtggcctcggtcaacatggtgagccggctgttgctgaatagatttacaatgacccaccgtaggcccactatcgagaaagacgttgatctcggtgctgggacccggcacgtgaacgcggaaccggagacacctaacatggacgtcattggagagcgcataaagcgaatcaaagaagagcataattccacgtggcactatgacgatgaaaacccatacaagacctgggcctatcatggctcttacgaggtgaaggcaactggctcagctagctccatgattaatggggtagtgaaacttctgacaaagccctgggacgttgtccctatggtgacccaaatggccatgactgatacaaccccattcggacagcagagagtgtttaaagaaaaggtcgacacaaggactccccggagtatgccgggtacccgcagagttatgggcatcacggcagagtggttatggaggaccctggggcgaaacaaaaagcctcggttgtgcacacgtgaggaattcactaagaaagtgagaaccaatgccgctatgggagccgtatttacagaggaaaaccaatgggattctgcgaaggcagccgtggaggacgaagatttctggaaactcgtcgaccgcgagagggagctgcacaagctaggcaaatgtggtagctgcgtgtataatatgatggggaagcgggaaaaaaagcttggagagtttggcaaggctaaaggctcaagagccatttggtacatgtggctgggggcacgctacctcgaattcgaggctctgggatttttgaacgaggatcattggttctccagggaaaatagttatagcggtgttgagggcgaagggctgcacaagctcggatacatccttcgagacatatctaaaatccccggcggtgccatgtatgctgatgacactgccgggtgggacacccggattacggaggatgacctgcacaacgaagagaagatcacacagcagatggatccagagcatagacagttagcaaatgcgatttttaaactgacctaccaaaacaaggtggtcaaggtgcagaggcctactcccacaggaaccgtaatggacatcatatcccgcaaagatcagcgtggctcaggccaggttgggacttatggattgaataccttcacaaacatggaagcccaactcattcggcagatggagggtgaaggcgtgctgagcaaggctgacctagagaatccacaccttcccgaaaaaaagatcacgcagtggctggagaccaaaggggtcgagagactcaagaggatggccatctcgggagatgactgcgtggtgaagcctattgatgaccgctttgcaaacgctctgttggccttaaacgatatgggcaaagtccgaaaggacataccacagtggcaaccgtctaaaggttggcatgattggcagcaggttcccttctgtagtcaccacttccatgaactgatcatgaaggacgggcggaaactcgtggtaccttgcagaccacaggacgagcttattggaagggcacgcatctcccaaggcgccggctggagcctgagagaaactgcgtgtctagggaaggcttacgcccagatgtggtcactgatgtattttcaccggagggatctccgtttggcatccaatgccatttgctctgctgtgcccgtccattgggtgcctacaagccgaaccacttggagtatccacgcccatcaccagtggatgacaaccgaggacatgctgacggtttggaaccgcgtgtggatagaagataatccatggatggaggacaagacacccgtcaccacttgggaggatgtgccttaccttggaaaaagagaagaccaatggtgtggttccctgatcggcctcaccagccgggcaacatgggctcagaacattttaactgccatccagcaggtaaggtctctgattgggaatgaggaattcttggattacatgccgtcaatgaagcgctttagaaaagaggaggaaagtgagggagcgatctggtga

SEQ ID NO: 15365 - RNA, 9873 nt, synthetic construct
  misc_feature 1..9873: note = derived and/or modified CDS sequence (opt3) from DENV-3__KJ189284__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggtgaccctcccagaatatggaactcttggcctggagtgctctccgcgaaccggtttggacttcaatgagatgatcctactgacaatgaaaaacaaggcctggatggtacatagacagtggtttttcgatctccccctgccttggaccagcggggcgactacagaaacgccaacctggaataggaaagagcttctggttacttttaagaacgcccacgcaaaaaagcaagaagtggtcgtgttgggctcccaggagggagctatgcacacagccctcaccggcgctacagaaatccagaattcagggggaactagtattttcgccggtcatctgaagtgtcggttaaaaatggacaagctggagctaaaaggcatgagctacgcaatgtgcaccaacacgtttgtcctcaagaaagaggtgtctgaaacccagcacgggacaatactgatcaaggttgagtacaagggagaagatgccccctgtaaaattcctttctccactgaggacggccatggtaaggctcacaacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccatcaaatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccacacctggactgaacagtacaaatttcaggcagattctcccaagcggctagccaccgctattgccggtgcatgggagaatggcgtttgtgggatccgaagcacaacgcgcatggaaaacctcctgtggaaacaaatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcagaacagttccttcataattgatggccccaataccccagagtgccccagcgcctctagggcttggaacgtttgggaagtggaggactatggttttggggtcttcacgacaaatatctggctgcggcttcgcgaagtgtacacccaattgtgtgaccacagactcatgtcagcagccgttaaagatgagagggctgtgcatgccgacatgggatactggattgagagtcagaagaacggcagctggaaactggaaaaggcatccctaatcgaggtaaaaacttgcacctggcctaagtctcacacactgtggtcgaatggtgtcctcgaaagcgatatgataatcccaaagtccctggcgggcccgatttcacagcataaccaccgtcccgggtatcacactcagaccgccggaccttggcatcttggcaaattggagctggactttaattactgcgaggggacaacggtggtgatcaccgaaaactgtggaactcggggcccaagtttacgaacaaccactgtctctggtaagctcattcacgagtggtgctgtagaagctgcacactgccccctcttaggtatatgggggaagatggatgttggtacggcatggagatccgcccaatatccgaaaaagaggagaatatggttaagtcactggtgagcgctggttctggcaaagtagacaacttcaccatgggggtgttgtgcctcgccattctgtttgaagaggtcatgcggggaaagttcggcaagaaacatatgatcgcaggggtgttctttacgttcgttctactgctctccggacaaatcacttggagagatatggctcacaccctgattatgatcggcagtaatgccagcgacaggatgggtatgggggtgacatatcttgcattgattgccacctttaagatacagcccttcctggctttaggatttttcctccgcaaactgacttctcgagaaaaccttctgctaggcgtcggcctcgcgatggccacaaccctgcagttgccggaggatatcgaacaaatggcaaatgggattgctctgggattaatggccctcaagctgatcacacagtttgagacttaccagctttggaccgccctgatttccttgacgtgttcaaacacaatcttcaccctcactgtggcttggcggaccgcaacactgatactagccggtgttagtctgcttcctgtgtgccagagctcgtccatgcgtaaaactgactggctcccaatggcggtcgctgccatgggcgtaccccctctgcccttgtttatcttctctctgaaggataccttaaagagaaggagctggccactcaatgagggggtgatggcagttggactggtgtcaattcttgccagttccctgttgcgcaacgacgtccctatggctggccccctcgtggcaggtgggctgctaatcgcctgttatgtaattacgggaacatctgcggatctgaccgtggaaaaagctgccgacatcacttgggaggaagaggcagaacaaacaggcgtcagccataaccttatgataaccgttgacgatgacggcactatgcggattaaggatgacgagacagagaatatcctcaccgtgctgttgaaaacggccttactgatcgtgtccgggatttttccatactcaataccggctactctcctggtctggcacacctggcagaagcagacacagagaagcggagtgctttgggatgttcctagtcccccagaaacccaaaaagccgagctggaagagggtgtatacaggatcaagcagcagggcattttcgggaaaacacaggtgggagtcggcgtgcaaaaggagggtgtttttcacactatgtggcatgtgacccgaggggcagtcttgacgtataacggaaagcgcctagaacccaattgggcttctgtgaaaaaggacctgatctcctacggcggcgggtggcggctcagcacacagtggcagaaaggagaggaagtacaagtcattgccgtggagcctggtaagaacccaaaaaatttccagactatgcccggcaccttccagacaaccactggggaaatcggagcgatagccctggattttaagcctggcacctcgggttcaccgatcattaacagagaggggaaggttgtgggactttatggcaatggcgtcgtgacaaaaaacgggggatacgtttctggtatcgcacagacgaatgctgagccagacggccccactcctgaattagaggaagagatgttcaagaaaaggaacctgaccattatggatctccacccagggagtggaaagacacgtaaatatttgcccgccatcgtgcgcgaagctataaagcggagactgaggaccctcattctggcacctactcgagtcgtggccgccgagatggaggaagctcttaagggcctgccgatccggtaccaaacaaccgcgacgaaatccgagcatactggtcgcgaaatcgtagacttgatgtgccacgcaacatttaccatgagactactgagccccgtgagggttccaaattataacctcattatcatggatgaggcccatttcaccgaccctgcttctatagccgcacgggggtacattagcactcgagtcggaatgggcgaagccgctgcgatctttatgacagccacccccccaggcacagcagatgctttccctcagtccaatgcccccattcaggacgaggagagagacatcccagaacgctcatggaacagtgggaatgagtggataactgattttgcaggaaagacggtgtggttcgtgccgagcattaaagccggtaacgacatcgctaactgtttaaggaagaatggcaaaaaggtcatccagctgtctcgtaagacctttgatacagaataccaaaaaactaagcttaacgactgggatttcgtagtgaccacagacatttccgagatgggggccaattttaaagcggatcgggttatcgaccctagaaggtgcctgaagcccgtgattctcaccgatggaccagagcgcgtcatattggcaggccccatgcctgtgactgccgcttcagccgctcagcgaagaggtcgggttgggaggaacccacagaaagaaaatgaccagtatatcttcacgggccaacccctgaacaatgatgaggaccacgcacactggaccgaagccaagatgctcctggacaacattaatacacctgagggaatcatcccggctcttttcgaaccagagcgcgagaagagtgccgcaattgatggcgaataccgtctaaaaggggagagcagaaagacttttgtggaactgatgcggaggggagacttgcccgtctggttagcgcataaagtggcctccgagggtataaagtataccgatcgcaaatggtgcttcgacggccagcgaaacaatcagatcctggaagagaacatggatgtagagatttggacaaaggaaggggagaaaaagaagctcagacctcggtggctggacgctaggacctactctgatccccttgccctgaaagaatttaaggacttcgcagctggacgcaaatcgatcgccctcgatttggtgactgagattggcagagttccaagccacctggcacataggacacggaatgccctagacaacctggtcatgctccacacgtcagaacacggtgggcgtgcttatcgccatgcggtggaggagcttcctgaaaccatggagactctgttattgctgggcctcatgatcctgcttacaggaggcgccatgctgtttctcatatccgggaagggaatcggtaaaaccagtattggcttgatctgtgtgattgcatctagcgggatgctgtggatggctgaaatccccttacagtggatagcctccgccattgtcctagagttctttatgatggttctgctcatcccagagcctgaaaagcaacgaaccccgcaggataatcagcttgcatacgtggtaattggaatcctgacattggctgccataatcgcggctaacgagatgggcctgctcgaaactacgaagagagacctgggtatgtcaaaagagcccggggtggtctctccaaccagctatcttgatgtggacctccaccctgccagtgcatggacactgtacgccgttgctactaccgtgattacacccatgttgaggcataccatcgaaaattccactgcaaacgtcagcctggccgcgattgctaaccaagccgtagtgttaatgggcctagacaagggatggccaatctctaaaatggatctgggcgttcctctccttgcactggggtgctactcacaggtgaatcccttgacgctgacagccgctgtcctcctgcttataacccactatgccattatcggaccgggcttacaggcaaaggctactcgggaggcccagaaacgcaccgcggccggtatcatgaagaacccaacagtggacgggattatgactatcgatctggaccctgtcatatacgattccaagttcgagaaacaactcggacaggtgatgttgctggttctatgtgcagtgcagctgctccttatgagaaccagttgggctctgtgcgaagccttgacactggcaacgggccccattaccactctctgggagggtagcccaggcaagttttggaatacaaccatcgctgtatcgatggccaacattttcagggggtcttatctggccggagcgggcttagctttttccatcatgaaaagcgtggggactggaaagcggggcacaggttcacagggggaaacccttggagagaaatggaagaagaaactgaatcaactcagtcgaaaggaattcgacctatacaaaaagtctggcataacggaggtcgatagaaccgaggcaaaagaaggtctgaagcgcggcgagatcacacatcacgccgtttccagggggagcgctaaattgcagtggtttgtggaacggaacatggtcattcccgagggacgtgtgatcgacctgggctgtgggagaggaggctggtcatattactgcgccggtctcaagaaggtaactgaagtgagggggtataccaaaggaggccctggccacgaggagccggttcccatgagtacatacgggtggaatattgtgaagcttatgagcggaaaagatgtcttctacctgccacctgaaaagtgtgacactttgctgtgcgatatcggtgagtcctctcccagccctaccgtggaagagtcccgcacaattcgggtcctcaaaatggtggagccatggttaaagaacaatcagttctgtatcaaggttctgaacccctatatgcctaccgtaatagaacatcttgagcgactgcagagaaaacacggcgggatgctagtgaggaatccactctcacgcaactctactcatgaaatgtactggattagtaatggaacgggcaacatcgtcgcatcggtgaatatggttagccggctgttgctgaacagatttacaatgacccaccgtaggcccactatcgagaaggacgtggatctcggtgccgggacccggcacgtcaacgctgaaccggagacacctaatatggacgtgattggagagcgcataaaacgaatcaaggaagagcataactccacgtggcactatgacgatgaaaatccatacaaaacctgggcgtatcatggctcttacgaggtaaaggccactggctcagcaagctccatgattaacggggtggttaagcttctgacaaaaccctgggacgtcgtgcctatggtgacccaaatggctatgactgatacaaccccattcggacagcagagagtctttaaggaaaaagttgacacaaggactccccggagtatgccgggtacccgcagagtgatgggcatcacggccgagtggttatggaggaccctggggcgaaataagaaacctcggttgtgcacacgtgaggaattcactaagaaggtaagaaccaacgcagccatgggagctgtgtttacagaggaaaatcaatgggattctgccaaagcggcagtcgaggacgaagatttctggaagctcgtggaccgcgagagggagctgcacaaactaggcaagtgtggtagctgcgtttataacatgatggggaaacgggaaaagaaacttggagagtttggcaaggccaagggctcaagagctatttggtacatgtggctgggggcccgctacctcgaattcgaggcactgggatttttgaatgaggatcattggttctccagggaaaacagttatagcggtgtggagggcgaagggctgcacaaactcggatacatccttcgagacatatctaagatccccggcggtgctatgtatgccgatgacactgctgggtgggacacccggattacggaggatgacctgcacaatgaagagaaaatcacacagcagatggatccagagcatagacagttagccaacgcaatttttaagctgacctaccaaaataaagtcgtgaaggtacagaggcctactcccacaggaaccgttatggacatcatatcccgcaaggatcagcgtggctcaggccaggtggggacttatggattgaacaccttcacaaatatggaagcgcaactcattcggcagatggagggtgaaggcgtcctgagcaaagccgacctagagaacccacaccttcccgaaaagaaaatcacgcagtggctggagaccaagggggtggagagactcaaaaggatggctatctcgggagatgactgcgtggtcaagcctattgatgaccgctttgccaacgcactgttggctttaaatgatatgggcaaggttcgaaaagacataccacagtggcaaccgtctaagggttggcatgattggcagcaggtgcccttctgtagtcaccacttccatgaactgatcatgaaagacgggcggaagctcgtagtgccttgcagaccacaggacgagcttattggaagggcccgcatctcccaaggcgcaggctggagcctgagagaaactgcctgtctagggaaagcgtacgctcagatgtggtcactgatgtattttcaccggagggatctccgtttggcctccaacgcaatttgctctgccgtccccgtgcattgggttcctacaagccgaaccacttggagtatccacgctcatcaccagtggatgacaaccgaggacatgctgacggtgtggaatcgcgtctggatagaagataacccatggatggaggacaagacacccgtgaccacttgggaggatgtaccttaccttggaaagagagaagaccaatggtgtggttccctgatcggcctcaccagccgggccacatgggcacagaatattccgactgctatccagcaggttaggtctttaattgggaacgaggaattcctggattacatgccatcaatgaaacgctttagaaaggaggaggaaagtgagggagccatctggtga

SEQ ID NO: 15366 - RNA, 9873 nt, synthetic construct
  misc_feature 1..9873: note = derived and/or modified CDS sequence (opt3) from DENV-3__KJ189286__SS-prME
  source 1..9873: mol_type = other RNA
accagcttctgcctgatgatgatcctccccgcagctcttgcatttcacctgacctccagagacggcgagcctaggatgattgtggggaagaacgaacggggaaaatctttgttattcaagactgcctcaggtataaatatgtgtacgctgatcgcgatggatttgggcgagatgtgcgacgataccgtcacatacaaatgtccacatattactgaagttgagccggaagacatcgattgctggtgtaacctcaccagtacatgggtgacctatgggacttgcaatcaggctggagagcaccgccgagacaagcgtagcgtcgccctggcaccccatgtgggcatgggtcttgatacaagaacccaaacgtggatgtccgccgagggggcttggaggcaggtcgaaaaagtggagacttgggcactgcggcaccctggatttaccattttggccctcttcctggctcattacatcggcacatctctgactcagaaggttgtgatatttatcctcttaatgctggtcaccccatcgatgacaatgcgctgtgtgggcgtagggaacagagacttcgttgaaggactttcaggtgccacctgggtggatgtcgtgttggagcacggcgggtgcgtgacgactatggcgaagaataaacccacactggacattgagctacagaagaccgaagcaactcaactcgccacactgaggaaactttgtatcgagggaaagattaccaacatcacgaccgatagccggtgccctacacagggcgaagctgtcctgccagaggaacaggaccagaattatgtttgtaaacacacttacgtggatcgcggttgggggaacggatgcggcttgtttggcaaggggagtctcgtaacctgcgccaagttccaatgtctggagcccatagagggaaaagtggtccagtatgaaaatttaaagtacacagtgattatcactgttcataccggtgaccagcaccaggtgggcaacgagacacaaggggtcaccgcagaaattactcctcaggcttccacgacagaggccaccctgccagaatatggaactctcggccttgagtgctctccgcgaaccggtctggactttaatgagatgatcttgctaacaatgaaaaacaaggcgtggatggtgcatagacagtggttctttgatctgcccctcccttggaccagcggggccactacagaaacgccaacctggaataggaaagagctgcttgtaactttcaagaacgcacacgctaaaaagcaagaagttgtggtcctgggctcccaggagggagccatgcacacagctttgaccggcgccacagaaatccaaaattcagggggaacaagcatttttgcaggtcatctcaagtgtcggctgaaaatggacaagttagagctgaaaggcatgagctacgccatgtgcaccaacacgttcgtgctaaagaaagaggtctctgaaacccagcacgggacaatactcatcaaggtggagtacaagggagaagatgctccctgtaaaattcctttctccactgaggacggccatggtaaggcgcacaacgggcgtctgatcaccgcaaatccagttgtgactaagaaagaggaacccgtaaacatagaggccgaaccgccttttggcgagtcaaatattgtcatcggaatcggcgataacgctcttaaaattaattggtataaaaaggggagcagtatcggaaaaatgttcgaagccactgcacgcggtgccagaaggatggctattttgggcgacaccgcctgggattttgggtctgtgggaggcgttctgaactccctcggtaagatggtgcatcaaatattcgggagcgcatacacggcgctgttttcgggcgtctcttgggtgatgaaaatcggaattggcgtacttctgacatggatcgggctaaattccaagaacacctcaatgagtttcagctgcatcgctattggaataatcactctctatctgggcgccgtggttcaggcagacatgggttgtgtcattaattggaaagggaaggagttaaagtgcggatccggcatctttgtgacaaacgaggtgcacacctggactgaacagtacaaattccaggccgattctcccaagcggctggctaccgccattgccggtgcttgggagaatggcgtctgtgggatccgaagcacaacgcgcatggaaaacctactctggaaacaaatagccaatgagctgaactatatcctttgggaaaataacattaagttgaccgttgtggtgggagacatcattggcgtactggagcaggggaaaagaactctcacaccacagcctatggagctgaagtactcatggaaaacctggggaaaggcgaagatcgtcacagccgaaactcagaacagttcctttataattgatggccccaataccccagagtgccccagcgcttctagggcatggaacgtgtgggaagttgaggactatggtttcggggtgtttacgacaaatatctggttacggctgcgcgaagtctacacccaactttgtgaccacagattgatgtcagccgctgtgaaagatgagagggccgttcatgcagacatgggatactggattgagagtcagaagaacggcagctggaaactcgaaaaggcgtccctgatcgaggtgaaaacttgcacctggcctaagtctcacacactatggtcgaatggtgtactggaaagcgatatgataatcccaaagtccctcgccggcccgatttcacagcataaccaccgtcccgggtatcacactcagaccgctggaccttggcatctgggcaaacttgagttggacttcaattactgcgaggggacaacggtcgtgatcaccgaaaactgtggaactcggggcccaagtctgcgaacaaccactgtgtctggtaagttaattcacgagtggtgctgtagaagctgcacactcccacctctgaggtatatgggggaagatggatgttggtacggcatggagatccgcccaatatccgaaaaagaggagaatatggtcaagtcacttgttagcgccggttctggcaaagtggacaactttaccatgggggtactgtgcttggcaattctcttcgaagaggtgatgcggggaaagttcggcaagaaacatatgatcgctggggtctttttcacgtttgtgctgctactgtccggacaaatcacttggagagatatggcccacaccctcattatgatcggcagtaatgcaagcgacaggatgggtatgggggttacatatctggcccttattgctaccttcaagatacagccctttttggcgctgggattctttttacgcaaactcacttctcgagaaaacctgcttctgggcgtgggcctagccatggcaacaaccctccagctgccggaggatatcgaacaaatggctaatgggattgccttgggactgatggccttaaagctcatcacacagttcgagacttaccagctgtggaccgctcttatttccctgacgtgttcaaacacaatctttaccttgactgtcgcatggcggaccgccacactcatactggcgggtgtgagtctactgcctgtttgccagagctcgtccatgcgtaaaactgactggcttccaatggctgtggccgcaatgggcgtaccccctctccccctgttcatctttaatttgaaggataccctgaagagaaggtcttggccattaaacgagggggtaatggccgtgggactcgttagcattctggcttcaagtcttctgcgcaacgacgtgcctatggcaggccccttggtcgccggtgggctcctgatcgcgtgttatgtgattacgggaacatccgctgatctaaccgtagaaaaagccgcagacatcacttgggaggaagaggccgaacaaacaggcgtgtctcataatctgatgataaccgtcgacgatgacggcactatgcggattaaggatgacgagacagagaacatccttaccgttctcctgaaaacggctttgttaatcgtgagcgggattttcccatactccataccggccactctgctcgtgtggcacacctggcagaagcagacacagagatcaggagtcctgtgggatgtgcctagtcccccagaaacccaaaaagcagagcttgaagagggtgtttacaggatcaagcagcagggcatttttgggaaaacacaggtaggagtgggcgtccaaaaggagggtgtgttccacactatgtggcatgttacccgaggggctgtgctgacgtataatggaaagcgcttggaacccaactgggccagtgtcaaaaaggacctaatctcttacggcggcgggtggcggctgtccacacagtggcagaaaggagaggaagtgcaagtaattgcggtcgagcctggtaagaatcccaaaaatttccagactatgcccggcacctttcagacaaccactggggaaatcggagccatagcactcgatttcaagcctggcaccagcggttcgccgatcattaatagagaggggaaggtggttggactgtatggcaacggcgtggtcaccaaaaatgggggatacgtgtcaggtatcgctcagacgaacgccgagccagacggccccactcctgaacttgaggaagagatgtttaagaaaaggaatttaaccattatggatctgcacccagggtctggaaagacacgtaaatatctccccgctatcgttcgcgaagcaataaagcggagattgaggaccctgattctcgcccctactcgagtggtcgccgctgagatggaggaagcgctgaagggccttccgatccggtaccaaacaaccgcaacgaaaagtgagcatactggtcgcgaaatcgtggacctgatgtgccacgccacattcaccatgagattgctatcccccgtaagggtgccaaactataatctgattatcatggatgaggctcattttaccgaccctgccagcatagcagcccgggggtacatttctactcgagttggaatgggcgaagctgcggccatcttcatgacagcaacacccccaggcacagctgatgcctttcctcagagcaacgcacccattcaggacgaggagagagacatcccagaacgctcctggaactcagggaacgagtggataactgatttcgccggaaagacggtctggtttgtgccgagtattaaagctggtaacgacatcgccaattgtctcaggaagaacggcaaaaaggtgatccagttaagccgtaagaccttcgatacagaataccagaaaactaagctgaatgactgggattttgtcgtaaccacagacatttctgagatgggggcgaacttcaaagcagatcgggtgatcgaccctagaaggtgccttaagcccgttattctgaccgatggaccagagcgcgtgatactcgccggccccatgcctgtcactgctgcctccgctgcacagcgaagaggtcgggtggggaggaatccacagaaagaaaacgaccagtatatcttcacgggccaacccttgaataacgatgaggaccacgcccactggaccgaagctaagatgctgctcgacaatattaacacacctgagggaatcatcccggccctgtttgaaccagagcgcgagaagtcagcagcgattgatggcgaataccgtcttaaaggggagagtagaaagactttcgttgaactaatgcggaggggagacctgcccgtgtggttggcccataaagtcgctagcgagggtataaagtataccgatcgcaaatggtgctttgacggccagcgaaataaccagatcttagaagagaatatggatgtggagatttggacaaaggaaggggagaaaaagaagctgagacctcggtggctcgacgccaggacctactccgatcccctggcacttaaagagttcaaggactttgctgccggacgcaaatctatcgcactggatctcgtaactgagattggcagagtgccatcgcacttggcccataggacacggaacgctctggacaatctagttatgctgcacacgagcgaacacggtgggcgtgcgtatcgccatgccgtcgaggagctccctgaaaccatggagactcttctgttattgggcctgatgatcctcctgacaggaggcgcaatgcttttcctgatatcagggaagggaatcggtaaaacctccattggcctcatctgtgtgattgctagttctgggatgttgtggatggccgaaatccccctgcagtggatagccagcgcaattgtgttagagtttttcatgatggtcctactgatcccagagcctgaaaagcaacgaaccccgcaggataaccagctcgcttacgttgtgattggaatccttacactggccgcgataatcgctgccaatgagatgggcttgctggaaactacgaagagagacctcggtatgtccaaagagcccggggtagtgtcaccaacctcttatctggatgtcgaccttcaccctgcaagcgcctggacactctacgctgtggcaactaccgttattacacccatgctgaggcataccatcgaaaacagtactgccaacgtgtccttggcggctattgccaatcaagcagtcgtactgatgggcttagacaagggatggccaatcagcaaaatggatctaggcgtgcctctgctcgcccttgggtgctactctcaggttaaccccctgacgttgacagctgccgtgctgctcctgataacccactatgcaattatcggaccgggccttcaggctaaggccactcgggaggcgcagaaacgcaccgccgcaggtatcatgaagaatccaacagtcgacgggattatgactatcgatttagaccctgtgatatacgattcaaagtttgagaaacaactgggacaggtcatgctcttggtgctgtgtgctgttcagctactgctcatgagaacctcctgggccctttgcgaagcactgacattggctacgggccccattaccactctgtgggagggtagtccaggcaagttctggaacacaaccatcgccgtgagcatggccaatatttttagggggtcgtatctcgcgggagctggcctggcattctctatcatgaaatccgtagggactggaaagcggggcacaggtagccagggggaaaccttaggagagaaatggaagaagaaacttaaccaactgtcacgaaaggaatttgacctctacaaaaagagtggcataacggaggtggatagaaccgaggccaaagaaggtctaaagcgcggcgagatcacacatcacgctgtctctagggggtccgccaaactgcagtggttcgttgaacggaatatggtgattcccgagggacgtgtcatcgacttgggctgtgggagaggaggctggagctattactgcgcaggtctgaagaaggtgactgaagtaagggggtataccaaaggaggccctggccacgaggagccggtgcccatgtcaacatacgggtggaacattgttaagctcatgagtggaaaagatgtgttctaccttccacctgaaaagtgtgacactctgttgtgcgatatcggtgagagctccccctctcctaccgtcgaagagagccgcacaattcgggtgctgaaaatggtcgagccatggctcaagaataaccagttttgtatcaaggtgttaaatccctatatgcctaccgttatagaacatctggagcgacttcagagaaaacacggcgggatgctggtaaggaacccactatcccgcaattcaactcatgaaatgtactggatttctaacggaacgggcaatatcgtggccagtgtcaacatggtgtcgcggctcctgttgaacagattcacaatgacccaccgtaggcccactatcgagaaggacgttgatctgggtgctgggacccggcacgtgaatgcggaaccggagacacctaacatggacgtcattggagagcgcataaaacgaatcaaggaagaacataatagcacgtggcactatgacgatgaaaacccatacaaaacctgggcctatcatggctcctacgaggtgaaggcaactggctctgcttcaagcatgattaatggggtagtgaagctccttacaaaaccctgggacgttgtccctatggtgacccaaatggccatgactgatacaaccccatttggacagcagagagtgttcaaggaaaaagtcgacacaaggactccccggtccatgccgggtacccgcagagttatgggcatcacggcagagtggctgtggaggaccttagggcgaaacaagaaacctcggctgtgcacacgtgaggaatttactaagaaggtgagaaccaatgccgctatgggagccgtattcacagaggaaaaccaatgggatagtgcgaaagcagccgtggaggacgaagatttttggaagttggtcgaccgcgagagggagctccacaaactgggcaagtgtggttcttgcgtgtataatatgatggggaaacgggaaaagaaactaggagagttcggcaaggctaagggcagcagagccatttggtacatgtggcttggggcacgctacctggaatttgaggctctcggattcctgaacgaggatcattggttttcaagggaaaattcctatagtggtgttgagggcgaagggttgcacaaactgggatacatcctccgagacataagcaagatccccggcggtgccatgtatgctgatgacactgccgggtgggacacccggattacggaggatgaccttcacaacgaagagaaaatcacacagcagatggatccagagcatagacagctggcaaatgcgattttcaagttaacctaccaaaacaaagtggtcaaggtgcagaggcctactcccacaggaaccgtaatggacatcatatctcgcaaggatcagcgtggctccggccaggttgggacttatggactgaatacctttacaaacatggaagcccaattgattcggcagatggagggtgaaggcgtgctctcaaaagctgacctggagaacccacacctacccgaaaagaaaatcacgcagtggcttgagaccaagggggtcgagagactgaaaaggatggccatcagcggagatgactgcgtggtgaagcctattgatgaccgcttcgcaaatgctctcctggccttgaacgatatgggcaaggtccgaaaagacataccacagtggcaaccgtcgaagggttggcatgattggcagcaggttcccttctgttctcaccactttcatgaattaatcatgaaagacgggcggaagctggtggtaccttgcagaccacaggacgagctcattggaagggcacgcatcagtcaaggcgccggctggtcccttagagaaactgcgtgtctggggaaggcttacgcccagatgtggagcctaatgtatttccaccggagggatctgcgtctcgcatcaaatgccatttgctccgctgtgcccgtccattgggtgcctacatctcgaaccacttggagcatccacgcccatcaccagtggatgacaaccgaggacatgttgacggtttggaaccgcgtgtggatagaagataatccatggatggaggacaagacacccgtcaccacttgggaggatgtgccttacctgggaaagagagaagaccaatggtgtggtagtcttatcggcctgacctcccgggcaacatgggctcagaacattccgactgccatccagcaggtaaggagcctcattgggaatgaggaatttttagattacatgccatctatgaaacgcttcagaaaggaggaggaatcagagggagcgatctggtga

SEQ ID NO: 15367 - RNA, 9873 nt, synthetic construct
  misc_feature 1..9873: note = derived and/or modified CDS sequence (opt3) from DENV-3__KJ189287__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcatcctcgagcaggggaaaagaactctgacaccacagcctatggagttaaagtactcatggaaaacctggggaaaggcgaagatagtaacagccgaaactcagaacagttccttcattatcgatggccccaataccccagagtgccccagcgcttctagggcatggaacgtctgggaagtggaggactatggttttggggttttcacgacaaatatttggctgcggcttcgcgaagtgtacacccaattgtgtgaccacagactcatgtcagccgctgtcaaagatgagagggccgtgcatgcagacatgggatactggatcgagagtcagaagaacggcagctggaaactggaaaaggcgtccctaatagaggttaaaacttgcacctggcctaagtctcacacactgtggtcgaatggtgtgctcgaaagcgatatgatcattccaaagtccctggccggcccgatctcacagcataaccaccgtcccgggtatcacactcagaccgctggaccttggcatcttggcaaattggagctggactttaattactgcgaggggacaacggtagtcattaccgaaaactgtggaactcggggcccaagtttacgaacaaccactgtgtctggtaagctcatccacgagtggtgctgtagaagctgcacactgccccctcttaggtatatgggggaagatggatgttggtacggcatggagatacgcccaatttccgaaaaagaggagaatatggtgaagtcactggtcagcgccggttctggcaaagttgacaacttcaccatgggggtgttgtgcctcgcaatcctgtttgaagaggtaatgcggggaaagttcggcaagaaacatatgatcgctggggtgttctttacgttcgtcctactgctctccggacaaattacttggagaaatatggcccacaccctgatcatgattggcagtaacgcaagcgataggatgggtatgggggtgacatatcttgccttgatagctacctttaagatccagcccttcctggttttaggatttttcctccgcaaactgacttctcgagaaaatcttctgctaggcgtgggcctcgcgatggccacaaccctgcagttgccggaggacattgaacaaatggcaaacgggatcgctctgggattaatggccctcaagctgattacacagtttgagacttaccagctttggaccgccctgatctccttgacgtgttcaaatacaatattcaccctcactgtcgcttggcggaccgcaacactgatcctagccggtgtgagtctgcttcctgtttgccagagctcgtccatgcgtaaaactgattggctcccaatggcggtggctgccatgggcgtcccccctctgcccttgtttattttctctctgaaggacaccttaaagagaaggagctggccactcaacgagggggtaatggcagtgggactggtttcaatccttgccagttccctgttgcgcaacgatgtgcctatggctggccccctcgtcgcaggtgggctgctaattgcctgttatgtgatcacgggaacatctgcggacctgaccgtagaaaaagctgccgatataacttgggaggaagaggcagaacaaacaggcgtgagccataatcttatgattaccgtcgacgacgatggcactatgcggatcaaggacgatgagacagagaacatcctcaccgttctgttgaaaacggccttactgattgtgtccgggatatttccatactcaatcccggctactctcctggtgtggcacacctggcagaagcagacacagagaagcggagtcctttgggacgtgcctagtcccccagaaacccaaaaagccgagctggaagagggtgtttacaggattaagcagcagggcatcttcgggaaaacacaggtaggagtgggcgtccaaaaggagggtgtgtttcacactatgtggcatgttacccgaggggcagtgttgacgtataatggaaagcgcctagaacccaactgggcttctgtcaaaaaggatctgatttcctacggcggcgggtggcggctcagcacacagtggcagaaaggagaggaagtgcaagtaatcgccgtcgagcctggtaagaatccaaaaaacttccagactatgcccggcaccttccagacaaccactggggaaataggagcgatcgccctggactttaagcctggcacctcgggttcaccgattatcaatagagaggggaaggtggttggactttatggcaacggcgtggtcacaaaaaatgggggatacgtgtctggtattgcacagacgaacgctgagccagatggccccactcctgaattagaggaagagatgttcaagaaaaggaatctgaccatcatggacctccacccagggagtggaaagacacgtaaatatttgcccgccatagttcgcgaagctattaagcggagactgaggaccctcatcctggcacctactcgagtggtcgccgccgagatggaggaagctcttaagggcctgccgatccggtaccaaacaaccgcgacgaaatccgagcatactggtcgcgaaattgtggatttgatgtgccacgcaacatttaccatgagactactgagccccgtaagggtgccaaactataatctcatcataatggacgaggcccatttcaccgatcctgcttctattgccgcacgggggtacatcagcactcgagttggaatgggcgaagccgctgcgatttttatgacagccacccccccaggcacagcagacgctttccctcagtccaacgcccccatccaggatgaggagagagacataccagaacgctcatggaatagtgggaacgagtggattactgactttgcaggaaagacggtctggttcgtgccgagcatcaaagccggtaacgatatcgctaattgtttaaggaagaacggcaaaaaggtgattcagctgtctcgtaagacctttgacacagaataccaaaaaactaagcttaatgattgggacttcgtcgtaaccacagatatctccgagatgggggccaactttaaagcggaccgggtgattgatcctagaaggtgcctgaagcccgttatactcaccgacggaccagagcgcgtgatcttggcaggccccatgcctgtcactgccgcttcagccgctcagcgaagaggtcgggtggggaggaatccacagaaagaaaacgatcagtatattttcacgggccaacccctgaataacgacgaggatcacgcacactggaccgaagccaagatgctcctggacaatatcaacacacctgagggaatcattccggctcttttcgaaccagagcgcgagaagagtgccgcaatagacggcgaataccgtctaaaaggggagagcagaaagacttttgttgaactgatgcggaggggagatttgcccgtgtggttagcgcataaagtcgcctccgagggtatcaagtataccgaccgcaaatggtgcttcgatggccagcgaaataaccagattctggaagagaatatggacgtggagatctggacaaaggaaggggagaaaaagaagctcagacctcggtggctggatgctaggacctactctgacccccttgccctgaaagaatttaaggatttcgcagctggacgcaaatcgattgccctcgacttggtaactgagatcggcagagtgccaagccacctggcacataggacacggaacgccctagataatctggttatgctccacacgtcagaacacggtgggcgtgcttatcgccatgcggtcgaggagcttcctgaaaccatggagactctgttattgctgggcctcatgatactgcttacaggaggcgccatgctgtttctcatctccgggaagggaattggtaaaaccagtatcggcttgatttgtgtgatcgcatctagcgggatgctgtggatggctgaaatacccttacagtggattgcctccgccatcgtgctagagttctttatgatggtcctgctcattccagagcctgaaaagcaacgaaccccgcaggacaaccagcttgcatacgttgtgatcggaatactgacattggctgccatcattgcggctaatgagatgggcctgctcgaaactacgaagagagatctgggtatgtcaaaagagcccggggtagtgtctccaaccagctatcttgacgtcgatctccaccctgccagtgcatggacactgtacgccgtggctactaccgttatcacacccatgttgaggcataccattgaaaactccactgcaaacgtgagcctggccgcgatcgctaatcaagccgtcgtattaatgggcctagacaagggatggccaatatctaaaatggacctgggcgtgcctctccttgcactggggtgctactcacaggttaaccccttgacgctgacagccgctgtgctcctgcttattacccactatgccatcatcggaccgggcttacaggcaaaggctactcgggaggcccagaaacgcaccgcggccggtattatgaagaatccaacagtcgatgggatcatgactatagacctggatcctgtgatttacgactccaagttcgagaaacaactcggacaggtcatgttgctggtgctatgtgcagttcagctgctccttatgagaaccagttgggctctgtgcgaagccttgacactggcaacgggccccatcaccactctctgggagggtagcccaggcaagttttggaacacaaccattgctgtgtcgatggccaatatcttcagggggtcttatctggccggagcgggcttagctttttccataatgaaaagcgtagggactggaaagcggggcacaggttcacagggggaaacccttggagagaaatggaagaagaaactgaaccaactcagtcgaaaggaattcgatctatacaaaaagtctggcatcacggaggtggacagaaccgaggcaaaagaaggtctgaagcgcggcgagattacacatcacgccgtctccagggggagcgctaaattgcagtggtttgttgaacggaatatggtgatccccgagggacgtgtcattgatctgggctgtgggagaggaggctggtcatattactgcgccggtctcaagaaggtgactgaagtaagggggtataccaaaggaggccctggccacgaggagccggtgcccatgagtacatacgggtggaacatcgttaagcttatgagcggaaaagacgtgttctacctgccacctgaaaagtgtgatactttgctgtgcgacattggtgagtcctctcccagccctaccgtcgaagagtcccgcacaatccgggtgctcaaaatggtcgagccatggttaaagaataaccagttctgtataaaggtgctgaatccctatatgcctaccgttattgaacatcttgagcgactgcagagaaaacacggcgggatgctagtaaggaacccactctcacgcaattctactcatgaaatgtactggatcagtaacggaacgggcaatatcgtggcatcggtcaacatggtgagccggctgttgctgaacagatttacaatgacccaccgtaggcccactattgagaaggatgttgacctcggtgccgggacccggcacgtgaatgctgaaccggagacacctaacatggatgtcataggagagcgcatcaaacgaattaaggaagagcataattccacgtggcactatgacgacgaaaacccatacaaaacctgggcgtatcatggctcttacgaggtgaaggccactggctcagcaagctccatgatcaatggggtagtgaagcttctgacaaaaccctgggatgttgtccctatggtgacccaaatggctatgactgacacaaccccattcggacagcagagagtgtttaaggaaaaagtcgatacaaggactccccggagtatggccggtacccgcagagttatgggcattacggcagagtggttatggaggaccctggggcgaaacaagaaaccgcggttgtgcacacgtgaggaattcactaagaaggtgagaaccaatgccgctatgggagccgtatttacagaggaaaaccaatgggactctgcgaaagcagccgtggaggatgaagacttctggaagctcgtcgatcgcgagagggagctgcacaaactaggcaagtgtggtagctgcgtgtataatatgatggggaaacgggaaaagaaacttggagagtttggcaaggctaagggctcaagagccatctggtacatgtggctgggggcacgctacctcgaattcgaggctctgggatttttgaacgaggaccattggttctccagggaaaatagttatagcggtgttgagggcgaagggctgcacaaactcggatacatacttcgagatatctctaagattcctggcggtgccatgtatgctgacgatactgccgggtgggacacccggatcacggaggacgatctgcacaacgaagagaaaattacacagcagatggaccccgagcatagacagttagcaaatgcgatctttaagctgacctaccaaaacaaagtggtcaaggtgcagaggccaactcctacaggaaccgtaatggatataatttcccgcaaggaccagcgtggctcaggccaggttgggacttatggattgaataccttcacaaacatggaagcccaactcatccggcagatggagggtgaaggcgtgctgagcaaagctgatctagagaacccccaccttccagaaaagaaaatcacgcagtggctggagaccaagggggtcgagagactcaaaaggatggccatttcgggagacgattgcgtggtgaagcccatagacgatcgctttgcaaatgctctgttggccttaaacgacatgggcaaggtccgaaaagatatccctcagtggcaaccatctaagggttggcatgactggcagcaggttccgttctgtagtcaccacttccatgaactgattatgaaagatgggcggaagctcgtggtaccctgcagacctcaggacgagcttatcggaagggcacgcatttcccaaggcgccggctggagcctgagagaaactgcgtgtctagggaaagcttacgcccagatgtggtcactgatgtattttcaccggagggacctccgtttggcatccaatgccatctgctctgctgtgccagtccattgggtgcccacaagccgaaccacttggagtatacacgcccatcaccagtggatgacaaccgaggatatgctgacggtttggaaccgcgtgtggatcgaagacaatccttggatggaggataagacaccagtcaccacttgggaggacgtgccctaccttggaaagagagaagatcaatggtgtggttccctgattggcctcaccagccgggcaacatgggctcagaacatccctactgccattcagcaggtaaggtctttaatcgggaatgaggaattcctggactacatgccgtcaatgaaacgctttagaaaggaggaggaaagtgagggagcgatttggtga

SEQ ID NO: 15368 - RNA, 9873 nt, synthetic construct
  misc_feature 1..9873: note = derived and/or modified CDS sequence (opt3) from DENV-3__KJ189288__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcaccgccgagacaagcgtagcgtagcccttgcaccccatgtgggcatgggtctggataccagaacgcaaacttggatgtccgccgagggggcttggaggcaggtcgaaaaagtggagacctgggcattgcggcaccctggattcacaatcctcgccctgtttctggctcattacattggcacttctctcacccagaaggttgtgatcttcatattactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaaatggtgcagtatgaaaatctgaagtacactgtcataattaccgtgcatacaggtgaccagcaccaggttggcaacgagacccaaggggtgactgcagaaatcacgcctcaggcttccacaaccgaggccactctcccagaatatggaacccttggcctggagtgctctccgcgaacaggtttggacttcaatgagatgattctactgaccatgaaaaacaaggcgtggatggtccatagacagtggtttttcgatctccccctgccttggactagcggggccacaacggaaaccccaacttggaataggaaagagcttctggtgacatttaagaacgcacacgctaaaaagcaagaagtagttgtgttgggctcccaggagggagccatgcacaccgctctcacaggcgccactgaaatccagaattcagggggaaccagtatcttcgcaggtcatctgaagtgtcggttaaaaatggacaagctggagctaaaaggcatgagctacgccatgtgcacgaacacctttgtcctcaagaaagaggtgtctgaaacacagcacgggactattctgataaaggtcgagtacaagggagaagatgctccctgtaaaatccctttctccaccgaggacggccatggtaaggcgcacaacgggcgtcttattacagcaaatccagtggttactaaaaaggaggaacccgtgaacatcgaggccgaaccgcctttcggcgagtcaaatatagtaattggaatcggcgataacgctttgaaaatcaattggtataagaaggggagcagtattggaaaaatgtttgaagccaccgcacgcggtgccagaaggatggctatcctgggcgacacggcctgggatttcgggtctgtcggaggcgtgctcaactccctgggtaagatggttcatcaaatttttgggagcgcatacacagcgcttttctcgggcgtgtcttgggtcatgaaaataggaatcggcgtgctgttgacctggattgggctcaattccaagaacacttcaatgagttttagctgcatcgctatcggaattataacactgtatttaggcgccgtagtgcaggcagacatgggttgtgttatcaattggaaagggaaggagctgaagtgcggatccggcattttcgtcaccaacgaggtgcacacttggaccgaacagtacaaatttcaggccgattctcccaagcggctagctacagccatcgcaggtgcttgggagaatggcgtgtgtgggattcgaagcacgacccgcatggaaaacctcctgtggaaacaaatcgccaatgagcttaactatatattgtgggaaaataacgtcaagctgactgttgtggtgggagacatcattggcgtactcgagcaggggaaaagaacactgaccccacagcctatggagttaaagtactcatggaaaacatggggaaaggcgaagatcgtcactgccgaaacccagaacagttccttcattatcgatggccccaatacgccagagtgccccagcgcttctagggcatggaacgtgtgggaagttgaggactatggttttggggtgttcacaaccaatatatggctgcggcttcgcgaagcctacactcaattgtgtgaccacagactcatgtcagctgccgtcaaagatgagagggcagtgcatgcggacatgggatactggattgagagtcagaagaacggcagctggaaactggaaaaggcctccctaatcgaggttaaaacctgcacatggcctaagtctcacactctgtggtcgaatggtgtgctcgaaagcgatatgattatcccaaagtccctggctggcccgatatcacagcataaccaccgtcccgggtatcacacccagacagccggaccttggcatcttggcaaattggagctggactttaattactgcgaggggacgaccgtagtcatcactgaaaactgtggaacacggggcccaagtttacgaaccactacagtgtctggtaagctcattcacgagtggtgctgtagaagctgcaccctgccccctcttaggtatatgggggaagatggatgttggtacggcatggagatccgcccaatttccgaaaaagaggagaatatggtgaagtcactggtcagcgcaggttctggcaaagttgacaacttcacgatgggggtgttgtgcctcgctatcctgtttgaagaggtaatgcggggaaagttcggcaagaaacatatgatagccggggtgttctttactttcgtcctactgctctccggacaaattacctggagagatatggcacacacactgatcatgatcggcagtaatgccagcgacaggatgggtatgggggtgacctatcttgctttgattgcgacttttaagatccagcccttcctggccttaggatttttcctccgcaaactgacatctcgagaaaaccttctgctaggcgttggcctcgcaatggctaccacactgcagttgccggaggatattgaacaaatggccaatgggatagccctgggattaatggctctcaagctgatcactcagtttgagacctaccagctttggacggcactgatttccttgacatgttcaaacaccatcttcactctcaccgtggcctggcggacagcgactctgattctagctggtgtcagtctgcttcctgtgtgccagagctcgtccatgcgtaaaaccgactggctcccaatggccgttgcagccatgggcgtgccccctctgcccttgtttatcttctctctgaaggatacgttaaagagaaggagctggccactcaatgagggggtcatggctgtaggactggtgtcaatacttgcaagttccctgttgcgcaacgacgttcctatggccggccccctcgtggcgggtgggctgctaatcgcttgttatgtcattacaggaacctctgccgatctgactgtggaaaaagcagccgacatcacatgggaggaagaggctgaacaaaccggcgtaagccataaccttatgattactgtggacgatgacggcacaatgcggatcaaggatgacgagaccgagaatatactcacggtcctgttgaaaactgccttactgattgtttccgggatctttccatactcaatcccggcaaccctcctggtgtggcacacatggcagaagcagacccagagaagcggagtgctttgggatgtccctagtcccccagaaacacaaaaagctgagctggaagagggtgtgtacaggattaagcagcagggcatattcgggaaaactcaggttggagtaggcgtgcaaaaggagggtgtctttcacaccatgtggcatgtgacgcgaggggccgttttgacatataacggaaagcgcctagaacccaattgggcgtctgtgaaaaaggacctgatctcctacggcggcgggtggcggctcagcactcagtggcagaaaggagaggaagtccaagtgattgccgtagagcctggtaagaacccaaaaaatttccagaccatgcccggcacattccagaccactaccggggaaatcggagcaattgctctggattttaagcctggcacatcgggttcaccgatcataaacagagaggggaaggtcgtgggactttatggcaatggcgttgtgacgaaaaacgggggatacgtctctggtatcgcccagactaatgctgagccagacggccccacccctgaattagaggaagagatgttcaagaaaaggaacctgacaattatggatctccacccagggagtggaaagacccgtaaatatttgcccgcaatcgtgcgcgaagccattaagcggagactgaggactctcatcctggcccctacacgagttgtggctgcggagatggaggaagcacttaagggcctgccgatacggtaccaaaccacggccactaaatccgagcatacaggtcgcgaaattgtcgacttgatgtgccacgctacctttaccatgagactactgagccccgtgagggtaccaaattataacctcatcatcatggatgaggcccatttcactgaccctgcatctattgccgctcgggggtacatcagcacacgagtgggaatgggcgaagcggccgcaatatttatgaccgctacacccccaggcactgccgatgcattccctcagtccaatgcccccattcaggacgaggagagagacatcccagaacgctcatggaacagtgggaatgagtggattacggattttgctggaaagaccgtttggttcgtcccgagcatcaaagccggtaacgacatagcgaactgtttaaggaagaatggcaaaaaggtgattcagctgtctcgtaagacatttgatactgaataccaaaaaaccaagcttaacgactgggatttcgtggtcacaaccgacatctccgagatgggggcaaattttaaagccgatcgggtaatcgaccctagaaggtgcctgaagcccgtgattctcactgatggaccagagcgcgttatcttggctggccccatgcctgtgacggccgcttcagcagcccagcgaagaggtcgggtcgggaggaacccacagaaagaaaatgaccagtatattttcaccggccaacccctgaacaatgatgaggaccacgctcactggacagaagccaagatgctcctggacaacataaatactcctgagggaatcattccggcacttttcgaaccagagcgcgagaagagtgcggccatcgatggcgaataccgtctaaaaggggagagcagaaagacctttgtggaactgatgcggaggggagacttgcccgtttggttagctcataaagtggcctccgagggtatcaagtatacagatcgcaaatggtgcttcgacggccagcgaaacaatcagattctggaagagaacatggatgtcgagatatggaccaaggaaggggagaaaaagaagctcagacctcggtggctggacgcaaggacttactctgatccccttgctctgaaagaatttaaggacttcgccgcaggacgcaaatcgatcgccctcgatttggtgacagagattggcagagtaccaagccacctggctcataggacgcggaatgcgctagacaacctggtgatgctccacacctcagaacacggtgggcgtgcctatcgccatgcagttgaggagcttcctgaaactatggagacactgttattgctgggcctcatgatcctgcttaccggaggcgctatgctgtttctcatttccgggaagggaatcggtaaaaccagtataggcttgatctgtgtcattgcctctagcgggatgctgtggatggccgaaatccccttacagtggattgcatccgctatcgtgctagagttctttatgatggtgctgctcgtcccagagcctgaaaagcaacgaacaccgcaggataatcagcttgcctacgttgtgataggaattctgactttggcggctatcattgccgcaaacgagatgggcctgctcgaaacgaccaagagagacctgggtatgtcaaaagagcccggggtagtgtctccaacaagctatcttgatgtcgacctccaccctgccagtgcttggactctgtacgcagtggccaccacagttatcacccccatgttgaggcatactatagaaaattccacggcgaacgtgagcctggctgccatcgcaaaccaagccgtcgtattaatgggcctagacaagggatggccaatttctaaaatggatctgggcgtgcctctccttgctctggggtgctactcacaggttaatcccttgacactgaccgccgcagtgctcctgcttatcactcactatgctattatcggaccgggcttacaggccaaggcgacccgggaggcccagaaacgcacagcagctggtataatgaagaacccaactgtcgacgggattatgaccatcgatctggaccctgtgatctacgattccaagttcgagaaacaactcggacaggtcatgttgctggtgctatgtgccgttcagctgctccttatgagaacaagttgggcactgtgcgaagctttgacgctggccaccggccccattactacactctgggagggtagcccaggcaagttttggaataccactatcgccgtgtcgatggcgaacatattcagggggtcttatctggctggagcaggcttagccttttccattatgaaaagcgtagggacaggaaagcggggcaccggttcacagggggaaacgcttggagagaaatggaagaagaaactgaatcaactcagtcgaaaggaattcgacctatacaaaaagtctggcatcaccgaggtggatagaacagaggctaaagaaggtctgaagcgcggcgagattactcatcacgccgtctccagggggagcgcaaaattgcagtggtttgttgaacggaacatggtgatccccgagggacgtgtcatagacctgggctgtgggagaggaggctggtcatattactgcgccggtctcaagaaggtgaccgaagtaagggggtatacaaaaggaggccctggccacgaggagccggtgcccatgagtacttacgggtggaatatcgttaagcttatgagcggaaaagatgtgttctacctgccacctgaaaagtgtgacaccttgctgtgcgatattggtgagtcctctcccagccctacagtcgaagagtcccgcaccatccgggtgctcaaaatggtcgagccatggttaaagaacaatcagttctgtattaaggtgctgaacccctatatgcctactgttatcgaacatcttgagcgactgcagagaaaacacggcgggatgctagtaaggaatccactctcacgcaactctacgcatgaaatgtactggattagtaatggaacaggcaacatcgtggcttcggtcaatatggtgagccggctgttgctgaacagatttaccatgactcaccgtaggcccaccatagagaaggacgttgatctcggtgcggggacacggcacgtgaacgccgaaccggagacgcctaatatggacgtcattggagagcgcatcaaacgaatcaaggaagagcataactccacctggcactatgacgatgaaaatccatacaaaacttgggcatatcatggctcttacgaggtgaaggctacaggctcagccagctccatgattaacggggtagtgaagcttctgaccaaaccctgggacgttgtccctatggtgactcaaatggcaatgacagataccacaccattcggacagcagagagtgtttaaggaaaaagtcgacactaggaccccccggagtatgccgggtacgcgcagagttatgggcataaccgccgagtggttatggaggacactggggcgaaataagaaacctcggttgtgcactcgtgaggaattcaccaagaaggtgagaacaaacgctgccatgggagcggtatttactgaggaaaatcaatgggattctgcaaaagccgctgtggaggacgaagatttctggaagctcgtcgaccgcgagagggagctgcacaaactaggcaagtgtggtagctgcgtgtataacatgatggggaaacgggaaaagaaacttggagagtttggcaaggccaagggctcaagagcaatctggtacatgtggctgggggctcgctacctcgaattcgaggccctgggatttttgaatgaggatcattggttctccagggaaaacagttatagcggtgttgagggcgaagggctgcacaaactcggatacattcttcgagacatctctaagattcccggcggtgctatgtatgccgatgacaccgcagggtgggacacgcggatcacagaggatgacctgcacaatgaagagaaaataacccagcagatggatccagagcatagacagttagcgaacgccatctttaagctgacttaccaaaataaagtggtcaaggtgcagaggcctacacccaccggaactgtaatggacattatctcccgcaaggatcagcgtggctcaggccaggttgggacctatggattgaacacattcacgaatatggaagctcaactcattcggcagatggagggtgaaggcgtgctgagcaaagccgacctagagaacccacaccttcccgaaaagaaaatcacccagtggctggagactaagggggtcgagagactcaaaaggatggcaatatcgggagatgactgcgtggtgaagcctattgatgaccgctttgctaacgccctgttggcattaaatgatatgggcaaggtccgaaaagacatcccacagtggcaaccgtctaagggttggcatgattggcagcaggttcccttctgtagtcaccacttccatgaactgatcatgaaagacgggcggaagctcgtggtaccttgcagaccacaggacgagcttattggaagggcccgcatatcccaaggcgcgggctggagcctgagagaaacagcttgtctagggaaagcctacgcacagatgtggtcactgatgtattttcaccggagggatctccgtttggcctccaacgctatctgctctgccgtgcccgtccattgggtgcctaccagccgaactacatggagtattcacgcacatcaccagtggatgaccacggaggacatgctgacagtttggaatcgcgtgtggatcgaagataacccatggatggaggacaagacccccgtcactacctgggaggatgtgccttaccttggaaagagagaagaccaatggtgtggttccctgattggcctcacaagccgggctacttgggcccagaatatcccgaccgcgatacagcaggtaaggtctttaatcgggaacgaggaattcctggattacatgccatcaatgaaacgctttagaaaggaggaggaaagtgagggagctatttggtga

SEQ ID NO: 15369 - RNA, 9873 nt, synthetic construct
  misc_feature 1..9873: note = derived and/or modified CDS sequence (opt3) from DENV-3__KJ189289__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacactatcggcgtactcgagcaggggaaaagaacactgaccccacagcctatggagttaaagtactcatggaaaacatggggaaaggcgaagattgtcactgccgaaacccagaacagttccttcatcatagatggccccaatacgccagagtgccccagcgcttctagggcatggaacgtgtgggaagttgaggactatggttttggggtgttcacaaccaatatttggctgcggcttcgcgaagtctacactcaattgtgtgaccacagactcatgtcagccgctgtgaaagatgagagggccgttcatgcagacatgggatactggatcgagagtcagaagaacggcagctggaaactggaaaaggcgtccctaattgaggtgaaaacctgcacatggcctaagtctcacactctgtggtcgaatggtgtactcgaaagcgatatgatcataccaaagtccctggccggcccgatctcacagcataaccaccgtcccgggtatcacacccagacagctggaccttggcatcttggcaaattggagctggactttaattactgcgaggggacgaccgtcgtgattactgaaaactgtggaacacggggcccaagtttacgaaccactacagtgtctggtaagctcatccacgagtggtgctgtagaagctgcaccctgccccctcttaggtatatgggggaagatggatgttggtacggcatggagattcgcccaatctccgaaaaagaggagaatatggtcaagtcactggttagcgccggttctggcaaagtggacaacttcacgatgggggtattgtgcctcgcaatactgtttgaagaggtgatgcggggaaagttcggcaagaaacatatgattgctggggtcttctttactttcgtgctactgctctccggacaaatcacctggagagatatggcccacacactgatcatgattggcagtaatgcaagcgacaggatgggtatgggggttacctatcttgccttgatcgctacttttaagattcagcccttcctggcgttaggatttttcctccgcaaactgacatctcgagaaaaccttctgctaggcgtgggcctcgccatggcaaccacactgcagttgccggaggatatagaacaaatggctaatgggatcgccctgggattaatggccctcaagctgattactcagtttgagacctaccagctttggacggctctgatctccttgacatgttcaaacaccattttcactctcaccgtcgcatggcggacagccactctgatcctagcgggtgtgagtctgcttcctgtttgccagagctcgtccatgcgtaaaaccgactggctcccaatggctgtggccgcaatgggcgtcccccctctgcccttgtttatattctctctgaaggatacgttaaagagaaggagctggccactcaatgagggggtaatggccgtgggactggtttcaatccttgctagttccctgttgcgcaacgacgtgcctatggcaggccccctcgtcgccggtgggctgctaattgcgtgttatgtgatcacaggaacctctgctgatctgactgtagaaaaagccgcagacattacatgggaggaagaggccgaacaaaccggcgtgagccataaccttatgatcactgtcgacgatgacggcacaatgcggataaaggatgacgagaccgagaatattctcacggttctgttgaaaactgctttactgatcgtgtccgggatctttccatactcaattccggccaccctcctggtgtggcacacatggcagaagcagacccagagaagcggagtcctttgggatgtgcctagtcccccagaaacacaaaaagcagagctggaagagggtgtttacaggataaagcagcagggcatcttcgggaaaactcaggtaggagtgggcgtccaaaaggagggtgtgtttcacaccatgtggcatgttacgcgaggggctgtgttgacatataacggaaagcgcctagaacccaattgggcctctgtcaaaaaggacctgatttcctacggcggcgggtggcggctcagcactcagtggcagaaaggagaggaagtgcaagtaatcgcggtcgagcctggtaagaacccaaaaaatttccagaccatgcccggcacattccagaccactaccggggaaattggagccatcgcactggattttaagcctggcacatcgggttcaccgataatcaacagagaggggaaggtggttggactttatggcaatggcgtggtcacgaaaaacgggggatacgtgtctggtattgctcagactaatgccgagccagacggccccacccctgaattagaggaagagatgttcaagaaaaggaacctgacaatcatggatctccacccagggagtggaaagacccgtaaatatttgcccgctattgttcgcgaagcaatcaagcggagactgaggactctcatactggcccctacacgagtggtcgccgctgagatggaggaagcgcttaagggcctgccgattcggtaccaaaccacggcaactaaatccgagcatacaggtcgcgaaatcgtggacttgatgtgccacgccacctttaccatgagactactgagccccgtaagggtgccaaattataacctcatcattatggatgaggctcatttcactgaccctgcctctatcgcagcccgggggtacataagcacacgagttggaatgggcgaagctgcggccatttttatgaccgcaacacccccaggcactgctgatgccttccctcagtccaatgcacccatccaggacgaggagagagacattccagaacgctcatggaacagtgggaatgagtggatcacggattttgccggaaagaccgtctggttcgtgccgagcataaaagctggtaacgacattgccaactgtttaaggaagaatggcaaaaaggtgatccagctgtctcgtaagacatttgatactgaataccaaaaaaccaagcttaacgactgggatttcgtcgtaacaaccgacatctccgagatgggggcgaattttaaagcagatcgggtgattgaccctagaaggtgcctgaagcccgttatcctcactgatggaccagagcgcgtgattttggccggccccatgcctgtcacggctgcctcagctgcacagcgaagaggtcgggtggggaggaacccacagaaagaaaatgaccagtatatattcaccggccaacccctgaacaatgatgaggaccacgcccactggacagaagctaagatgctcctggacaacatcaatactcctgagggaattatcccggcccttttcgaaccagagcgcgagaagagtgcagcgatcgatggcgaataccgtctaaaaggggagagcagaaagacctttgttgaactgatgcggaggggagacttgcccgtgtggttagcccataaagtcgcttccgagggtattaagtatacagatcgcaaatggtgcttcgacggccagcgaaacaatcagatactggaagagaacatggatgtggagatctggaccaaggaaggggagaaaaagaagctcagacctcggtggctggacgccaggacttactctgatccccttgcactgaaagaatttaaggacttcgctgccggacgcaaatcgattgcactcgatttggtaacagagatcggcagagtgccaagccacctggcccataggacgcggaatgctctagacaacctggttatgctccacacctcagaacacggtgggcgtgcgtatcgccatgccgtcgaggagcttcctgaaactatggagacactgttattgctgggcctcatgattctgcttaccggaggcgcaatgctgtttctcatctccgggaagggaataggtaaaaccagtatcggcttgatttgtgtgatcgcttctagcgggatgctgtggatggccgaaattcccttacagtggatcgcctccgcaatagtgctagagttctttatgatggtcctgctcattccagagcctgaaaagcaacgaacaccgcaggataatcagcttgcttacgttgtgatcggaattctgactttggccgcgatcatagctgccaacgagatgggcctgctcgaaacgaccaagagagacctgggtatgtcaaaagagcccggggtagtgtctagcacaagttatcttgatgtcgacctccacccagcatccgcctggactctgtacgctgtggcaaccacagttatcacccctatgttgaggcatactattgaaaatagcacggccaacgtgtctctggcggctatcgccaaccaagcagtcgtattaatgggcctagacaagggatggcccatttcaaaaatggatctgggcgtgccactccttgccctggggtgctactcccaggttaatcctttgacactgaccgctgccgtgctcctgcttatcactcactatgcaataattggacccggcttacaggctaaggccacccgggaggcgcagaaacgcacagccgcaggtatcatgaagaacccgactgtcgacgggatcatgaccattgatctggacccagtgatctacgatagtaagttcgagaaacaactcggacaggtcatgttgctggtgctatgtgctgttcagctgctccttatgagaacaagctgggccctgtgcgaagcattgacgctggctaccggccctataactacactctgggagggttcgcccggcaagttttggaataccactattgccgtgtctatggccaacatcttcagggggtcctatctggcgggagctggcttagcatttagcattatgaaatcagtagggacaggaaagcggggcaccggtagtcagggggaaacgcttggagagaaatggaagaagaaactgaatcaactctctcgaaaggaattcgacctatacaaaaagtccggcatcaccgaggtggatagaacagaggccaaagaaggtctgaagcgcggcgagataactcatcacgctgtcagcagggggtcagccaaattgcagtggtttgttgaacggaacatggtgatcccagagggacgtgtcattgacctgggctgtgggagaggaggctggagttattactgcgcaggtctcaagaaggtgaccgaagtaagggggtatacaaaaggaggccccggccacgaggagcctgtgccgatgagcacttacgggtggaatatcgttaagcttatgtccggaaaagatgtgttctacctgcccccagaaaagtgtgacaccttgctgtgcgatattggtgagtctagcccttcccccacagtcgaagagtcacgcaccatccgggtgctcaaaatggtcgagccttggttaaagaacaatcagttctgtattaaggtgctgaacccatatatgcccactgttatcgaacatcttgagcgactgcagagaaaacacggcgggatgctagtaaggaatcctctctctcgcaacagtacgcatgaaatgtactggatatcgaatggaacaggcaacattgtggccagcgtcaatatggtgtcccggctgttgctgaacagatttaccatgactcaccgtaggccaaccatcgagaaggacgttgatctcggtgctgggacacggcacgtgaacgcggaacccgagacgccgaatatggacgtcatcggagagcgcattaaacgaataaaggaagagcataactctacctggcactatgacgatgaaaatccttacaaaacttgggcctatcatggctcatacgaggtgaaggcaacaggcagcgcttccagtatgatcaacggggtagtgaagcttctgaccaaaccatgggacgttgtccccatggtgactcaaatggccatgacagataccacacctttcggacagcagagagtgtttaaggaaaaagtcgacactaggaccccacggtctatgcccggtacgcgcagagttatgggcattaccgcagagtggttatggaggacactggggcgaaataagaaaccgcggttgtgcactcgtgaggaattcaccaagaaggtgagaacaaacgccgctatgggagccgtatttactgaggaaaatcaatgggatagcgcgaaaaccgcagtggaggacgaagatttctggaagctcgtcgaccgcgagagggagctgcacaaactaggcaagtgtggttcatgcgtgtataacatgatggggaaacgggaaaagaaacttggagagtttggcaaggccaagggctccagagctatctggtacatgtggctgggggcccgctacctcgaattcgaggcactgggatttttgaatgaggatcattggttcagtagggaaaacagctattctggtgttgagggcgaagggctgcacaaactcggatacattcttcgagacatctccaagatacctggcggtgctatgtatgccgatgacacggctgggtgggacacacggatcaccgaggatgacctgcacaatgaagagaaaattactcagcagatggatcccgagcatagacagttagccaacgcaatctttaagctgacataccaaaataaagtggtcaaggtgcagaggccaacccctactggaaccgtaatggacattatctcacgcaaggatcagcgtggcagcggccaggttgggacatatggattgaacacgttcaccaatatggaagcgcaactcatacggcagatggagggtgaaggcgtgctgtcgaaagccgacctagagaacccccaccttccagaaaagaaaattactcagtggctggagacaaagggggtcgagagactcaaaaggatggctatctctggagatgactgcgtggtgaagcccatcgatgaccgctttgccaacgcactgttggctttaaatgatatgggcaaggtccgaaaagacattcctcagtggcaaccaagtaagggttggcatgattggcagcaggttccgttctgttcccaccacttccatgaactgataatgaaagacgggcggaagctcgtggtaccctgcagacctcaggacgagcttatcggaagggcccgcattagccaaggcgcaggctggtcactgagagaaaccgcctgtctagggaaagcgtacgctcagatgtggtccctgatgtattttcaccggagggatctccgtttggcctctaacgcaatctgcagcgccgtgccagtccattgggtgcccactagtcgaacaacctggtccattcacgctcatcaccagtggatgacgacagaggacatgctgaccgtttggaatcgcgtgtggatcgaagataacccttggatggaggacaagactccagtcaccacatgggaggatgtgccctaccttggaaagagagaagaccaatggtgtggtagcctgataggcctcacttctcgggccacctgggcacagaatatccctacagctattcagcaggtaaggtcattaatcgggaacgaggaattcctggattacatgccgagtatgaaacgctttagaaaggaggaggaatccgagggagccatttggtga

SEQ ID NO: 15370 - RNA, 9873 nt, synthetic construct
  misc_feature 1..9873: note = derived and/or modified CDS sequence (opt3) from DENV-3__KJ189290__SS-prME
  source 1..9873: mol_type = other RNA
accagcctgtgcctcatgatgatccttcccgcagctctggcattccacttgacctcccgggacggcgagcctaggatgattgtggggaagaacgaacggggaaaatctttactgtttaagactgcctcaggtataaatatgtgtacgttaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccaaaattcagggggaacaagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgactaagaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgccggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagaaatatggcccacaccctgattatgatcggcagtaacgcaagcgataggatgggtatgggggttacatatcttgccttgattgctacctttaagatacagcccttcctggcgttaggatttttcctccgcaaactgacttctcgagaaaatcttctgctaggcgtgggcctcgccatggcaacaaccctgcagttgccggaggacatcgaacaaatggctaacgggattgccctgggattaatggccctcaagctgatcacacagtttgagacttaccagctttggaccgctctgatttccttgacgtgttcaaatacaatcttcaccctcactgtcgcatggcggaccgccacactgatactagcgggtgtgagtctgcttcctgtttgccagagctcgtccatgcgtaaaactgattggctcccaatggctgtggccgcaatgggcgtcccacctctgcccttgtttatcttctctctgaaggacaccttaaagagaaggagctggccactcaacgagggggtaatggccgtgggactggtttcaattcttgctagttccctgttgcgcaacgatgtgcctatggcaggccccctcgtcgccggtgggctgctaatcgcgtgttatgtgattacgggaacatctgctgacctgaccgtagaaaaagccgcagatatcacttgggaggaagaggccgaacaaacaggcgtgagccataatcttatgataaccgtcgacgacgatggcactatgcggattaaggacgatgagacagagaacatcctcaccgttctgttgaaaacggctttactgatcgtgtccgggatttttccatactcaataccggccactctcctggtgtggcacacctggcagaagcagacacagagaagcggagtcctttgggacgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataatggaaagcgcctagaacccaactgggcctctgtcaaaaaggatctgatctcctacggcggcgggtggcggctcagcacacagtggcagaaaggagaggaagtgcaagtaattgcggtcgagcctggtaagaatcccaagaacttccagactatgcccggcaccttccagacaaccactggggaaatcggagccatagcactggactttaagcctggcacctcgggttcaccgatcattaatagagaggggaaggtggttggactttatggcaacggcgtggtcaccaagaatgggggatacgtgtctggtatcgctcagacgaacgccgagccagatggccccactcctgaattagaggaagagatgttcaagaaaaggaatctgaccattatggacctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggatttgatgtgccacgccacatttaccatgagactactgagccccgtaagggtgccaaactataatctcattatcatggacgaggctcatttcaccgatcctgcctctatagcagcccgggggtacattagcactcgagttggaatgggcgaagctgcggccatctttatgacagcaacacccccaggcacagctgacgccttccctcagtccaacgcacccattcaggatgaggagagagacatcccagaacgctcatggaatagtgggaacgagtggataactgactttgccggaaagacggtctggttcgtgccgagcattaaagctggtaacgatatcgccaattgtttaaggaagaacggcaaaaaggtgatccagctgtctcgtaagacctttgacacagaataccagaaaactaaacttaatgattgggacttcgtcgtaaccacagatatttccgagatgggggcgaactttaaagcagaccgggtgatcgatcctagaaggtgcctgaagcccgttattctcaccgacggaccagagcgcgtgatattggccggccccatgcctgtcactgctgcctcagctgcacagcgaagaggtcgggtggggaggaatccacagaaagaaaacgatcagtatatcttcacgggccaacccctgaataacgacgaggatcacgcccactggaccgaagctaagatgctcctggacaatattaacacacctgagggaatcatcccggcccttttcgaaccagagcgcgagaagagtgcagcgattgacggcgaataccgtctaaaaggggagagcagaaagacttttgttgaactgatgcggaggggagatttgcccgtgtggttagcccataaagtcgcttccgagggtataaagtataccgaccgcaaatggtgcttcgatggccagcgaaataaccagatcctggaagagaatatggacgtggagatttggacaaaggaaggggagaaaaagaagctcagacctcggtggctggatgccaggacctactctgacccccttgcactgaaagaatttaaggatttcgctgccggacgcaaatcgatcgcactcgacttggtaactgagattggcagagtgccaagccacctggcccataggacacggaacgctctagataatctggttatgctccacacgtcagaacacggtgggcgtgcgtatcgccatgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacagtggatagcctccgcaattgtgctagagttctttatgatggtcctgctcatcccagagcctgaaaagcaacgaaccccgcaggacaaccagcttgcttacgttgtgattggaatcctgacattggccgcgataatcgctgccaatgagatgggcctgctcgaaactacgaagagagatctgggtatgtcaaaagagcccggggtagtgtctccaaccagctatcttgacgtcgatctccaccctgcaagtgcctggacactgtacgctgtggcaactaccgttattacacccatgttgaggcataccatcgaaaactccactgccaacgtgagcctggcggctattgccaatcaagcagtcgtattaatgggcctagacaagggatggccaatctctaaaatggacctgggcgtgcctctccttgccctggggtgctactcacaggttaaccccttgacgctgacagctgccgtgctcctgcttataacccactatgcaattatcggaccgggcttacaggctaaggccactcgggaggcgcagaaacgcaccgccgcaggtatcatgaagaatccaacagtcgatgggattatgactatcgacctggatcctgtgatatacgactccaagttcgagaaacaactcggacaggtcatgttgctggtgctatgtgctgttcagctgctccttatgagaaccagttgggccctgtgcgaagcattgacactggctacgggccccattaccactctctgggagggtagcccaggcaagttttggaacacaaccatcgccgtgtcgatggccaatattttcagggggtcttatctggcgggagctggcttagcattttccatcatgaaaagcgtagggactggaaagcggggcacaggttcacagggggaaacccttggagagaaatggaagaagaaactgaaccaactcagtcgaaaggagttcgatctatacaaaagatctggcataacggaggtggaccgcaccgaggccaaggaaggtctgaaaaggggcgagatcacacatcacgctgtctcccgggggagcgccaagttgcagtggtttgttgaacgtaatatggtgattcccgagggaagagtcatcgatctgggctgtgggaggggaggctggtcatattactgcgcaggtctcaaaaaggtgactgaagtacgcgggtataccaagggaggccctggccacgaggagccggtgcccatgagtacatacgggtggaacattgttaaacttatgagcggaaaggacgtgttctacctgccacctgaaaaatgtgatactttgctgtgcgacatcggtgagtcctctcccagccctaccgtcgaagagtcccggacaattcgagtgctcaagatggtcgagccatggctgaaaaataaccagttctgtatcaaggtgctaaatccctatatgcctaccgttatagaacatcttgagagactgcagaggaagcacggcgggatgctagtacgcaacccactctcaagaaattctactcatgaaatgtactggattagtaacggaacgggcaatatcgtggcctcggtcaacatggtgagcagactgttgctgaaccgttttacaatgacccacaggcggcccactatcgagaaagatgttgacctcggtgctgggacccgccacgtgaatgcggaaccggagacacctaacatggatgtcattggagagcgaataaagagaatcaaagaagaacataattccacgtggcactatgacgaagagaacccatacaagacctgggcctatcatggctcttacgaagtgaaagcaactggctcagctagctccatgattaatggggtagtgaaacttctgacaaagccctgggacgttgtccctatggtgacccaaatggccatgactgatacaaccccattcggacagcagagggtgtttaaagagaaggtcgacacacggactccccgcagtatgccgggtaccagaagggttatgggcatcacggcagagtggttatggcgaaccctggggcggaacaaaaagcctcgtttgtgcacaagagaagagttcactaaaaaggtgcgcaccaatgccgctatgggagccgtatttacagaagagaaccaatgggattctgcgaaggcagccgtggaagacgaggatttctggaaactcgtcgacagggagcgggaactgcacaagctaggcaaatgtggtagctgcgtgtataatatgatggggaagagagagaagaaacttggagaatttggcaaagctaaaggctcacgcgccatttggtacatgtggctgggggcaaggtacctcgagttcgaggctctgggatttttgaacgaagatcattggttctcccgagagaatagttatagcggtgttgaaggcgaggggctgcacaagctcggatacatccttcgggacatatctaaaatccccggcggtgccatgtatgctgatgacactgccgggtgggataccagaattacggaagacgacctgcacaacgaggagaagatcacacagcagatggatccagaacataggcagttagcaaatgcgatttttaaactgacctaccaaaacaaggtggtcaaagtgcagcgccctactcccacaggaaccgtaatggacatcatatcccgtaaggatcagcggggctcaggccaggttgggacttatggattgaataccttcacaaacatggaggcccaactcattagacagatggaaggtgagggcgtgctgagcaaggctgacctagaaaacccacaccttcccgagaaaaagatcacgcagtggctggagaccaaaggggtcgaaaggctcaagcgcatggccatctcgggagatgactgcgtggtgaaacctattgatgaccgatttgcaaatgctctgttggccttaaacgatatgggcaaggtccggaaggacataccacagtggcaaccgtctaaaggttggcatgattggcagcaggttcccttctgtagtcaccacttccatgagctgatcatgaaggacgggagaaaactcgtggtaccttgcaggccacaggatgaacttattggacgcgcaagaatctcccaaggcgccggctggagcctgcgggagactgcgtgtctagggaaggcttacgcccagatgtggtcactgatgtattttcacaggcgtgacctccgattggcatccaatgccatttgctctgctgtgcccgtccattgggtgcctacaagccgcaccacttggagtatccacgcccatcaccagtggatgacaaccgaagacatgctgacggtttggaacagagtgtggatagaggataatccatggatggaggacaaaacacccgtcaccacttgggaagatgtgccttaccttggaaagcgggaggaccaatggtgtggttccctgatcggcctcaccagcagggcaacatgggctcagaacattccgactgccatccagcaggtacgctctttaattgggaatgaagagttcctggattacatgccatcaatgaagagatttcggaaagaggaagagagtgaaggagcgatctggtga

SEQ ID NO: 15371 - RNA, 9873 nt, synthetic construct
  misc_feature 1..9873: note = derived and/or modified CDS sequence (opt3) from DENV-3__KJ189291__SS-prME
  source 1..9873: mol_type = other RNA
accagcctgtgcctcatgatgatccttcccgcagctctggcattccacttgacctcccgggacggcgagcctaggatgattgtggggaagaacgaacggggaaaatctttactgtttaagactgcctcaggtataaatatgtgtacgttaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccaaaattcagggggaacaagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgactaagaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgccggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagaaatatggcccacaccctgattatgatcggcagtaacgcaagcgataggatgggtatgggggttacatatcttgccttgattgctacctttaagatacagcccttcctggcgttaggatttttcctccgcaaactgacttctcgagaaaatcttctgctaggcgtgggcctcgccatggcaacaaccctgcagttgccggaggacatcgaacaaatggctaacgggattgccctgggattaatggccctcaagctgatcacacagtttgagacttaccagctttggaccgctctgatttccttgacgtgttcaaatacaatcttcaccctcactgtcgcatggcggaccgccacactgatactagcgggtgtgagtctgcttcctgtttgccagagctcgtccatgcgtaaaactgattggctcccaatggctgtggccgcaatgggcgtcccacctctgcccttgtttatcttctctctgaaggacaccttaaagagaaggagctggccactcaacgagggggtaatggccgtgggactggtttcaattcttgctagttccctgttgcgcaacgatgtgcctatggcaggccccctcgtcgccggtgggctgctaatcgcgtgttatgtgattacgggaacatctgctgacctgaccgtagaaaaagccgcagatatcacttgggaggaagaggccgaacaaacaggcgtgagccataatcttatgataaccgtcgacgacgatggcactatgcggattaaggacgatgagacagagaacatcctcaccgttctgttgaaaacggctttactgatcgtgtccgggatttttccatactcaataccggccactctcctggtgtggcacacctggcagaagcagacacagagaagcggagtcctttgggacgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataatggaaagcgcctagaacccaactgggcctctgtcaaaaaggatctgatctcctacggcggcgggtggcggctcagcacacagtggcagaaaggagaggaagtgcaagtaattgcggtcgagcctggtaagaatcccaagaacttccagactatgcccggcaccttccagacaaccactggggaaatcggagccatagcactggactttaagcctggcacctcgggttcaccgatcattaatagagaggggaaggtggttggactttatggcaacggcgtggtcaccaagaatgggggatacgtgtctggtatcgctcagacgaacgccgagccagatggccccactcctgaattagaggaagagatgttcaagaaaaggaatctgaccattatggacctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggatttgatgtgccacgccacatttaccatgagactactgagccccgtaagggtgccaaactataatctcattatcatggacgaggctcatttcaccgatcctgcctctatagcagcccgggggtacattagcactcgagttggaatgggcgaagctgcggccatctttatgacagcaacacccccaggcacagctgacgccttccctcagtccaacgcacccattcaggatgaggagagagacatcccagaacgctcatggaatagtgggaacgagtggataactgactttgccggaaagacggtctggttcgtgccgagcattaaagctggtaacgatatcgccaattgtttaaggaagaacggcaaaaaggtgatccagctgtctcgtaagacctttgacacagaataccagaaaactaaacttaatgattgggacttcgtcgtaaccacagatatttccgagatgggggcgaactttaaagcagaccgggtgatcgatcctagaaggtgcctgaagcccgttattctcaccgacggaccagagcgcgtgatattggccggccccatgcctgtcactgctgcctcagctgcacagcgaagaggtcgggtggggaggaatccacagaaagaaaacgatcagtatatcttcacgggccaacccctgaataacgacgaggatcacgcccactggaccgaagctaagatgctcctggacaatattaacacacctgagggaatcatcccggcccttttcgaaccagagcgcgagaagagtgcagcgattgacggcgaataccgtctaaaaggggagagcagaaagacttttgttgaactgatgcggaggggagatttgcccgtgtggttagcccataaagtcgcttccgagggtataaagtataccgaccgcaaatggtgcttcgatggccagcgaaataaccagatcctggaagagaatatggacgtggagatttggacaaaggaaggggagaaaaagaagctcagacctcggtggctggatgccaggacctactctgacccccttgcactgaaagaatttaaggatttcgctgccggacgcaaatcgatcgcactcgacttggtaactgagattggcagagtgccaagccacctggcccataggacacggaacgctctagataatctggttatgctccacacgtcagaacacggtgggcgtgcgtatcgccatgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacagtggatagcctccgcaattgtgctagagttctttatgatggtcctgctcatcccagagcctgaaaagcaacgaaccccgcaggacaaccagcttgcttacgttgtgattggaatcctgacattggccgcgataatcgctgccaatgagatgggcctgctcgaaactacgaagagagatctgggtatgtcaaaagagcccggggtagtgtctccaaccagctatcttgacgtcgatctccaccctgcaagtgcctggacactgtacgctgtggcaactaccgttattacacccatgttgaggcataccatcgaaaactccactgccaacgtgagcctggcggctattgccaatcaagcagtcgtattaatgggcctagacaagggatggccaatctctaaaatggacctgggcgtgcctctccttgccctggggtgctactcacaggttaaccccttgacgctgacagctgccgtgctcctgcttataacccactatgcaattatcggaccgggcttacaggctaaggccactcgggaggcgcagaaacgcaccgccgcaggtatcatgaagaatccaacagtcgatgggattatgactatcgacctggatcctgtgatatacgactccaagttcgagaaacaactcggacaggtcatgttgctggtgctatgtgctgttcagctgctccttatgagaaccagttgggccctgtgcgaagcattgacactggctacgggccccattaccactctctgggagggtagcccaggcaagttttggaacacaaccatcgccgtgtcgatggccaatattttcagggggtcttatctggcgggagctggcttagcattttccatcatgaaaagcgtagggactggaaagcggggcacaggttcacagggggaaacccttggagagaaatggaagaagaaactgaaccaactcagtcgaaaggagttcgatctatacaaaagatctggcataacggaggtggaccgcaccgaggccaaggaaggtctgaaaaggggcgagatcacacatcacgctgtctcccgggggagcgccaagttgcagtggtttgttgaacgtaatatggtgattcccgagggaagagtcatcgatctgggctgtgggaggggaggctggtcatattactgcgcaggtctcaaaaaggtgactgaagtacgcgggtataccaagggaggccctggccacgaggagccggtgcccatgagtacatacgggtggaacattgttaaacttatgagcggaaaggacgtgttctacctgccacctgaaaaatgtgatactttgctgtgcgacatcggtgagtcctctcccagccctaccgtcgaagagtcccggacaattcgagtgctcaagatggtcgagccatggctgaaaaataaccagttctgtatcaaggtgctaaatccctatatgcctaccgttatagaacatcttgagagactgcagaggaagcacggcgggatgctagtacgcaacccactctcaagaaattctactcatgaaatgtactggattagtaacggaacgggcaatatcgtggcctcggtcaacatggtgagcagactgttgctgaaccgttttacaatgacccacaggcggcccactatcgagaaagatgttgacctcggtgctgggacccgccacgtgaatgcggaaccggagacacctaacatggatgtcattggagagcgaataaagagaatcaaagaagaacataattccacgtggcactatgacgaagagaacccatacaagacctgggcctatcatggctcttacgaagtgaaagcaactggctcagctagctccatgattaatggggtagtgaaacttctgacaaagccctgggacgttgtccctatggtgacccaaatggccatgactgatacaaccccattcggacagcagagggtgtttaaagagaaggtcgacacacggactccccgcagtatgccgggtaccagaagggttatgggcatcacggcagagtggttatggcgaaccctggggcggaacaaaaagcctcgtttgtgcacaagagaagagttcactaaaaaggtgcgcaccaatgccgctatgggagccgtatttacagaagagaaccaatgggattctgcgaaggcagccgtggaagacgaggatttctggaaactcgtcgacagggagcgggaactgcacaagctaggcaaatgtggtagctgcgtgtataatatgatggggaagagagagaagaaacttggagaatttggcaaagctaaaggctcacgcgccatttggtacatgtggctgggggcaaggtacctcgagttcgaggctctgggatttttgaacgaagatcattggttctcccgagagaatagttatagcggtgttgaaggcgaggggctgcacaagctcggatacatccttcgggacatatctaaaatccccggcggtgccatgtatgctgatgacactgccgggtgggataccagaattacggaagacgacctgcacaacgaggagaagatcacacagcagatggatccagaacataggcagttagcaaatgcgatttttaaactgacctaccaaaacaaggtggtcaaagtgcagcgccctactcccacaggaaccgtaatggacatcatatcccgtaaggatcagcggggctcaggccaggttgggacttatggattgaataccttcacaaacatggaggcccaactcattagacagatggaaggtgagggcgtgctgagcaaggctgacctagaaaacccacaccttcccgagaaaaagatcacgcagtggctggagaccaaaggggtcgaaaggctcaagcgcatggccatctcgggagatgactgcgtggtgaaacctattgatgaccgatttgcaaatgctctgttggccttaaacgatatgggcaaggtccggaaggacataccacagtggcaaccgtctaaaggttggcatgattggcagcaggttcccttctgtagtcaccacttccatgagctgatcatgaaggacgggagaaaactcgtggtaccttgcaggccacaggatgaacttattggacgcgcaagaatctcccaaggcgccggctggagcctgcgggagactgcgtgtctagggaaggcttacgcccagatgtggacactgatgtattttcacaggcgtgacctccgattggcatcaaatgccatttgctccgctgtgcccgtccattgggtgcctacctctcgcactacatggagcatccacgcccatcaccagtggatgaccacggaagacatgctgacagtttggaacagagtgtggatagaggataatccatggatggaggacaaaacccccgtcactacctgggaagatgtgccttaccttggaaagcgggaggaccaatggtgtggtagtctgatcggcctcacatccagggcaacttgggctcagaacattccgaccgccatccagcaggtacgcagcttaattgggaatgaagagttcctggattacatgccatctatgaagagatttcggaaagaggaagagtcagaaggagcgatctggtga

SEQ ID NO: 15372 - RNA, 9873 nt, synthetic construct
  misc_feature 1..9873: note = derived and/or modified CDS sequence (opt3) from DENV-3__KJ189292__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagctgagccggaagacatcgattgctggtgtaacctgaccagtacatgggttacctatgggacttgcaatcaggccggagagcaccgccgagacaagcgtagcgtggcacttgccccccatgtaggcatgggtctggatacaagaacccaaacgtggatgtccgctgagggggcatggaggcaggtggaaaaagtcgagacttgggccttgcggcaccctggattcaccattctcgctctgtttctggcccattacatcggcacatctctcactcagaaggtggttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcaactggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgaccctcccagaatatggaactcttggcctggagtgctctccgcgaaccggtttggacttcaatgagatgatcctactgacaatgaaaaacaaggcctggatggtccatagacagtggtttttcgatctccccctgccttggaccagcggggcaactacagaaacgccaacctggaataggaaagagcttctggtgacttttaagaacgctcacgccaaaaagcaagaagtagttgtgttgggctcccaggagggagctatgcacacagccctcaccggcgcaacagaaatccagaattcagggggaactagtattttcgccggtcatctgaagtgtcggttaaaaatggacaagctggagctaaaaggcatgagctacgctatgtgcaccaacacgtttgtcctcaagaaagaggtgtctgaaacccagcacgggacaatactgatcaaggtcgagtacaagggagaagatgcgccctgtaaaattcctttctccactgaggacggccatggtaaggcacacaacgggcgtcttatcaccgccaatccagtggttacaaaaaaggaggaacccgtgaacatagaggctgaaccgcctttcggcgagtcaaatattatgatcggaatcggcgataacgccttgaaaattaattggtataagaaggggagcagtatcggaaaaatgtttgaagcaactgcccgcggtgctagaaggatggccattctgggcgacaccgcatgggatttcgggtctgtaggaggcgtcctcaactccctgggtaagatggtgcatcaaatatttgggagcgcgtacacggctcttttctcgggcgtttcttgggtgatgaaaatcggaattggcgtcctgttgacatggatcgggctcaattccaagaacacctcaatgagttttagctgcatcgccattggaataatcactctgtatttaggcgcagtggtacaggccgacatgggttgtattatcaattggaaagggaaggagctgaagtgcggatccggcattttcgtgacaaacgaggttcacacctggactgaacagtacaaatttcaggctgattctcccaagcggctagccaccgcaatcgctggtgcctgggagaatggcgtctgtgggatacgaagcacaacgcgcatggaaaacctcctgtggaaacaaatcgcgaatgagcttaactatattttgtgggaaaataacatcaagctgaccgtggtggtcggagacattatcggcgttctcgagcaggggaaaagaactctgacaccacagcctatggagttaaagtactcatggaaaacctggggaaaggccaagatagtgacagctgaaactcagaacagttccttcattatcgatggccccaataccccagagtgccccagcgcatctagggcctggaacgtgtgggaagtagaggactatggttttggggtcttcacgacaaatatttggctgcggcttcgcgaagtgtacacccaattgtgtgaccacagactcatgtcagctgccgttaaagatgagagggcagtgcatgcggacatgggatactggatcgagagtcagaagaacggcagctggaaactggaaaaggcctccctaatagaggtcaaaacttgcacctggcctaagtctcacacactgtggtcgaatggtgtgctcgaaagcgatatgatcattccaaagtccctggctggcccgatctcacagcataaccaccgtcccgggtatcacactcagaccgccggaccttggcatcttggcaaattggagctggactttaattactgcgaggggacaacggttgtgattaccgaaaactgtggaactcggggcccaagtttacgaacaaccactgtatctggtaagctcatccacgagtggtgctgtagaagctgcacactgccccctcttaggtatatgggggaagatggatgttggtacggcatggagatacgcccaatttccgaaaaagaggagaatatggtcaagtcactggtgagcgcaggttctggcaaagtggacaacttcaccatgggggtcttgtgcctcgctatcctgtttgaagaggttatgcggggaaagttcggcaagaaacatatgatcgccggggtgttctttacgttcgtactactgctctccggacaaattacttggagagatatggcacacaccctgatcatgattggcagtaatgccagcgacaggatgggtatgggggtgacatatcttgctttgatagcgacctttaagatccagcccttcctggccttaggatttttcctccgcaaactgacttctcgagaaaaccttctgctaggcgtcggcctcgcaatggctacaaccctgcagttgccggaggatattgaacaaatggccaatgggatcgccctgggattaatggctctcaagctgattacacagtttgagacttaccagctttggaccgcactgatctccttgacgtgttcaaacacaatattcaccctcactgtggcctggcggaccgcgacactgatcctagctggtgttagtctgcttcctgtgtgccagagctcgtccatgcgtaaaactgactggctcccaatggccgtcgcagccatgggcgtgccccctctgcccttgtttattttctctctgaaggataccttaaagagaaggagctggccactcaatgagggggttatggctgtgggactggtctcaatccttgcaagttccctgttgcgcaacgacgtacctatggccggccccctcgtggcgggtgggctgctaattgcttgttatgttatcacgggaacatctgccgatctgaccgtggaaaaagcagccgacataacttgggaggaagaggctgaacaaacaggcgtcagccataaccttatgattaccgtggacgatgacggcactatgcggatcaaggatgacgagacagagaatatcctcaccgtactgttgaaaacggccttactgattgtgtccgggatatttccatactcaatcccggcaactctcctggtctggcacacctggcagaagcagacacagagaagcggagttctttgggatgtgcctagtcccccagaaacccaaaaagctgagctggaagagggtgtgtacaggattaagcagcagggcatcttcgggaaaacacaggtcggagtgggcgttcaaaaggagggtgtatttcacactatgtggcatgtgacccgaggggccgtcttgacgtataacggaaagcgcctagaacccaattgggcgtctgtgaaaaaggacctgatttcctacggcggcgggtggcggctcagcacacagtggcagaaaggagaggaagttcaagtgatcgccgtcgagcctggtaagaacccaaaaaatttccagactatacccggcaccttccagacaaccactggggaaatcggagcaattgctctggattttaagcctggcacctcgggttcaccgatcattaacagagaggggaaggtggtaggactttatggcaatggcgtcgtgacaaaaaacgggggatacgtttctggtatcgcccagacgaatgctgagccagacggcagtactcccgaattagaggaagagatgttcaagaaaaggaacctgaccataatggatctccaccctgggtccggaaagacacgtaaatatttgccagcaattgtgcgcgaagccatcaagcggagactgaggaccctcatcctggcccccactcgagtcgtggctgcggagatggaggaagcacttaagggcctgcctattcggtaccaaacaaccgccacgaaaagcgagcatactggtcgcgaaatcgttgacttgatgtgccacgctacatttaccatgagactactgtctccggtgagggtccccaattataacctcataattatggatgaggcccatttcaccgacccagcaagcatcgccgctcgggggtacatttccactcgagtgggaatgggcgaagcggccgcaatctttatgacagctacccctcccggcacagccgatgcattcccacagtcaaatgcccctatacaggacgaggagagagacattcccgaacgcagttggaacagcgggaatgagtggatcactgattttgctggaaagacggtatggttcgtgccatctatcaaagccggtaacgacattgcgaactgtttaaggaagaatggcaaaaaggttatccagctgtcccgtaagacctttgatacagaataccaaaaaactaagcttaacgactgggatttcgtcgtgaccacagacatttcagagatgggggcaaattttaaagccgatcgggtgatagacccgagaaggtgcctgaagcctgtcatcctcaccgatggacccgagcgcgtaattttggctggcccaatgcccgtgactgttgccagtgctgcacagcgaagaggtcgggtggggaggaaccctcagaaagaaaatgaccagtatatcttcacgggccaaccactgaacaatgatgaggaccacgcccactggaccgaagctaagatgctcctggacaacatcaatacacccgagggaattatacctgcccttttcgaaccggagcgcgagaagagcgcagcgatcgatggcgaataccgtctaaaaggggagtccagaaagacttttgtcgaactgatgcggaggggagacttgccagtgtggttagcccataaagttgcttctgagggtattaagtataccgatcgcaaatggtgcttcgacggccagcgaaacaatcagatcctggaagagaacatggatgtggagatttggacaaaggaaggggagaaaaagaagctcagaccccggtggctggacgccaggacctactcggatcctcttgcactgaaagaatttaaggacttcgctgccggacgcaaaagcatcgcactcgatttggtcactgagataggcagagtgccctcacacctggcccataggacacggaatgctctagacaacctggtaatgctccacacgtccgaacacggtgggcgtgcgtatcgccatgccgtggaggagcttccagaaaccatggagactctgttattgctgggcctcatgatcctgcttacaggaggcgcaatgctgtttctcattagtgggaagggaatcggtaaaacctctattggcttgatctgtgttatagctagctccgggatgctgtggatggccgaaattcctttacagtggatcgcctcagcaattgtcctagagttctttatgatggtgctgctcatccccgagccagaaaagcaacgaacccctcaggataatcagcttgcttacgtggtcataggaatcctgacattggccgcgattatcgctgccaacgagatgggcctgctcgaaactacgaagagagacctgggtatgtctaaagagccgggggttgtgagccccaccagttatcttgatgtagacctccacccagcatccgcctggacactgtacgctgtggcaactaccgtcattacacctatgttgaggcataccatcgaaaatagcactgccaacgtgtctctggcggctatagccaaccaagcagttgtgttaatgggcctagacaagggatggcccatttcaaaaatggatctgggcgtcccactccttgccctggggtgctactcccaggtaaatcctttgacgctgacagctgccgtgctcctgcttatcacccactatgcaatcattggacccggcttacaggctaaggccactcgggaggcgcagaaacgcaccgccgcaggtatcatgaagaacccgacagttgacgggataatgactattgatctggacccagtgatctacgatagtaagttcgagaaacaactcggacaggtcatgttgctggtgctatgtgctgtccagctgctccttatgagaaccagctgggccctgtgcgaagcattgacactggctacgggccctattaccactctctgggagggttcgcccggcaagttttggaatacaaccatcgccgtgtctatggccaacatattcagggggtcctatctggcgggagctggcttagcatttagcatcatgaaatcagttgggactggaaagcggggcacaggtagtcagggggaaacccttggagagaaatggaagaagaaactgaatcaactctctcgaaaggaattcgacctatacaaaaagtccggcattacggaggtggatagaaccgaggccaaagaaggtctgaagcgcggcgagatcacacatcacgctgtaagcagggggtcagccaaattgcagtggtttgtggaacggaacatggtcattccagagggacgtgttatcgacctgggctgtgggagaggaggctggagttattactgcgcaggtctcaagaaggtgactgaagtcagggggtataccaaaggaggccccggccacgaggagcctgtgccgatgagcacatacgggtggaatattgtaaagcttatgtccggaaaagatgtgttctacctgcccccagaaaagtgtgacactttgctgtgcgatatcggtgagtctagcccttcccccaccgttgaagagtcacgcacaatacgggtgctcaaaatggtcgagccttggttaaagaacaatcagttctgtattaaggtgctgaacccatatatgcccaccgtcatcgaacatcttgagcgactgcagagaaaacacggcgggatgctagtgaggaatcctctctctcgcaacagtactcatgaaatgtactggatctcgaatggaacgggcaacattgttgccagcgtaaatatggtgtcccggctgttgctgaacagatttacaatgacccaccgtaggccaactatagagaaggacgtcgatctcggtgctgggacccggcacgtgaacgcggaacccgagacaccgaatatggacgttatcggagagcgcattaaacgaatcaaggaagagcataactctacgtggcactatgacgatgaaaatccttacaaaacctgggcctatcatggctcatacgaggtgaaggcaactggcagcgcttccagtatgattaacggggtcgtgaagcttctgacaaaaccatgggacgtagtgcccatggttacccaaatggccatgactgatacaacccctttcggacagcagagagtctttaaggaaaaagtggacacaaggactccacggtctatgcccggtacccgcagagtgatgggcatcacggcagagtggttatggaggaccctggggcgaaataagaaaccgcggttgtgcacacgtgaggaattcactaagaaggtcagaaccaacgccgctatgggagccgtttttacagaggaaaatcaatgggatagcgcgaaagcagccgtggaggacgaagatttctggaagctcgtagaccgcgagagggagctgcacaaactaggcaagtgtggttcatgcgtgtataacatgatggggaaacgggaaaagaaacttggagagtttggcaaggctaagggctccagagccatatggtacatgtggctgggggcacgctacctcgaattcgaggctctgggatttttgaatgaggatcattggttcagtagggaaaacagctattctggtgtcgagggcgaagggctgcacaaactcggatacatccttcgagacatttccaagatccctggcggtgccatgtatgctgatgacactgccgggtgggacacccggattacggaggatgacctgcacaatgaagagaaaatcacacagcagatggatcccgagcatagacagttagcaaacgcgatatttaagctgacctaccaaaataaagtggttaaggtgcagaggccaactcctacaggaaccgtcatggacattatctcacgcaaggatcagcgtggcagcggccaggtggggacttatggattgaacaccttcacaaatatggaagtacaactcatccggcagatggagggtgaaggcgttctgtcgaaagccgacctagagaacccccaccttccagaaaagaaaattacgcagtggctggagaccaagggggtggagagactcaaaaggatggctatatctggagatgactgcgtcgtgaagcccatcgatgaccgctttgccaacgcactgttggctttaaatgatatgggcaagattcgaaaagacatccctcagtggcaaccaagtaagggttggcatgattggcagcaggtgccgttctgttcccaccacttccatgaactgattatgaaagacgggcggaagctcgtcgttccctgcagacctcaggacgagcttatcggaagggcccgcataagccaaggcgcaggctggtcactgagagaaactgcctgtctagggaaagcgtacgctcagatgtggtccctgatgtattttcaccggagggatctccgtttggcctctaacgcaatctgcagcgccgtgccagtacattgggtgcccacaagtcgaaccacttggtccattcacgctcatcaccagtggatgacaaccgaggacatgctgacggtctggaatcgcgtgtggatcgaagataacccttggatggaggacaagacaccagttaccacttgggaggatgtgccctaccttggaaagagagaagaccaatggtgtggtagcctgattggcctcacctctcgggccacatgggcacagaatatccctactgctattcagcaggtcaggtcattaatagggaacgaggaattcctggattacatgccgagtatgaaacgctttagaaaggaggaggaatccgagggagccatctggtga

SEQ ID NO: 15373 - RNA, 9873 nt, synthetic construct
  misc_feature 1..9873: note = derived and/or modified CDS sequence (opt3) from DENV-3__KJ189293__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagagatatggcccacaccctgattatgatcggcagtaatgcaagcgacaggatgggtatgggggttacatatcttgccttgattgctacctttaagatacagcccttcctggcgttaggatttttcctccgcaaactgacttctcgagaaaaccttctgctaggcgtgggcctcgccatggcaacaaccctgcagttgccggaggatatcgaacaaatggctaatgggattgccctgggattaatggccctcaagctgatcacacagtttgagacttaccagctttggaccgctctgatttccttgacgtgttcaaacacaatcttcaccctcactgtcgcatggcggaccgccacactgatactagcgggtgtgagtctgcttcctgtttgccagagctcgtccatgcgtaaaactgactggctcccaatggctgtggccgcaatgggcgtcccccctctgcccttgtttatcttctctctgaaggataccttaaagagaaggagctggccactcaatgagggggtaatggccgtgggactggtttcaattcttgctagttccctgttgcgcaacgacgtgcctatggcaggccccctcgtcgccggtgggctgctaatcgcgtgttatgtgattacgggaacatctgctgatctgaccgtagaaaaagccgcagacatcacttgggaggaagaggccgaacaaacaggcgtgagccataaccttatgataaccgtcgacgatgacggcactatgcggattaaggatgacgagacagagaatatcctcaccgttctgttgaaaacggctttactgatcgtgtccgggatttttccatactcaataccggccactctcctggtgtggcacacctggcagaagcagacacagagaagcggagtcctttgggatgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataacggaaagcgcctagaacccaattgggcctctgtcaaaaaggacctgatctcctacggcggcgggtggcggctcagcacacagtggcagaaaggagaggaagtgcaagtaattgcggtcgagcctggtaagaacccaaaaaatttccagactatgcccggcaccttccagacaaccactggggaaatcggagccatagcactggattttaagcctggcacctcgggttcaccgatcattaacagagaggggaaggtggttggactttatggcaatggcgtggtcacaaaaaacgggggatacgtgtctggtatcgctcagacgaatgccgagccagacggccccactcctgaattagaggaagagatgttcaagaaaaggaacctgaccattatggatctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggacttgatgtgccacgccacatttaccatgagactactgagccccgtaagggtgccaaattataacctcattatcatggatgaggctcatttcaccgaccctgcctctatagcagcccgggggtacattagcactcgagttggaatgggcgaagctgcggccatctttatgacagcaacccccccaggcacagctgatgccttccctcagtccaatgcacccattcaggacgaggagagagacatcccagaacgctcatggaacagtgggaatgagtggataactgattttgccggaaagacggtctggttcgtgccgagcattaaagctggtaacgacatcgccaactgtttaaggaagaatggcaaaaaggtgatccagctgtctcgtaagacctttgatacagaataccaaaaaactaagcttaacgactgggatttcgtcgtaaccacagacatttccgagatgggggcgaattttaaagcagatcgggtgatcgaccctagaaggtgcctgaagcccgttattctcaccgatggaccagagcgcgtgatattggccggccccatgcctgtcactgctgcctcagctgcacagcgaagaggtcgggtggggaggaacccacagaaagaaaatgaccagtatatcttcacgggccaacccctgaacaatgatgaggaccacgcccactggaccgaagctaagatgctcctggacaacattaatacacctgagggaatcatcccggcccttttcgaaccagagcgcgagaagagtgcagcgattgatggcgaataccgtctaaaaggggagagcagaaagacttttgttgaactgatgcggaggggagacttgcccgtgtggttagcccataaagtcgcttccgagggtataaagtataccgatcgcaaatggtgcttcgacggccagcgaaacaatcagatcctggaagagaacatggatgtggagatttggacaaaggaaggggagaaaaagaagctcagacctcggtggctggacgccaggacctactctgatccccttgcactgaaagaatttaaggacttcgctgccggacgcaaatcgatcgcactcgatttggtaactgagattggcagagtgccaagccacctggcccataggacacggaatgctctagacaacctggttatgctccacacgtcagaacacggtgggcgtgcgtatcgccatgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacagtggatagcctccgcaattgtgctagagttctttatgatggtcctgctcatcccagagcctgaaaagcaacgaaccccgcaggataatcagcttgcttacgttgtgattggaatcctgacattggccgcgataatcgctgccaacgagatgggcctgctcgaaactacgaagagagacctgggtatgtcaaaagagcccggggtagtgtctccaaccagctatcttgatgtcgacctccaccctgcaagtgcctggacactgtacgctgtggcaactaccgttattacacccatgttgaggcataccatcgaaaattccactgccaacgtgagcctggcggctattgccaaccaagcagtcgtattaatgggcctagacaagggatggccaatctctaaaatggatctgggcgtgcctctccttgccctggggtgctactcacaggttaatcccttgacgctgacagctgccgtgctcctgcttataacccactatgcaattatcggaccgggcttacaggctaaggccactcgggaggcgcagaaacgcaccgccgcaggtatcatgaagaacccaacagtcgacgggattatgactatcgatctggaccctgtgatatacgattccaagttcgagaaacaactcggacaggtcatgttgctggtgctatgtgctgttcagctgctccttatgagaaccagttgggccctgtgcgaagcattgacactggctacgggccccattaccactctctgggagggtagcccaggcaagttttggaatacaaccatcgccgtgtcgatggccaacattttcagggggtcttatctggcgggagctggcttagcattttccatcatgaaaagcgtagggactggaaagcggggcacaggttcacagggggaaacccttggagagaaatggaagaagaaactgaatcaactcagtcgaaaggaattcgacctatacaaaaagtctggcataacggaggtggatagaaccgaggccaaagaaggtctgaagcgcggcgagatcacacatcacgctgtctccagggggagcgccaaattgcagtggtttgttgaacggaacatggtgattcccgagggacgtgtcatcgacctgggctgtgggagaggaggctggtcatattactgcgcaggtctcaagaaggtgactgaagtaagggggtataccaaaggaggccctggccacgaggagccggtgcccatgagtacatacgggtggaatattgttaagcttatgagcggaaaagatgtgttctacctgccacctgaaaagtgtgacactttgctgtgcgatatcggtgagtcctctcccagccctaccgtcgaagagtcccgcacaattcgggtgctcaaaatggtcgagccatggttaaagaacaatcagttctgtatcaaggtgctgaacccctatatgcctaccgttatagaacatcttgagcgactgcagagaaaacacggcgggatgctagtaaggaatccactctcacgcaactctactcatgaaatgtactggattagtaatggaacgggcaacatcgtggcctcggtcaatatggtgagccggctgttgctgaacagatttacaatgacccaccgtaggcccactatcgagaaggacgttgatctcggtgctgggacccggcacgtgaacgcggaaccggagacacctaatatggacgtcattggagagcgcataaaacgaatcaaggaagagcataactccacgtggcactatgacgatgaaaatccatacaaaacctgggcctatcatggctcttacgaggtgaaggcaactggctcagctagctccatgattaacggggtagtgaagcttctgacaaaaccctgggacgttgtccctatggtgacccaaatggccatgactgatacaaccccattcggacagcagagagtgtttaaggaaaaagtcgacacaaggactccccggagtatgccgggtacccgcagagttatgggcatcacggcagagtggttatggaggaccctggggcgaaataagaaacctcggttgtgcacacgtgaggaattcactaagaaggtgagaaccaacgccgctatgggagccgtatttacagaggaaaatcaatgggattctgcgaaagcagccgtggaggacgaagatttctggaagctcgtcgaccgcgagagggagctgcacaaactaggcaagtgtggtagctgcgtgtataacatgatggggaaacgggaaaagaaacttggagagtttggcaaggctaagggctcaagagccatttggtacatgtggctgggggcacgctacctcgaattcgaggctctgggatttttgaatgaggatcattggttctccagggaaaacagttatagcggtgttgagggcgaagggctgcacaaactcggatacatccttcgagacatatctaagatccccggcggtgccatgtatgctgatgacactgccgggtgggacacccggattacggaggatgacctgcacaatgaagagaaaatcacacagcagatggatccagagcatagacagttagcaaacgcgatttttaagctgacctaccaaaataaagtggtcaaggtgcagaggcctactcccacaggaaccgtaatggacatcatatcccgcaaggatcagcgtggctcaggccaggttgggacttatggattgaacaccttcacaaatatggaagcccaactcattcggcagatggagggtgaaggcgtgctgagcaaagctgacctagagaacccacaccttcccgaaaagaaaatcacgcagtggctggagaccaagggggtcgagagactcaaaaggatggccatctcgggagatgactgcgtggtgaagcctattgatgaccgctttgcaaacgctctgttggccttaaatgatatgggcaaggtccgaaaagacataccacagtggcaaccgtctaagggttggcatgattggcagcaggttcccttctgtagtcaccacttccatgaactgatcatgaaagacgggcggaagctcgtggtaccttgcagaccacaggacgagcttattggaagggcacgcatctcccaaggcgccggctggagcctgagagaaactgcgtgtctagggaaagcttacgcccagatgtggtcactgatgtattttcaccggagggatctccgtttggcatccaacgccatttgctctgctgtgcccgtccattgggtgcctacaagccgaaccacttggagtatccacgcccatcaccagtggatgacaaccgaggacatgctgacggtttggaatcgcgtgtggatagaagataacccatggatggaggacaagacacccgtcaccacttgggaggatgtgccttaccttggaaagagagaagaccaatggtgtggttccctgatcggcctcaccagccgggcaacatgggctcagaatattccgactgccatccagcaggtaaggtctttaattgggaacgaggaattcctggattacatgccatcaatgaaacgctttagaaaggaggaggaaagtgagggagcgatctggtga

SEQ ID NO: 15374 - RNA, 9873 nt, synthetic construct
  misc_feature 1..9873: note = derived and/or modified CDS sequence (opt3) from DENV-3__KJ189294__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcatcctcgagcaggggaaaagaactctgacaccacagcctatggagttaaagtactcatggaaaacctggggaaaggcgaagatagtaacagccgaaactcagaacagttccttcattatcgatggccccaataccccagagtgccccagcgcttctagggcatggaacgtctgggaagtggaggactatggttttggggttttcacgacaaatatttggctgcggcttcgcgaagtgtacacccaattgtgtgaccacagactcatgtcagccgctgtcaaagatgagagggccgtgcatgcagacatgggatactggatcgagagtcagaagaacggcagctggaaactggaaaaggcgtccctaatagaggttaaaacttgcacctggcctaagtctcacacactgtggtcgaatggtgtgctcgaaagcgatatgatcattccaaagtccctggccggcccgatctcacagcataaccaccgtcccgggtatcacactcagaccgctggaccttggcatcttggcaaattggagctggactttaattactgcgaggggacaacggtagtcattaccgaaaactgtggaactcggggcccaagtttacgaacaaccactgtgtctggtaagctcatccacgagtggtgctgtagaagctgcacactgccccctcttaggtatatgggggaagatggatgttggtacggcatggagatacgcccaatttccgaaaaagaggagaatatggtgaagtcactggtcagcgccggttctggcaaagttgacaacttcaccatgggggtgttgtgcctcgcaatcctgtttgaagaggtaatgcggggaaagttcggcaagaaacatatgatcgctggggtgttctttacgttcgtcctactgctctccggacaaattacttggagagatatggcccacaccctgatcatgattggcagtaatgcaagcgacaggatgggtatgggggtgacatatcttgccttgatagctacctttaagatccagcccttcctggcgttaggatttttcctccgcaaactgacttctcgagaaaaccttctgctaggcgttggcctcgccatggcaacaaccctgcagttgccggaggatattgaacaaatggctaatgggatcgccctgggattaatggccctcaagctgattacacagtttgagacttaccagctttggaccgctctgatctccttgacgtgttcaaacacaatattcaccctcactgtggcatggcggaccgccacactgatcctagcgggtgtcagtctgcttcctgtgtgccagagctcgtccatgcgtaaaactgactggctcccaatggctgttgccgcaatgggcgtgccccctctgcccttgtttattttctctctgaaggataccttaaagagaaggagctggccactcaatgagggggtcatggccgtaggactggtgtcaatccttgctagttccctgttgcgcaacgacgttcctatggcaggccccctcgtggccggtgggctgctaattgcgtgttatgtcatcacgggaacatctgctgatctgaccgtggaaaaagccgcagacataacttgggaggaagaggccgaacaaacaggcgtaagccataaccttatgattaccgtggacgatgacggcactatgcggatcaaggatgacgagacagagaatatcctcaccgtcctgttgaaaacggctttactgattgtttccgggatatttccatactcaatcccggccactctcctggtgtggcacacctggcagaagcagacacagagaagcggagtgctttgggatgtccctagtcccccagaaacccaaaaagcagagctggaagagggtgtgtacaggattaagcagcagggcatcttcgggaaaacacaggttggagtaggcgtgcaaaaggagggtgtctttcacactatgtggcatgtgacccgaggggctgttttgacgtataacggaaagcgcctagaacccaattgggcctctgtgaaaaaggacctgatttcctacggcggcgggtggcggctcagcacacagtggcagaaaggagaggaagtccaagtgatcgcggtagagcctggtaagaacccaaaaaatttccagactatgcccggcaccttccagacaaccactggggaaataggagccatcgcactggattttaagcctggcacctcgggttcaccgattatcaacagagaggggaaggtcgtgggactttatggcaatggcgttgtgacaaaaaacgggggatacgtctctggtattgctcagacgaatgccgagccagacggccccactcctgaattagaggaagagatgttcaagaaaaggaacctgaccatcatggatctccacccagggagtggaaagacacgtaaatatttgcccgctatagtgcgcgaagcaattaagcggagactgaggaccctcatcctggcccctactcgagttgtggccgctgagatggaggaagcgcttaagggcctgccgatccggtaccaaacaaccgcaacgaaatccgagcatactggtcgcgaaattgtcgacttgatgtgccacgccacatttaccatgagactactgagccccgtgagggtaccaaattataacctcatcataatggatgaggctcatttcaccgaccctgcctctattgcagcccgggggtacatcagcactcgagtgggaatgggcgaagctgcggccatttttatgacagcaacccccccaggcacagctgatgccttccctcagtccaatgcacccatccaggacgaggagagagacataccagaacgctcatggaacagtgggaatgagtggattactgattttgccggaaagacggtttggttcgtcccgagcatcaaagctggtaacgacatcgccaactgtttaaggaagaatggcaaaaaggtgattcagctgtctcgtaagacctttgatacagaataccaaaaaactaagcttaacgactgggatttcgtggtcaccacagacatctccgagatgggggcgaattttaaagcagatcgggtaattgaccctagaaggtgcctgaagcccgtgatactcaccgatggaccagagcgcgttatcttggccggccccatgcctgtgactgctgcctcagctgcacagcgaagaggtcgggtcgggaggaacccacagaaagaaaatgaccagtatattttcacgggccaacccctgaacaatgatgaggaccacgcccactggaccgaagctaagatgctcctggacaacatcaatacacctgagggaatcattccggcccttttcgaaccagagcgcgagaagagtgcagcgatagatggcgaataccgtctaaaaggggagagcagaaagacttttgtggaactgatgcggaggggagacttgcccgtttggttagcccataaagtggcttccgagggtatcaagtataccgatcgcaaatggtgcttcgacggccagcgaaacaatcagattctggaagagaacatggatgtcgagatctggacaaaggaaggggagaaaaagaagctcagacctcggtggctggacgccaggacctactctgatccccttgcactgaaagaatttaaggacttcgctgccggacgcaaatcgattgcactcgatttggtgactgagatcggcagagtaccaagccacctggcccataggacacggaatgctctagacaacctggtgatgctccacacgtcagaacacggtgggcgtgcgtatcgccatgccgttgaggagcttcctgaaaccatggagactctgttattgctgggcctcatgatactgcttacaggaggcgcaatgctgtttctcatctccgggaagggaattggtaaaaccagtatcggcttgatttgtgtcatcgcttctagcgggatgctgtggatggccgaaatacccttacagtggattgcctccgcaatcgtgctagagttctttatgatggtgctgctcattccagagcctgaaaagcaacgaaccccgcaggataatcagcttgcttacgtcgttatcggaatactgacattggccgcgatcattgctgccaacgagatgggcctgctcgaaactacgaagagagacctgggtatgtcaaaagagcccggggtggtatctccaaccagctatcttgatgtggacctccaccctgcaagtgcctggacactgtacgctgtcgcaactaccgtgatcacacccatgttgaggcataccattgaaaattccactgccaacgttagcctggcggctatcgccaaccaagcagtggtcttaatgggcctagacaagggatggccaatatctaaaatggatctgggcgtacctctccttgccctggggtgctactcacaggtgaatcccttgacgctgacagctgccgttctcctgcttattacccactatgcaatcatcggaccgggcttacaggctaaggccactcgggaggcgcagaaacgcaccgccgcaggtattatgaagaacccaacagtggacgggatcatgactatagatctggaccctgtcatttacgattccaagttcgagaaacaactcggacaggtgatgttgctggtcctatgtgctgtgcagctgctccttatgagaaccagttgggccctgtgcgaagcattgacactggctacgggccccatcaccactctctgggagggtagcccaggcaagttttggaatacaaccattgccgtttcgatggccaacatcttcagggggtcttatctggcgggagctggcttagcattttccataatgaaaagcgtggggactggaaagcggggcacaggttcacagggggaaacccttggagagaaatggaagaagaaactgaatcaactcagtcgaaaggaattcgacctatacaaaaagtctggcatcacggaggtagatagaaccgaggccaaagaaggtctgaagcgcggcgagattacacatcacgctgtgtccagggggagcgccaaattgcagtggtttgtcgaacggaacatggttatccccgagggacgtgtgattgacctgggctgtgggagaggaggctggtcatattactgcgcaggtctcaagaaggtcactgaagtgagggggtataccaaaggaggccctggccacgaggagccggtacccatgagtacatacgggtggaatatcgtgaagcttatgagcggaaaagatgttttctacctgccacctgaaaagtgtgacactttgctgtgcgatattggtgagtcctctcccagccctaccgtggaagagtcccgcacaatccgggtcctcaaaatggtggagccatggttaaagaacaatcagttctgtataaaggtcctgaacccctatatgcctaccgtgattgaacatcttgagcgactgcagagaaaacacggcgggatgctagttaggaatccactctcacgcaactctactcatgaaatgtactggatcagtaatggaacgggcaacatcgtagcctcggtgaatatggtcagccggctgttgctgaacagatttacaatgacccaccgtaggcccactattgagaaggacgtggatctcggtgctgggacccggcacgttaacgcggaaccggagacacctaatatggacgtgataggagagcgcatcaaacgaattaaggaagagcataactccacgtggcactatgacgatgaaaatccatacaaaacctgggcctatcatggctcttacgaggtcaaggcaactggctcagctagctccatgatcaacggggtggtaaagcttctgacaaaaccctgggacgtggttcctatggtcacccaaatggccatgactgatacaaccccattcggacagcagagagtgtttaaggaaaaagtggacacaaggactccccggagtatgccgggtacccgcagagtcatgggcattacggcagagtggttatggaggaccctggggcgaaataagaaacctcggttgtgcacacgtgaggaattcactaagaaggttagaaccaacgccgctatgggagccgtgtttacagaggaaaatcaatgggattctgcgaaagcagccgtagaggacgaagatttctggaagctcgtggaccgcgagagggagctgcacaaactaggcaagtgtggtagctgcgtctataacatgatggggaaacgggaaaagaaacttggagagtttggcaaggctaagggctcaagagccatctggtacatgtggctgggggcacgctacctcgaattcgaggctctgggatttttgaatgaggatcattggttctccagggaaaacagttatagcggtgtggagggcgaagggctgcacaaactcggatacatacttcgagacatctctaagattcccggcggtgccatgtatgctgatgacactgccgggtgggacacccggatcacggaggatgacctgcacaatgaagagaaaattacacagcagatggatccagagcatagacagttagcaaacgcgatctttaagctgacctaccaaaataaagttgtgaaggtccagaggcctactcccacaggaaccgtgatggacataatttcccgcaaggatcagcgtggctcaggccaggtagggacttatggattgaacaccttcacaaatatggaagcccaactcatccggcagatggagggtgaaggcgttctgagcaaagctgacctagagaacccacaccttcccgaaaagaaaatcacgcagtggctggagaccaagggggtggagagactcaaaaggatggccatttcgggagatgactgcgtcgtgaagcctatagatgaccgctttgcaaacgctctgttggccttaaatgatatgggcaaggtgcgaaaagacatcccacagtggcaaccgtctaagggttggcatgattggcagcaggtccccttctgtagtcaccacttccatgaactgattatgaaagacgggcggaagctcgttgtgccttgcagaccacaggacgagcttatcggaagggcacgcatttcccaaggcgccggctggagcctgagagaaactgcgtgtctagggaaagcttacgcccagatgtggtcactgatgtattttcaccggagggatctccgtttggcatccaacgccatctgctctgctgtacccgtgcattgggtccctacaagccgaaccacttggagtatacacgcccatcaccagtggatgacaaccgaggacatgctgacggtgtggaatcgcgtttggatcgaagataacccatggatggaggacaagacacccgtgaccacttgggaggatgtcccttaccttggaaagagagaagaccaatggtgtggttccctgattggcctcaccagccgggcaacatgggctcagaatatcccgactgccattcagcaggtgaggtctttaatcgggaacgaggaattcctggattacatgccatcaatgaaacgctttagaaaggaggaggaaagtgagggagcgatttggtga

SEQ ID NO: 15375 - RNA, 9873 nt, synthetic construct
  misc_feature 1..9873: note = derived and/or modified CDS sequence (opt3) from DENV-3__KJ189295__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagagatatggcccacaccctgattatgatcggcagtaatgcaagcgacaggatgggtatgggggttacatatcttgccttgattgctacctttaagatacagcccttcctggcgttaggatttttcctccgcaaactgacttctcgagaaaaccttctgctaggcgtgggcctcgccatggcaacaaccctgcagttgccggaggatatcgaacaaatggctaatgggattgccctgggattaatggccctcaagctgatcacacagtttgagacttaccagctttggaccgctctgatttccttgacgtgttcaaacacaatcttcaccctcactgtcgcatggcggaccgccacactgatactagcgggtgtgagtctgcttcctgtttgccagagctcgtccatgcgtaaaactgactggctcccaatggctgtggccgcaatgggcgtcccccctctgcccttgtttatcttctctctgaaggataccttaaagagaaggagctggccactcaatgagggggtaatggccgtgggactggtttcaattcttgctagttccctgttgcgcaacgacgtgcctatggcaggccccctcgtcgccggtgggctgctaatcgcgtgttatgtgattacgggaacatctgctgatctgaccgtagaaaaagccgcagacatcacttgggaggaagaggccgaacaaacaggcgtgagccataaccttatgataaccgtcgacgatgacggcactatgcggattaaggatgacgagacagagaatatcctcaccgttctgttgaaaacggctttactgatcgtgtccgggatttttccatactcaataccggccactctcctggtgtggcacacctggcagaagcagacacagagaagcggagtcctttgggatgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataacggaaagcgcctagaacccaattgggcctctgtcaaaaaggacctgatctcctacggcggcgggtggcggctcagcacacagtggcagaaaggagaggaagtgcaagtaattgcggtcgagcctggtaagaacccaaaaaatttccagactatgcccggcaccttccagacaaccactggggaaatcggagccatagcactggattttaagcctggcacctcgggttcaccgatcattaacagagaggggaaggtggttggactttatggcaatggcgtggtcacaaaaaacgggggatacgtgtctggtatcgctcagacgaatgccgagccagacggccccactcctgaattagaggaagagatgttcaagaaaaggaacctgaccattatggatctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggacttgatgtgccacgccacatttaccatgagactactgagccccgtaagggtgccaaattataacctcattatcatggatgaggctcatttcaccgaccctgcctctatagcagcccgggggtacattagcactcgagttggaatgggcgaagctgcggccatctttatgacagcaacccccccaggcacagctgatgccttccctcagtccaatgcacccattcaggacgaggagagagacatcccagaacgctcatggaacagtgggaatgagtggataactgattttgccggaaagacggtctggttcgtgccgagcattaaagctggtaacgacatcgccaactgtttaaggaagaatggcaaaaaggtgatccagctgtctcgtaagacctttgatacagaataccaaaaaactaagcttaacgactgggatttcgtcgtaaccacagacatttccgagatgggggcgaattttaaagcagatcgggtgatcgaccctagaaggtgcctgaagcccgttattctcaccgatggaccagagcgcgtgatattggccggccccatgcctgtcactgctgcctcagctgcacagcgaagaggtcgggtggggaggaacccacagaaagaaaatgaccagtatatcttcacgggccaacccctgaacaatgatgaggaccacgcccactggaccgaagctaagatgctcctggacaacattaatacacctgagggaatcatcccggcccttttcgaaccagagcgcgagaagagtgcagcgattgatggcgaataccgtctaaaaggggagagcagaaagacttttgttgaactgatgcggaggggagacttgcccgtgtggttagcccataaagtcgcttccgagggtataaagtataccgatcgcaaatggtgcttcgacggccagcgaaacaatcagatcctggaagagaacatggatgtggagatttggacaaaggaaggggagaaaaagaagctcagacctcggtggctggacgccaggacctactctgatccccttgcactgaaagaatttaaggacttcgctgccggacgcaaatcgatcgcactcgatttggtaactgagattggcagagtgccaagccacctggcccataggacacggaatgctctagacaacctggttatgctccacacgtcagaacacggtgggcgtgcgtatcgccatgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacagtggatagcctccgcaattgtgctagagttctttatgatggtcctgctcatcccagagcctgaaaagcaacgaaccccgcaggataatcagcttgcttacgttgtgattggaatcctgacattggccgcgataatcgctgccaacgagatgggcctgctcgaaactacgaagagagacctgggtatgtcaaaagagcccggggtagtgtctccaaccagctatcttgatgtcgacctccaccctgcaagtgcctggacactgtacgctgtggcaactaccgttattacacccatgttgaggcataccatcgaaaattccactgccaacgtgagcctggcggctattgccaaccaagcagtcgtattaatgggcctagacaagggatggccaatctctaaaatggatctgggcgtgcctctccttgccctggggtgctactcacaggttaatcccttgacgctgacagctgccgtgctcctgcttataacccactatgcaattatcggaccgggcttacaggctaaggccactcgggaggcgcagaaacgcaccgccgcaggtatcatgaagaacccaacagtcgacgggattatgactatcgatctggaccctgtgatatacgattccaagttcgagaaacaactcggacaggtcatgttgctggtgctatgtgctgttcagctgctccttatgagaaccagttgggccctgtgcgaagcattgacactggctacgggccccattaccactctctgggagggtagcccaggcaagttttggaatacaaccatcgccgtgtcgatggccaacattttcagggggtcttatctggcgggagctggcttagcattttccatcatgaaaagcgtagggactggaaagcggggcacaggttcacagggggaaacccttggagagaaatggaagaagaaactgaatcaactcagtcgaaaggaattcgacctatacaaaaagtctggcataacggaggtggatagaaccgaggccaaagaaggtctgaagcgcggcgagatcacacatcacgctgtctccagggggagcgccaaattgcagtggtttgttgaacggaacatggtgattcccgagggacgtgtcatcgacctgggctgtgggagaggaggctggtcatattactgcgcaggtctcaagaaggtgactgaagtaagggggtataccaaaggaggccctggccacgaggagccggtgcccatgagtacatacgggtggaatattgttaagcttatgagcggaaaagatgtgttctacctgccacctgaaaagtgtgacactttgctgtgcgatatcggtgagtcctctcccagccctaccgtcgaagagtcccgcacaattcgggtgctcaaaatggtcgagccatggttaaagaacaatcagttctgtatcaaggtgctgaacccctatatgcctaccgttatagaacatcttgagcgactgcagagaaaacacggcgggatgctagtaaggaatccactctcacgcaactctactcatgaaatgtactggattagtaatggaacgggcaacatcgtggcctcggtcaatatggtgagccggctgttgctgaacagatttacaatgacccaccgtaggcccactatcgagaaggacgttgatctcggtgctgggacccggcacgtgaacgcggaaccggagacacctaatatggacgtcattggagagcgcataaaacgaatcaaggaagagcataactccacgtggcactatgacgatgaaaatccatacaaaacctgggcctatcatggctcttacgaggtgaaggcaactggctcagctagctccatgattaacggggtagtgaagcttctgacaaaaccctgggacgttgtccctatggtgacccaaatggccatgactgatacaaccccattcggacagcagagagtgtttaaggaaaaagtcgacacaaggactccccggagtatgccgggtacccgcagagttatgggcatcacggcagagtggttatggaggaccctggggcgaaataagaaacctcggttgtgcacacgtgaggaattcactaagaaggtgagaaccaacgccgctatgggagccgtatttacagaggaaaatcaatgggattctgcgaaagcagccgtggaggacgaagatttctggaagctcgtcgaccgcgagagggagctgcacaaactaggcaagtgtggtagctgcgtgtataacatgatggggaaacgggaaaagaaacttggagagtttggcaaggctaagggctcaagagccatttggtacatgtggctgggggcacgctacctcgaattcgaggctctgggatttttgaatgaggatcattggttctccagggaaaacagttatagcggtgttgagggcgaagggctgcacaaactcggatacatccttcgagacatatctaagatccccggcggtgccatgtatgctgatgacactgccgggtgggacacccggattacggaggatgacctgcacaatgaagagaaaatcacacagcagatggatccagagcatagacagttagcaaacgcgatttttaagctgacctaccaaaataaagtggtcaaggtgcagaggcctactcccacaggaaccgtaatggacatcatatcccgcaaggatcagcgtggctcaggccaggttgggacttatggattgaacaccttcacaaatatggaagcccaactcattcggcagatggagggtgaaggcgtgctgctaaaagctgaccttgagaacccacacctgcccgaaaagaaaatcacgcagtggctcgagaccaagggggtcgagagactgaaaaggatggccatcagcggagatgactgcgtggtgaagcctattgatgaccgctttgcaaacgctttgttagccctgaatgatatgggcaaggtccgaaaagacataccacagtggcaaccgtcgaagggttggcatgattggcagcaggttcccttctgttctcaccacttccatgaactcatcatgaaagacgggcggaagcttgtggtaccttgcagaccacaggacgagctgattggaagggcacgcatcagtcaaggcgccggctggtccctaagagaaactgcgtgtctggggaaagcttacgcccagatgtggagcctcatgtattttcaccggagggatttgcgtctggcatcaaacgccatttgctccgctgtgcccgtccattgggtgcctacatctcgaaccacttggagcatccacgcccatcaccagtggatgacaaccgaggacatgcttacggtttggaatcgcgtgtggatagaagataacccatggatggaggacagaacacccgtcaccacttgggaggatgtgccttacctgggaaagcgggaagaccaatggtgtggtagtctcatcggcttaacctccagggcaacatgggctcagaatattccgactgccatccagcaggtacgcagcctgattgggaacgaggaattcttggattacatgccatctatgaagagatttcggaaagaggaggaatcagagggagcgatctggtga

SEQ ID NO: 15376 - RNA, 9873 nt, synthetic construct
  misc_feature 1..9873: note = derived and/or modified CDS sequence (opt3) from DENV-3__KJ189297__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagagatatggcccacaccctgattatgatcggcagtaatgcaagcgacaggatgggtatgggggttacatatcttgccttgattgctacctttaagatacagcccttcctggcgttaggatttttcctccgcaaactgacttctcgagaaaaccttctgctaggcgtgggcctcgccatggcaacaaccctgcagttgccggaggatatcgaacaaatggctaatgggattgccctgggattaatggccctcaagctgatcacacagtttgagacttaccagctttggaccgctctgatttccttgacgtgttcaaacacaatcttcaccctcactgtcgcatggcggaccgccacactgatactagcgggtgtgagtctgcttcctgtttgccagagctcgtccatgcgtaaaactgactggctcccaatggctgtggccgcaatgggcgtcccccctctgcccttgtttatcttctctctgaaggataccttaaagagaaggagctggccactcaatgagggggtaatggccgtgggactggtttcaattcttgctagttccctgttgcgcaacgacgtgcctatggcaggccccctcgtcgccggtgggctgctaatcgcgtgttatgtgattacgggaacatctgctgatctgaccgtagaaaaagccgcagacatcacttgggaggaagaggccgaacaaacaggcgtgagccataaccttatgataaccgtcgacgatgacggcactatgcggattaaggatgacgagacagagaatatcctcaccgttctgttgaaaacggctttactgatcgtgtccgggatttttccatactcaataccggccactctcctggtgtggcacacctggcagaagcagacacagagaagcggagtcctttgggatgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataacggaaagcgcctagaacccaattgggcctctgtcaaaaaggacctgatctcctacggcggcgggtggcggctcagcacacagtggcagaaaggagaggaagtgcaagtaattgcggtcgagcctggtaagaacccaaaaaatttccagactatgcccggcaccttccagacaaccactggggaaatcggagccatagcactggattttaagcctggcacctcgggttcaccgatcattaacagagaggggaaggtggttggactttatggcaatggcgtggtcacaaaaaacgggggatacgtgtctggtatcgctcagacgaatgccgagccagacggccccactcctgaattagaggaagagatgttcaagaaaaggaacctgaccattatggatctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggacttgatgtgccacgccacatttaccatgagactactgagccccgtaagggtgccaaattataacctcattatcatggatgaggctcatttcaccgaccctgcctctatagcagcccgggggtacattagcactcgagttggaatgggcgaagctgcggccatctttatgacagcaacccccccaggcacagctgatgccttccctcagtccaatgcacccattcaggacgaggagagagacatcccagaacgctcatggaacagtgggaatgagtggataactgattttgccggaaagacggtctggttcgtgccgagcattaaagctggtaacgacatcgccaactgtttaaggaagaatggcaaaaaggtgatccagctgtctcgtaagacctttgatacagaataccaaaaaactaagcttaacgactgggatttcgtcgtaaccacagacatttccgagatgggggcgaattttaaagcagatcgggtgatcgaccctagaaggtgcctgaagcccgttattctcaccgatggaccagagcgcgtgatattggccggccccatgcctgtcactgctgcctcagctgcacagcgaagaggtcgggtggggaggaacccacagaaagaaaatgaccagtatatcttcacgggccaacccctgaacaatgatgaggaccacgcccactggaccgaagctaagatgctcctggacaacattaatacacctgagggaatcatcccggcccttttcgaaccagagcgcgagaagagtgcagcgattgatggcgaataccgtctaaaaggggagagcagaaagacttttgttgaactgatgcggaggggagacttgcccgtgtggttagcccataaagtcgcttccgagggtataaagtataccgatcgcaaatggtgcttcgacggccagcgaaacaatcagatcctggaagagaacatggatgtggagatttggacaaaggaaggggagaaaaagaagctcagacctcggtggctggacgccaggacctactctgatccccttgcactgaaagaatttaaggacttcgctgccggacgcaaatcgatcgcactcgatttggtaactgagattggcagagtgccaagccacctggcccataggacacggaatgctctagacaacctggttatgctccacacgtcagaacacggtgggcgtgcgtatcgccatgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacagtggatagcctccgcaattgtgctagagttctttatgatggtcctgctcatcccagagcctgaaaagcaacgaaccccgcaggataatcagcttgcttacgttgtgattggaatcctgacattggccgcgataatcgctgccaacgagatgggcctgctcgaaactacgaagagagacctgggtatgtcaaaagagcccggggtagtgtctccaaccagctatcttgatgtcgacctccaccctgcaagtgcctggacactgtacgctgtggcaactaccgttattacacccatgttgaggcataccatcgaaaattccactgccaacgtgagcctggcggctattgccaaccaagcagtcgtattaatgggcctagacaagggatggccaatctctaaaatggatctgggcgtgcctctccttgccctggggtgctactcacaggttaatcccttgacgctgacagctgccgtgctcctgcttataacccactatgcaattatcggaccgggcttacaggctaaggccactcgggaggcgcagaaacgcaccgccgcaggtatcatgaagaacccaacagtcgacgggattatgactatcgatctggaccctgtgatatacgattccaagttcgagaaacaactcggacaggtcatgttgctggtgctatgtgctgttcagctgctccttatgagaaccagttgggccctgtgcgaagcattgacactggctacgggccccattaccactctctgggagggtagcccaggcaagttttggaatacaaccatcgccgtgtcgatggccaacattttcagggggtcttatctggcgggagctggcttagcattttccatcatgaaaagcgtagggactggaaagcggggcacaggttcacagggggaaacccttggagagaaatggaagaagaaactgaatcaactcagtcgaaaggaattcgacctatacaaaaagtctggcataacggaggtggatagaaccgaggccaaagaaggtctgaagcgcggcgagatcacacatcacgctgtctccagggggagcgccaaattgcagtggtttgttgaacggaacatggtgattcccgagggacgtgtcatcgacctgggctgtgggagaggaggctggtcatattactgcgcaggtctcaagaaggtgactgaagtaagggggtataccaaaggaggccctggccacgaggagccggtgcccatgagtacatacgggtggaatattgttaagcttatgagcggaaaagatgtgttctacctgccacctgaaaagtgtgacactttgctgtgcgatatcggtgagtcctctcccagccctaccgtcgaagagtcccgcacaattcgggtgctcaaaatggtcgagccatggttaaagaacaatcagttctgtatcaaggtgctgaacccctatatgcctaccgttatagaacatcttgagcgactgcagagaaaacacggcgggatgctagtaaggaatccactctcacgcaactctactcatgaaatgtactggattagtaatggaacgggcaacatcgtggcctcggtcaatatggtgagccggctgttgctgaacagatttacaatgacccaccgtaggcccactatcgagaaggacgttgatctcggtgctgggacccggcacgtgaacgcggaaccggagacacctaatatggacgtcattggagagcgcataaaacgaatcaaggaagagcataactccacgtggcactatgacgatgaaaatccatacaaaacctgggcctatcatggctcttacgaggtgaaggcaactggctcagctagctccatgattaacggggtagtgaagcttctgacaaaaccctgggacgttgtccctatggtgacccaaatggccatgactgatacaaccccattcggacagcagagagtgtttaaggaaaaagtcgacacaaggactccccggagtatgccgggtacccgcagagttatgggcatcacggcagagtggttatggaggaccctggggcgaaataagaaacctcggttgtgcacacgtgaggaattcactaagaaggtgagaaccaacgccgctatgggagccgtatttacagaggaaaatcaatgggattctgcgaaagcagccgtggaggacgaagatttctggaagctcgtcgaccgcgagagggagctgcacaaactaggcaagtgtggtagctgcgtgtataacatgatggggaaacgggaaaagaaacttggagagtttggcaaggctaagggctcaagagccatttggtacatgtggctgggggcacgctacctcgaattcgaggctctgggatttttgaatgaggatcattggttctccagggaaaacagttatagcggtgttgagggcgaagggctgcacaaactcggatacatccttcgagacatatctcagatccccggcggtgccatgtatgctgatgacactgccgggtgggacacccggattacggaggatgacctgcacaatgaagagaagatcacacagcagatggatccagagcatagacaattagcaaacgcgatttttaaactgacctaccagaataaggtggtcaaagtgcagaggcctactcccacaggaaccgtaatggacatcatatcccgcaaggatcagcgtggctcaggccaagttgggacttatggattgaacaccttcacaaatatggaagcccagctcattcggcagatggagggtgaaggcgtgctgagcaaggctgacctagagaacccacaccttcccgaaaaaaagatcacgcagtggctggagaccaaaggggtcgagagactcaagaggatggccatctcgggagatgactgcgtggtgaaacctattgatgaccgctttgcaaacgctctgttggccttaaatgatatgggcaaggtccgaaaggacataccacaatggcagccgtctaaaggttggcatgattggcagcaggttcccttctgtagtcaccacttccatgaactgatcatgaaggacgggcggaaactcgtggtaccttgcagaccacaagacgagcttattggaagggcacgcatctcccagggcgccggctggagcctgagagaaactgcgtgtctagggaaggcttacgcccagatgtggtcactgatgtattttcaccggagggatctccgtttggcatccaacgccatttgctctgctgtgcccgtccattgggtgcctacaagccgaaccacttggagtatccacgcccatcaccaatggatgacaaccgaggacatgctgacggtttggaatcgcgtgtggatagaagataacccatggatggaggacaaaacacccgtcaccacttgggaggatgtgccttaccttggaaagagagaagaccagtggtgtggttccctgatcggcctcaccagccgggcaacatgggctcagaatattccgactgccatccagcaagtaaggtctttaattgggaacgaggaattcctggattacatgccatcaatgaagcgctttagaaaagaggaggaaagtgagggagcgatctggtga

SEQ ID NO: 15377 - RNA, 9873 nt, synthetic construct
  misc_feature 1..9873: note = derived and/or modified CDS sequence (opt3) from DENV-3__KJ189298__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccaccctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgctccctgtaaaattcctttctccactgaggacggccatggtaaggcgcacaacgggcgtcttatcaccgcaaatccagttgtgacaaaaaaggaggaacccgtaaacatagaggccgaaccgcctttcggcgagtcaaatattgtcatcggaatcggcgataacgctttgaaaattaattggtataagaaggggagcagtatcggaaaaatgtttgaagccactgcacgcggtgccagaaggatggctattctgggcgacaccgcctgggatttcgggtctgtgggaggcgttctcaactccctgggtaagatggtgcatcaaatatttgggagcgcatacacggcgcttttctcgggcgtctcttgggtgatgaaaatcggaattggcgtactgttgacatggatcgggctcaattccaagaacacctcaatgagttttagctgcatcgctattggaataatcactctgtatttaggcgccgtggttcaggcagacatgggttgtgtcattaattggaaagggaaggagctgaagtgcggatccggcatcttcgtgacaaacgaggtgcacacctggactgaacagtacaaatttcaggccgattctcccaagcggctagctaccgccattgcaggtgcttgggagaatggcgtctgtgggatccgaagcacaacgcgcatggaaaacctcctgtggaaacaaatagccaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggcgaagatcgtcacagccgaaactcagaacagttccttcataattgatggccccaataccccagagtgccccagcgcttctagggcatggaacgtgtgggaagttgaggactatggttttggggtgttcacgacaaatatctggctgcggcttcgcgaagtctacacccaattgtgtgaccacagactcatgtcagccgctgtgaaagatgagagggccgttcatgcagacatgggatactggattgagagtcagaagaacggcagctggaaactggaaaaggcgtccctaatcgaggtgaaaacttgcacctggcctaagtctcacacactgtggtcgaatggtgtactcgaaagcgatatgataatcccaaagtccctggccggcccgatttcacagcataaccaccgtcccgggtatcacactcagaccgctggaccttggcatcttggcaaattggagctggactttaattactgcgaggggacaacggtcgtgatcaccgaaaactgtggaactcggggcccaagtttacgaacaaccactgtgtctggtaagctcattcacgagtggtgctgtagaagctgcacactgccccctcttaggtatatgggggaagatggatgttggtacggcatggagatccgcccaatatccgaaaaagaggagaatatggtcaagtcactggttagcgccggttctggcaaagtggacaacttcaccatgggggtattgtgcctcgcaattctgtttgaagaggtgatgcggggaaagttcggcaagaaacatatgatcgctggggtcttctttacgttcgtgctactgctctccggacaaatcacttggagaaatatggcccacaccctgattatgatcggcagtaacgcaagcgataggatgggtatgggggttacatatcttgccttgattgctacctttaagatacagcccttcctggcgttaggatttttcctccgcaaactgacttctcgagaaaatcttctgctaggcgtgggcctcgccatggcaacaaccctgcagttgccggaggacatcgaacaaatggctaacgggattgccctgggattaatggccctcaagctgatcacacagtttgagacttaccagctttggaccgctctgatttccttgacgtgttcaaatacaatcttcaccctcactgtcgcatggcggaccgccacactgatactagcgggtgtgagtctgcttcctgtttgccagagctcgtccatgcgtaaaactgattggctcccaatggctgtggccgcaatgggcgtcccccctctgcccttgtttatcttctctctgaaggacaccttaaagagaaggagctggccactcaacgagggggtaatggccgtgggactggtttcaattcttgctagttccctgttgcgcaacgatgtgcctatggcaggccccctcgtcgccggtgggctgctaatcgcgtgttatgtgattacgggaacatctgctgacctgaccgtagaaaaagccgcagatatcacttgggaggaagaggccgaacaaacaggcgtgagccataatcttatgataaccgtcgacgacgatggcactatgcggattaaggacgatgagacagagaacatcctcaccgttctgttgaaaacggctttactgatcgtgtccgggatttttccatactcaataccggccactctcctggtgtggcacacctggcagaagcagacacagagaagcggagtcctttgggacgtgcctagtcccccagaaacccaaaaagcagagctggaagagggtgtttacaggatcaagcagcagggcattttcgggaaaacacaggtaggagtgggcgtccaaaaggagggtgtgtttcacactatgtggcatgttacccgaggggctgtgttgacgtataatggaaagcgcctagaacccaactgggcctctgtcaaaaaggatctgatctcctacggcggcgggtggcggctcagcacacagtggcagaaaggagaggaagtgcaagtaattgcggtcgagcctggtaagaatccaaaaaacttccagactatgcccggcaccttccagacaaccactggggaaatcggagccatagcactggactttaagcctggcacctcgggttcaccgatcattaatagagaggggaaggtggttggactttatggcaacggcgtggtcacaaaaaatgggggatacgtgtctggtatcgctcagacgaacgccgagccagatggccccactcctgaattagaggaagagatgttcaagaaaaggaatctgaccattatggacctccacccagggagtggaaagacacgtaaatatttgcccgctatcgttcgcgaagcaataaagcggagactgaggaccctcattctggcccctactcgagtggtcgccgctgagatggaggaagcgcttaagggcctgccgatccggtaccaaacaaccgcaacgaaatccgagcatactggtcgcgaaatcgtggatttgatgtgccacgccacatttaccatgagactactgagccccgtaagggtgccaaactataatctcattatcatggacgaggctcatttcaccgatcctgcctctatagcagcccgggggtacattagcactcgagttggaatgggcgaagctgcggccatctttatgacagcaacccccccaggcacagctgacgccttccctcagtccaacgcacccattcaggatgaggagagagacatcccagaacgctcatggaatagtgggaacgagtggataactgactttgccggaaagacggtctggttcgtgccgagcattaaagctggtaacgatatcgccaattgtttaaggaagaacggcaaaaaggtgatccagctgtctcgtaagacctttgacacagaataccaaaaaactaagcttaatgattgggacttcgtcgtaaccacagatatttccgagatgggggcgaactttaaagcagaccgggtgatcgatcctagaaggtgcctgaagcccgttattctcaccgacggaccagagcgcgtgatattggccggccccatgcctgtcactgctgcctcagctgcacagcgaagaggtcgggtggggaggaatccacagaaagaaaacgatcagtatatcttcacgggccaacccctgaataacgacgaggatcacgcccactggaccgaagctaagatgctcctggacaatattaacacacctgagggaatcatcccggcccttttcgaaccagagcgcgagaagagtgcagcgattgacggcgaataccgtctaaaaggggagagcagaaagacttttgttgaactgatgcggaggggagatttgcccgtgtggttagcccataaagtcgcttccgagggtataaagtataccgaccgcaaatggtgcttcgatggccagcgaaataaccagatcctggaagagaatatggacgtggagatttggacaaaggaaggggagaaaaagaagctcagacctcggtggctggatgccaggacctactctgacccccttgcactgaaagaatttaaggatttcgctgccggacgcaaatcgatcgcactcgacttggtaactgagattggcagagtgccaagccacctggcccataggacacggaacgctctagataatctggttatgctccacacgtcagaacacggtgggcgtgcgtatcgccatgccgtcgaggagcttcctgaaaccatggagactctgttattgctgggcctcatgatcctgcttacaggaggcgcaatgctgtttctcatatccgggaagggaatcggtaaaaccagtattggcttgatctgtgtgattgcttctagcgggatgctgtggatggccgaaatccccttacagtggatagcctccgcaattgtgctagagttctttatgatggtcctgctcatcccagagcctgaaaagcaacgaaccccgcaggacaaccagcttgcttacgttgtgattggaatcctgacattggccgcgataatcgctgccaatgagatgggcctgctcgaaactacgaagagagatctgggtatgtcaaaagagcccggggtagtgtctccaaccagctatcttgacgtcgatctccaccctgcaagtgcctggacactgtacgctgtggcaactaccgttattacacccatgttgaggcataccatcgaaaactccactgccaacgtgagcctggcggctattgccaatcaagcagtcgtattaatgggcctagacaagggatggccaatctctaaaatggacctgggcgtgcctctccttgccctggggtgctactcacaggttaaccccttgacgctgacagctgccgtgctcctgcttataacccactatgcaattatcggaccgggcttacaggctaaggccactcgggaggcgcagaaacgcaccgccgcaggtatcatgaagaatccaacagtcgatgggattatgactatcgacctggatcctgtgatatacgactccaagttcgagaaacaactcggacaggtcatgttgctggtgctatgtgctgttcagctgctccttatgagaaccagttgggccctgtgcgaagcattgacactggctacgggccccattaccactctctgggagggtagcccaggcaagttttggaacacaaccatcgccgtgtcgatggccaatattttcagggggtcttatctggcgggagctggcttagcattttccatcatgaaaagcgtagggactggaaagcggggcacaggttcacagggggaaacccttggagagaaatggaagaagaaactgaaccaactcagtcgaaaggaattcgatctatacaaaaagtctggcataacggaggtggacagaaccgaggccaaagaaggtctgaagcgcggcgagatcacacatcacgctgtctccagggggagcgccaaattgcagtggtttgttgaacggaatatggtgattcccgagggacgtgtcatcgatctgggctgtgggagaggaggctggtcatattactgcgcaggtctcaagaaggtgactgaagtaagggggtataccaaaggaggccctggccacgaggagccggtgcccatgagtacatacgggtggaacattgttaagcttatgagcggaaaagacgtgttctacctgccacctgaaaagtgtgatactttgctgtgcgacatcggtgagtcctctcccagccctaccgtcgaagagtcccgcacaattcgggtgctcaaaatggtcgagccatggttaaagaataaccagttctgtatcaaggtgctgaatccctatatgcctaccgttatagaacatcttgagcgactgcagagaaaacacggcgggatgctagtaaggaacccactctcacgcaattctactcatgaaatgtactggattagtaacggaacgggcaatatcgtggcctcggtcaacatggtgagccggctgttgctgaacagatttacaatgacccaccgtaggcccactatcgagaaggatgttgacctcggtgctgggacccggcacgtgaatgcggaaccggagacacctaacatggatgtcattggagagcgcataaaacgaatcaaggaagagcataattccacgtggcactatgacgaagagaacccatacaaaacctgggcctatcatggctcttacgaagtgaaggcaactggctcagctagctccatgattaatggggtagtgaagcttctgacaaaaccctgggacgttgtccctatggtgacccaaatggccatgactgatacaaccccattcggacagcagagagtgtttaaggagaaagtcgacacaaggactccccggagtatgccgggtacccgcagagttatgggcatcacggcagagtggttatggaggaccctggggcgaaacaagaaacctcggttgtgcacacgtgaagagttcactaagaaggtgagaaccaatgccgctatgggagccgtatttacagaagagaaccaatgggattctgcgaaagcagccgtggaagacgaggatttctggaagctcgtcgaccgcgagagggaactgcacaaactaggcaagtgtggtagctgcgtgtataatatgatggggaaacgggagaagaaacttggagaatttggcaaggctaagggctcaagagccatttggtacatgtggctgggggcacgctacctcgagttcgaggctctgggatttttgaacgaagatcattggttctccagggagaatagttatagcggtgttgaaggcgaggggctgcacaaactcggatacatccttcgagacatatctaagatccccggcggtgccatgtatgctgatgacactgccgggtgggatacccggattacggaagacgacctgcacaacgaggagaaaatcacacagcagatggatccagaacatagacagttagcaaatgcgatttttaagctgacctaccaaaacaaagtggtcaaggtgcagaggcctactcccacaggaaccgtaatggacatcatatcccgcaaggatcagcgtggctcaggccaggttgggacttatggattgaataccttcacaaacatggaggcccaactcattcggcagatggaaggtgagggcgtgctgagcaaagctgacctagaaaacccacaccttcccgagaagaaaatcacgcagtggctggagaccaagggggtcgaaagactcaaaaggatggccatctcgggagatgactgcgtggtgaagcctattgatgaccgctttgcaaatgctctgttggccttaaacgatatgggcaaggtccgaaaagacataccacagtggcaaccgtctaagggttggcatgattggcagcaggttcccttctgtagtcaccacttccatgagctgatcatgaaagacgggcggaagctcgtggtaccttgcagaccacaggatgaacttattggaagggcacgcatctcccaaggcgccggctggagcctgagagagactgcgtgtctagggaaagcttacgcccagatgtggtcactgatgtattttcaccggagggacctccgtttggcatccaatgccatttgctctgctgtgcccgtccattgggtgcctacaagccgaaccacttggagtatccacgcccatcaccagtggatgacaaccgaagacatgctgacggtttggaaccgcgtgtggatagaggataatccatggatggaggacaagacacccgtcaccacttgggaagatgtgccttaccttggaaagagagaggaccaatggtgtggttccctgatcggcctcaccagccgggcaacatgggctcagaacattccgactgccatccagcaggtaaggtctttaattgggaatgaagagttcctggattacatgccatcaatgaaacgctttagaaaggaggaagagagtgaaggagcgatctggtga

SEQ ID NO: 15378 - RNA, 9873 nt, synthetic construct
  misc_feature 1..9873: note = derived and/or modified CDS sequence (opt3) from DENV-3__KJ189301__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcaccgccgagacaagcgtagcgtagcccttgcaccccatgtgggcatgggtctggataccagaacgcaaacttggatgtccgccgagggggcttggaggcaggtcgaaaaagtggagacctgggcattgcggcaccctggattcacaatcctcgccctgtttctggctcattacattggcacttctctcacccagaaggttgtgatcttcatattactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccactctcccagaatatggaacccttggcctggagtgctctccgcgaacaggtttggacttcaatgagatgattctactgaccatgaaaaacaaggcgtggatggtgcatagacagtggtttttcgatctccccctgccttggactagcggggccacaacggaaaccccaacttggaataggaaagagcttctggtaacatttaagaacgcacacgctaaaaagcaagaagttgtggtcttgggctcccaggagggagccatgcacaccgctctcacaggcgccactgaaatccagaattcagggggaaccagtatcttcgcaggtcatctgaagtgtcggttaaaaatggacaagctggagctaaaaggcatgagctacgccatgtgcacgaacacctttgtgctcaagaaagaggtctctgaaacacagcacgggactattctgataaaggtggagtacaagggagaagatgctccctgtaaaatccctttctccaccgaggacggccatggtaaggcgcacaacgggcgtcttattacagcaaatccagttgtgactaaaaaggaggaacccgtaaacatcgaggccgaaccgcctttcggcgagtcaaatatagtcattggaatcggcgataacgctttgaaaatcaattggtataagaaggggagcagtattggaaaaatgtttgaagccaccgcacgcggtgccagaaggatggctatcctgggcgacacggcctgggatttcgggtctgtgggaggcgttctcaactccctgggtaagatggtgcatcaaatttttgggagcgcatacacagcgcttttctcgggcgtctcttgggtgatgaaaataggaatcggcgtactgttgacctggattgggctcaattccaagaacacttcaatgagttttagctgcatcgctatcggaattataacactgtatttaggcgccgtggttcaggcagacatgggttgtgtcatcaattggaaagggaaggagctgaagtgcggatccggcattttcgtgaccaacgaggtgcacacttggaccgaacagtacaaatttcaggccgattctcccaagcggctagctacagccatcgcaggtgcttgggagaatggcgtctgtgggattcgaagcacgacccgcatggaaaacctcctgtggaaacaaatcgccaatgagcttaactatatattgtgggaaaataacgttaagctgactgtggtggtaggagacatcattggcgtcctcgagagagggaaaaggacactgaccccacagcctatggagttaaagtactcatggaaaacatggggaaaggcgaagatcgtgactgccgaaacccagaacagttccttcattatcgatggccccaatacgccagagtgccccagcgcttctcgggcatggaacgtttgggaagtggaggactatggttttggggtcttcacaaccaatatatggctgcgccttagagaagcctacactcagttgtgtgaccacaggctcatgtcagctgccgtgaaagatgagcgtgcagttcatgcggacatgggatactggattgagagtcaaaagaacggcagctggaaactggaaaaggcctccctaatcgaggtgaaaacctgcacatggcctaagtctcacactctgtggtcgaatggtgtactcgaaagcgatatgattatcccaaagtccctggctggcccgatatcacagcataaccaccggcccgggtatcacacccagacagccggaccttggcatcttggcaaattggagctggactttaattactgcgaggggacgaccgtcgtgatcactgaaaactgtggaacacgaggcccaagtttaagaaccactacagtgtctggtaagctcattcacgagtggtgctgtaggagctgcaccctgccccctcttcgctatatgggggaagatggatgttggtacggcatggagatccggccaatttccgaaaaagaggagaatatggtcaagtcactggttagcgcaggttctggcaaagtggacaacttcacgatgggggtattgtgcctcgctatcctgtttgaagaggtgatgagaggaaagttcggcaagaaacatatgatagccggggtcttctttactttcgtgctactgctctccggacagattacctggagggatatggcacacacactgatcatgatcggcagtaatgccagcgaccgcatgggtatgggggttacctatcttgctttgattgcgacttttaagatccaacccttcctggccttaggatttttcctccgaaaactgacatctcgggaaaaccttctgctaggcgtgggcctcgcaatggctaccacactgcagttgccggaggatattgaacagatggccaatgggatagccctgggattaatggctctcaagctgatcactcaatttgagacctaccagctttggacggcactgatttccttgacatgttcaaacaccatcttcactctcaccgtcgcctggcgtacagcgactctgattctagctggtgtgagtctgcttcctgtttgccagagctcgtccatgagaaaaaccgactggctcccaatggccgtggcagccatgggcgtcccccctctgcccttgtttatcttctctctgaaggatacgttaaagaggcgcagctggccactcaatgagggggtaatggctgtgggactggtttcaatacttgcaagttccctgttgcggaacgacgtgcctatggccggccccctcgtcgcgggtgggctgctaatcgcttgttatgtgattacaggaacctctgccgatctgactgtagaaaaagcagccgacatcacatgggaggaagaggctgaacagaccggcgtgagccataaccttatgattactgtcgacgatgacggcacaatgagaatcaaggatgacgagaccgagaatatactcacggttctgttgaaaactgccttactgattgtgtccgggatctttccatactcaatcccggcaaccctcctggtgtggcacacatggcaaaagcagacccagaggagcggagtcctttgggatgtgcctagtcccccagaaacacagaaagctgagctggaagagggtgtttaccgaattaagcaacagggcatattcgggaaaactcaggtaggagtgggcgtccagaaggagggtgtgtttcacaccatgtggcatgttacgcgcggggccgtgttgacatataacggaaagcggctagaacccaattgggcgtctgtcaaaaaggacctgatctcctacggcggcgggtggagactcagcactcaatggcagaaaggagaggaagtgcaggtaattgccgtcgagcctggtaagaacccaaaaaatttccaaaccatgcccggcacattccagaccactaccggggaaatcggagcaattgctctggattttaagcctggcacatcgggttcaccgatcataaacagggaggggaaggtggttggactttatggcaatggcgtggtcacgaaaaacgggggatacgtgtctggtatcgcccagactaatgctgagccagacggccccacccctgaattagaggaagagatgttcaagaaacgtaacctgacaattatggatctccacccagggagtggaaagacccgcaaatatttgcccgcaatcgttcgggaagccattaagagaaggctgcgaactctcatcctggcccctacacgggtggtcgctgcggagatggaggaagcacttaagggcctgccgatacgctaccagaccacggccactaaatccgagcatacaggtagagaaattgtggacttgatgtgccacgctacctttaccatgaggctactgagccccgtacgggtgccaaattataacctcatcatcatggatgaggcccatttcactgaccctgcatctattgccgctcgagggtacatcagcacaagagttggaatgggcgaagcggccgcaatatttatgaccgctacacccccaggcactgccgatgcattccctcaatccaatgcccccattcaggacgaggagcgcgacatcccagaaaggtcatggaacagtgggaatgagtggattacggattttgctggaaagaccgtctggttcgtgccgagcatcaaagccggtaacgacatagcgaactgtttacgtaagaatggcaaaaaggtgattcagctgtctcggaagacatttgatactgaataccagaaaaccaagcttaacgactgggatttcgtcgtaacaaccgacatctccgagatgggggcaaattttaaagccgatagagtgatcgaccctaggcgctgcctgaagcccgttattctcactgatggaccagagcgagtgatcttggctggccccatgcctgtcacggccgcttcagcagcccaaagacggggtagggtggggcgcaacccacagaaagaaaatgaccagtatattttcaccggccagcccctgaacaatgatgaggaccacgctcactggacagaagccaagatgctcctggacaacataaatactcctgagggaatcattccggcacttttcgaaccagagcgtgagaagagtgcggccatcgatggcgaatacagactaaaaggggagagccggaagacctttgttgaactgatgaggcgcggagacttgcccgtgtggttagctcataaagtcgcctccgagggtatcaagtatacagatcgaaaatggtgcttcgacggccaaagaaacaatcagattctggaagagaacatggatgtggagatatggaccaaggaaggggagaaaaagaagctccggcctaggtggctggacgcacgcacttactctgatccccttgctctgaaagaatttaaggacttcgccgcaggaagaaaatcgatcgccctcgatttggtaacagagattggcagggtgccaagccacctggctcatcggacgcgtaatgcgctagacaacctggttatgctccacacctcagaacacggtgggcgcgcctatcgacatgcagtcgaggagcttcctgaaactatggagacactgttattgctgggcctcatgatcctgcttaccggaggcgctatgctgtttctcatttccgggaagggaatcggtaaaaccagtataggcttgatctgtgtgattgcctctagcgggatgctgtggatggccgaaatccccttacagtggattgcatccgctatcgtgctagagttctttatgatggtcctgctcgttccagagcctgaaaagcagagaacaccgcaagataatcagcttgcctacgtggtaataggaattctgactttggcggctatcattgccgcaaacgagatgggcctgctcgaaacgaccaagagggacctgggtatgtcaaaagagcccggggtggtctctccaacaagctatcttgatgtggacctccaccctgccagtgcttggactctgtacgcagttgccaccacagtgatcacccccatgttgcggcatactatagaaaattccacggcgaacgtcagcctggctgccatcgcaaaccaggccgtagtgttaatgggcctagacaagggatggccaatttctaaaatggatctgggcgttcctctccttgctctggggtgctactcacaagtgaatcccttgacactgaccgccgcagtcctcctgcttatcactcactatgctattatcggaccgggcttacaggccaaggcgacccgcgaggcccagaaaagaacagcagctggtataatgaagaacccaactgtggacgggattatgaccatcgatctggaccctgtcatctacgattccaagttcgagaaacagctcggacaagtgatgttgctggttctatgtgccgtgcagctgctccttatgaggacaagttgggcactgtgcgaagctttgacgctggccaccggccccattactacactctgggagggtagcccaggcaagttttggaataccactatcgccgtatcgatggcgaacatattccgggggtcttatctggctggagcaggcttagccttttccattatgaaaagcgtggggacaggaaagcgaggcaccggttcacagggggaaacgcttggagagaaatggaagaagaaactgaatcagctcagtagaaaggaattcgacctatacaaaaagtctggcatcaccgaggtcgatcgcacagaggctaaagaaggtctgaagaggggcgagattactcatcacgccgtttcccgggggagcgcaaaattgcaatggtttgtggaacgtaacatggtcatccccgagggaagagtgatagacctgggctgtgggaggggaggctggtcatattactgcgccggtctcaagaaggtaaccgaagtgcgcgggtatacaaaaggaggccctggccacgaggagccggttcccatgagtacttacgggtggaatatcgtgaagcttatgagcggaaaagatgtcttctacctgccacctgaaaagtgtgacaccttgctgtgcgatattggtgagtcctctcccagccctacagtggaagagtcccggaccatccgagtcctcaaaatggtggagccatggttaaagaacaatcagttctgtattaaggttctgaacccctatatgcctactgtaatcgaacatcttgagagactgcagaggaaacacggcgggatgctagtgcgcaatccactctcacggaactctacgcatgaaatgtactggattagtaatggaacaggcaacatcgtcgcttcggtgaatatggttagcagactgttgctgaaccgttttaccatgactcacaggcggcccaccatagagaaggacgtggatctcggtgcggggacacgccacgtcaacgccgaaccggagacgcctaatatggacgtgattggagagcgaatcaaaagaatcaaggaagagcataactccacctggcactatgacgatgaaaatccatacaaaacttgggcatatcatggctcttacgaggtaaaggctacaggctcagccagctccatgattaacggggtggttaagcttctgaccaaaccctgggacgtcgtgcctatggtgactcagatggcaatgacagataccacaccattcggacaacagagggtctttaaggaaaaagttgacactcggaccccccgcagtatgccgggtacgagaagggtgatgggcataaccgccgagtggttatggcgaacactggggcggaataagaaacctcgtttgtgcactagagaggaattcaccaagaaggtacgcacaaacgctgccatgggagcggtgtttactgaggaaaatcagtgggattctgcaaaagccgctgtcgaggacgaagatttctggaagctcgtggacagggagcgggagctgcacaaactaggcaagtgtggtagctgcgtttataacatgatggggaaaagagaaaagaaacttggagagtttggcaaggccaagggctcacgcgcaatctggtacatgtggctgggggctaggtacctcgaattcgaggccctgggatttttgaatgaggatcattggttctcccgagaaaacagttatagcggtgtggagggcgaagggctgcacaaactcggatacattcttcgggacatctctaagattcccggcggtgctatgtatgccgatgacaccgcagggtgggacacgagaatcacagaggatgacctgcacaatgaagagaaaataacccaacagatggatccagagcataggcagttagcgaacgccatctttaagctgacttaccagaataaagtcgtgaaggtacaacgccctacacccaccggaactgttatggacattatctcccgtaaggatcagcggggctcaggccaggtggggacctatggattgaacacattcacgaatatggaagctcagctcattagacaaatggagggtgaaggcgtcctgagcaaagccgacctagagaacccacaccttcccgaaaagaaaatcacccagtggctggagactaagggggtggagaggctcaaacgcatggcaatatcgggagatgactgcgtggtcaagcctattgatgaccgatttgctaacgccctgttggcattaaatgatatgggcaaggttcggaaagacatcccacagtggcagccgtctaagggttggcatgattggcaacaggtgcccttctgtagtcaccacttccatgaactgatcatgaaagacgggagaaagctcgtagtgccttgcaggccacaggacgagcttattggacgcgccagaatatcccagggcgcgggctggagcctgcgggaaacagcttgtctagggaaagcctacgcacaaatgtggtcactgatgtattttcacaggcgtgatctccgattggcctccaacgctatctgctctgccgtccccgtgcattgggttcctaccagccgcactacatggagtattcacgcacatcaccagtggatgaccacggaggacatgctgacagtgtggaatagagtctggatcgaagataacccatggatggaggacaagacccccgtgactacctgggaggatgtaccttaccttggaaagcgggaagaccagtggtgtggttccctgattggcctcacaagcagggctacttgggcccaaaatatcccgaccgcgatacagcaggttcgctctttaatcgggaacgaggaattcctggattacatgccatcaatgaaaagatttcggaaggaggaggaaagtgagggagctatttggtga

SEQ ID NO: 15379 - RNA, 9873 nt, synthetic construct
  misc_feature 1..9873: note = derived and/or modified CDS sequence (opt3) from DENV-3__KF955456__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcgtcttactgatgcttgtgactccatcgatgaccatgcgctgtgtaggcgttgggaacagagactttgtggaaggattgtcaggtgcgacatgggtcgatgtggtgctggagcacggcgggtgcgtcaccacgatggcaaagaataaacccactctagacatcgagctccagaagacagaagccacccaactggctactcttaggaaactgtgtattgagggaaagatcacaaacattaccacggatagccggtgccctacccagggcgaagccgttttgccagaggaacaggaccagaattatgtgtgtaaacacacatacgtagatcgcggttgggggaacggatgcggcctcttcggcaaggggagtctggtgacttgcgcaaagtttcaatgtttagagcccatcgagggaaaagtcgtgcagtatgaaaatctgaagtacaccgttataattacagtgcatactggtgaccagcaccaggtcggcaacgagacccaaggggtgacagctgaaatcacccctcaggcctccactacggaggcgattctcccagaatatggaacacttggcctggagtgctctccgcgaaccggtttggacttcaatgagatgatcctactgactatgaaaaacaaggcctggatggtacatagacagtggtttttcgatctccccctgccttggaccagcggggcaacaaccgaaactccaacatggaataggaaagagcttctggttacgtttaagaacgctcacgccaaaaagcaagaagtggtcgtgttgggctcccaggagggagctatgcacaccgccctcactggcgcaacagaaatccagaattcagggggaaccagtattttcgccggtcatctgaagtgtcggttaaaaatggacaagctggagctaaaaggcatgagctacgctatgtgcacaaacacttttgtcctcaagaaagaggtgtctgaaacccagcacgggacgatactgatcaaggttgagtacaagggagaagatgcgccctgtaaaattcctttctccaccgaggacggccaaggtaaggcacataacgggcgtcttatcacagccaatccagtggtaactaaaaaggaggaacccgtcaacatagaggctgaaccgcctttcggcgagtcaaatattgtgatcggaatcggcgataacgccttgaaaattaattggtataagaaggggagcagtatcggaaaaatgtttgaagcaaccgcccgcggtgctagaaggatggccattctgggcgacacagcatgggatttcgggtctgttggaggcgtgctcaactccctgggtaagatggtccaccagatatttgggagcgcgtacactgctcttttctcgggcgtgtcttgggtaatgaaaatcggaattggcgtgctgttgacctggatcgggctcaattccaagaacacgtcaatgagttttagctgcatcgccattggaataatcacactgtatttaggcgcagttgtccaggccgacaccggttgtgtgattaattggaaagggaaggagctgaagtgcggatccggcatcttcgtgactaacgaggtccatacatggaccgaacagtacaaatttcaagctgattctcccaagcggctagccactgcaattgctggtgcctgggagaatggcgtttgtgggatccgaagcaccacacgcatggaaaacctcctgtggaaacaggtggcgaatgagcttaactatatattgtgggaaaataacatcaagctgacggtggtagtcggagacattatcggcgtgctcgagcaggggaaaagaaccctgactccacagcctatggagttaaagtactcatggaaaacatggggaaaggccaagattgttaccgctgaaacacaaaacagttccttcatcatagatggccccaatactccagagtgccccagcgcatctagggcctggaacgtgtgggaagtcgaggactatggttttggggtgttcaccacgaatatttggctgaaacttcgggaagtttacacacagttgtgtgaccaccgcctcatgtcagctgccgtgaaggatgagagagcagtacacgcggacatgggatactggatcgagagtcagaaaaacggcagctggaagctggaaaaagcctccctaattgaggtcaagacctgcacttggcctaagtctcataccctgtggtcgaatggtgtgctcgaaagcgatatgatcataccaaaatccctggctggcccgatctcacagcacaactataggcccgggtaccatacacaaactgccggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagattaggccaatctccgaaaaggaggagaatatggtgaaatcactggtaagcgcaggttctggcaaggtggacaacttcacaatgggggtcttgtgcctcgctatactgtttgaagaggtgatgcgcggaaagttcggcaaaaagcatatgattgccggggttttctttaccttcgtgctactgctctccggacagatcacgtggcgggatatggcacacactctggtcatgatcggcagtaatgccagcgacagaatgggtatgggggtgacctaccttgctttgattgcgacatttaaaatccagcccttcctggccttaggatttttcctcaggaagctgacctctcgcgaaaaccttctgctaggcgttggcctcgcaatggctactacactgcaattgccggaggatattgaacagatggccaatgggatagccctgggattaatggctctcaaactgatcacccagtttgagacatatcagctttggactgcactgatttccttgacctgttcaaacacgatcttcacactcaccgtggcctggcgaactgcgaccctgattctagctggtgtcagtctgcttcctgtatgccaaagctcgtccatgcggaagtctgactggctcccaatgacagtggccgcaatgggcgttccccctctgcccttgtttatcttcagcctgaaggatactttaaaacgtagatcatggccactcaatgagggggtgatggccgtcggactggtgagtatacttgcttcctctctgttgaggaacgacgtacctatggcaggccccctcgtggccggtgggctgctaatcgcgtgttacgtcattaccggaacgagcgctgatctgacagttgaaaaggccgcagacgtgacctgggaggaagaggccgaacagactggcgtgtcccataaccttatgatcacagtcgacgatgacggcaccatgcgcattaaagatgacgagactgagaatatcctcacagtgctgttgaagaccgctttactgatagtttcagggatttttccatacagcatcccggccacgctcctggtatggcacacttggcagaaacagacccggagaagtggagtgctttgggatgtcccttctcccccagaaacacaaaaggcagagctggaagagggtgtgtataggatcaaacagcagggcattttcgggaagacccaggttggagtgggcgtccaaaaggagggtgtgtttcatacaatgtggcacgtaactcgaggggctgtcttgacctacaacggaaaacgcctagaacccaattgggcctccgtgaagaaagacctgataagctatggcggcgggtggcggctctcggcgcagtggcagaagggagaggaagttcaagtgatcgccgtcgagcctggtaaaaacccaaagaatttccagacgatgcccggcacattccagactaccacaggggaaattggagcaatcgctctggattttaagcctggcacctcaggttctccgattatcaacagagaggggaaagtggttggactttacggcaatggcgtggtcactaagaacgggggatatgtgagtggtatagcccagaccaatgctgagccagacggccccacacctgaattagaggaagagatgttcaaaaagaggaacctgacgatcatggatctccacccagggtccggaaaaactcgtaagtacttgcccgcaattgtacgcgaagccatcaagcggagactgaggaccctcattctggcccctacacgagtggttgctgcggagatggaggaagcacttaaaggcctgccgatccggtatcaaaccactgccacaaagagcgagcataccggtcgcgaaatagtcgacttgatgtgccacgctacgtttactatgagactactgtctcccgtgagggtgccaaattacaacctcattatcatggatgaggcccatttcacagaccctgcaagcatcgccgctcgggggtacatttccacccgagtcggaatgggcgaagcggccgcaatctttatgaccgctactcccccaggcacagccgatgcattccctcagtcaaatgcccccatacaggacgaggagagagacattccagaacgcagttggaacagcgggaatgagtggatcaccgattttgctggaaaaacagtatggttcgtgccgtctattaaggccggtaacgacatcgcgaactgtttaaggaaaaatggcaagaaggttatacagctgtcccgtaaaacttttgatacggaatatcaaaagaccaaacttaacgactgggatttcgtggtcacaactgacatttcagagatgggggcaaattttaaggccgatcgggtgatcgaccctagaaggtgcctgaaacccgttatcctcaccgatggaccagagcgcgtgattttggctggccccatgcctgtcacagccgctagtgcagcccagcgaagaggtcgggtggggaggaacccacagaaggaaaatgaccagtacatcttcaccggccaacccctgaacaatgatgaggaccacgctcattggactgaagccaagatgctcctggacaacattaatacgcctgagggaataatcccggcacttttcgaaccagagcgcgagaaaagcgcggccattgatggcgaatatcgtctaaagggggagtccagaaaaacctttgtagaactgatgcggaggggagacttgcccgtgtggttagctcacaaggttgcctctgagggtatcaaatacacagatcgcaagtggtgcttcgacggccagcgaaacaatcagatcctggaagagaacatggatgtcgagatttggactaaagaaggggagaagaagaaactcagacctcggtggctggacgcaaggacctattcggatccccttgctctgaaggaatttaaagacttcgccgcaggacgcaagagcatagccctcgatttggtgacagagatcggcagagtgccatcacacctggctcataggacccggaatgcgctagacaacctggtcatgctccacacttccgaacatggtgggaaagcctaccgtcacgcagttgaggagcttcctgaaacaatggagacgctgttattgctgggcctcatgattctgcttaccggaggcgctatgctgtttctcatcagtgggaagggaattggtaagacttctatcggcttgatatgtgtgatcgccagctccgggatgctgtggatggccgaaattcccttacagtggatcgcatcagctattgtactagagttctttatgatggtgctgctcatcccagagcctgaaaaacaacgcacaccgcaggataatcagcttgcctatgtcgtgataggaattctgaccttggcggctatcattgccgcaaacgagatgggcctgctcgaaaccacaaagcgagacctgggtatgtctaaagagcccggggttgtgagcccaactagttaccttgatgtcgacctccaccctgcctccgcttggacgctgtacgcagtagccaccacagtgatcactcccatgttgagacataccatagaaaatagcacagcgaacgtttctctggctgccatcgcaaaccaagccgtggtcttaatgggcctagacaagggatggccaatttcaaaaatggatctgggcgtgcctctccttgctctggggtgctattcccaggtcaatcccttgaccctgactgccgcagtgctcctgcttatcacgcactacgctattatcggaccgggcttacaggccaaggcgacaagggaggcccagaagcggaccgcagctggtataatgaaaaacccaactgttgacgggattatgaccatcgatctggaccctgtgatctatgatagtaagttcgagaaacaactcggacaggtaatgttgctggtgctatgtgccattcagctgctccttatgcgcacaagctgggcactgtgcgaagctttgactctggccaccggccccatcacaacgctctgggagggttcgccaggcaagttttggaataccactatagccgtctctatggcgaacattttcagagggtcctacctggctggagcaggcttagcctttagcatcatgaaatcagttgggacaggaaagaggggcaccggtagtcagggggaaactcttggagagaagtggaaaaagaaactgaatcaactctctcggaaggaattcgacctatataaaaagtccggcattacagaggtggatcgaaccgaggctaaagaaggtctgaagagaggcgagatcacgcatcacgccgtcagccgcgggtcagcaaagttgcagtggtttgtggaaaggaacatggtaatacccgagggacgggtgatcgacctgggctgtgggcgtggaggctggagttactattgcgccggtctcaaaaaggttaccgaagtgagagggtacacaaaaggaggccctggccatgaggagccggtccccatgagcacttacgggtggaatattgtgaagcttatgtccggaaaagatgtcttctatctgccacctgaaaagtgtgacaccttgctgtgcgatatcggtgagtctagcccctcccctacagtggaagagtcaaggactattcgcgttctcaagatggtagagccatggttaaaaaacaatcagttctgtatcaaggtgctgaacccctacatgcctaccgtcattgaacaccttgagcggctgcagcgaaaatatggcgggatgctagtgagaaatccactctctaggaacagtacacacgaaatgtactggatctcgaatggaaccggcaacatagttgctagcgtgaatatggtctcccgcctgttgctgaaccggtttactatgacgcatagacgtcccacaattgagaaggacgtggatctcggtgcggggaccaggcacgtaaacgccgaaccggagactcctaatatggacgtgatcggagagcggatcaaacgcattaaggaagagcataactctacctggcactatgacgatgaaaatccatacaagacatgggcatatcacggctcatacgaggttaaagctacgggcagcgcctccagtatgataaacggggtcgtgaagcttctgaccaaaccctgggacgtggtccctatggttactcaaatggcaatgacagataccactccattcggacagcagcgagtgtttaaggaaaaagtagacacaagaacccccaggtctatgccgggtacacggcgcgtgatgggcatcactgccgagtggttatggagaaccctggggaggaataagaagcctcgattgtgcacgcgggaggaattcaccaaaaaggtccgtacaaacgctgccatgggagcggtgtttactgaggaaaatcaatgggatagcgcaaaagccgctgttgaggacgaagatttctggaagctcgtggacagagagcgcgagctgcataaactaggcaagtgtggttcatgcgtctacaacatgatggggaaaagggaaaagaagcttggagagtttggcaaagccaagggctcccgggcaatttggtatatgtggctgggggctagatacctcgaattcgaggccctgggatttttgaatgaggatcactggttcagtcgcgaaaacagctattctggtgtggagggcgaagggctgcataaactcggatacatccttagggacatttccaagatccccggcggtgctatgtatgccgatgacaccgcagggtgggacacacgaataactgaggatgacctgcacaatgaagagaaaatcacccagcagatggatccagagcatcggcagttagcgaacgccatttttaagctgacgtaccaaaataaggtagttaaagtgcagagacctacacccaccggaactgtcatggacatcatttcaaggaaggatcagcgcggcagcggccaggtggggacatatggattgaacaccttcactaatatggaagctcaactcatccgtcagatggagggtgaaggcgtgctgaccaaagccgacctagagaacccacacctttcggaaaagaaaataacacagtggctggagacgaagggggtcgagcggctcaagagaatggcaatttctggagatgactgcgttgtgaaacccatcgatgacaggtttgctaacgccctgttggcattaaatgatatgggcaaggtacgcaaagacatccctcagtggcaaccaagtaagggttggcacgattggcagcaggtgccgttctgttcccatcacttccatgaactgattatgaaagacgggcgaaagctcgtcgtgccctgccggcctcaggacgagcttataggaagagccaggatcagccaaggcgcgggctggtcactgcgcgaaaccgcttgtctagggaaggcctacgcacagatgtggtccctgatgtactttcacagacgggatctcaggttggcctctaacgctatttgcagcgccgttccagtgcactgggtccccactagtcgtacaacctggtccatccatgcacaccatcagtggatgactacagaggacatgctgaccgtgtggaatcgagtatggattgaagataacccttggatggaggacaaaacgccagttacaacctgggagaatgtgccctatcttggaaagcgcgaagatcaatggtgtggtagcctgatcggcctcacttctagagctacctgggcccagaacatacctacagcgatccagcaggtccggtcattaattgggaatgaggaattcctggactacatgccgagtatgaaaaggtttcgcaaggaggaggaatccgagggagctatctggtga

SEQ ID NO: 15380 - RNA, 9873 nt, synthetic construct
  misc_feature 1..9873: note = derived and/or modified CDS sequence (opt3) from DENV-3__KF955465__SS-prME
  source 1..9873: mol_type = other RNA
accagcctgtgcatcatgatgattctccccgccgctcttgcattccacctgacatccagagacggcgagcctaggatgatagtggggaagaacgaacggggaaaatctttgttatttaagactgcctcaggtatcaatatgtgtacgctgattgcgatggatctaggcgagatgtgcgacgataccgtcacatacaaatgtccacatatcactgaagttgagccggaagacattgattgctggtgtaacctcaccagtacatgggtgacctatgggacttgcaatcaggctggagagcaccgccgagacaagcgtagcgtagccctggcaccccatgtgggcatgggtcttgatacaagaacccaaacgtggatgtccgccgagggggcttggaggcaggtcgaaaaagtggagacttgggcactgcggcaccctggattcaccatcttggccctctttctggctcattacataggcacatctctgactcagaaggttgtgatcttcattctcttaatgctggtcaccccatcgatgacaatgcgctgtgtgggcgtagggaacagagactttgttgaaggactttcaggtgccacctgggtggatgtcgtgttggagcacggcgggtgcgtgacgactatggcgaagaataaacccacactggacatcgagctacagaagaccgaagcaactcaactcgccacactgaggaaactttgtattgagggaaagatcaccaacataacgaccgatagccggtgccctacacagggcgaagctgtcctgccagaggaacaggaccagaattatgtttgtaaacacacttacgtggatcgcggttgggggaacggatgcggcttgttcggcaaggggagtctcgtaacctgcgccaagtttcaatgtctggagcccattgagggaaaagtggtccagtatgaaaatttaaagtacacagtgatcattactgttcataccggtgaccagcaccaggtgggcaacgagacacaaggggtcaccgcagaaatcactcctcaggcttccacgacagaggccatcctgccagaatatggaaccctcggccttgagtgctctccgcgaactggtctggacttcaatgagatggtgttgctaaccatgaaaaacaaggcgtggatggtacatagacagtggtttttcgatctgcccctcccttggacaagcggggccaccactgaaacaccaacgtggaataggaaagagctgcttgttacctttaagaacgcacacgctaaaaagcaagaagtggtcgtgctgggctcccaggagggagccatgcacactgctttgacaggcgccaccgaaattcagaattcagggggaacaagtatattcgcaggtcatctcaagtgtcggctgaaaatggacaagttagagctgaaaggcatgagctacgccatgtgcactaacacctttgtcctaaagaaagaggtgtctgaaacgcagcacgggaccatcctcattaaggttgagtacaagggagaagatgtgccctgtaaaatccctttctccacagaggacggccaaggtaaggctcataacgggcgtctgataactgcgaatccagtagtcaccaaaaaggaggaacccgtgaacattgaggcagaaccgcctttcggcgagtcaaatatcgttatcggaattggcgataacgcccttaaaatcaattggtataagaaggggagcagtattggaaaaatgtttgaagctacagcccgcggtgcaagaaggatggccatattgggcgacactgcttgggatttcgggtctgtgggaggcgtcctgaactccctcggtaagatggtgcaccagatctttgggagcgcctacaccgcactgttctcgggcgtatcttgggtgatgaaaattggaatcggcgttcttctgacgtggatcgggttgaattccaagaacacatcaatgagttttagctgcattgtcataggaatcattaccctctatctgggcgcggtggtgcaggctgacatgggttgtgtcatcaattggaaagggaaggagttaaagtgcggatccggcattttcgttactaacgaggtgcatacatggaccgaacagtacaaatttcaagccgattctcccaagcggctggcaactgccatcgctggtgcctgggagaatggcgtgtgtgggatacgaagcaccacacgcatggaaaacctactctggaaacagatcgcaaatgagctgaactatattctttgggaaaataacatcaagttgacggtagtcgtgggagacattatcggcgttctggagcaggggaaaagaaccctcactccacagcctatggagctgaagtactcatggaaaacatggggaaaggctaagatagtgaccgccgaaacacaaaacagttccttcattatcgatggccccaatactccagagtgccccagcgcgtctagggcctggaacgtctgggaagtggaggactatggttttggggttttcaccacgaatatttggttaaaactgcgggaagtgtacacacagctttgtgaccaccgcttgatgtcagctgcagtaaaggatgagagagccgtccacgctgacatgggatactggatcgagagtcagaaaaacggcagctggaagctcgaaaaagcctccctgatagaggtgaagacctgcacttggcctaagtctcataccctatggtcgaatggtgtgctggaaagcgatatgatcattccaaaatccctcgcaggcccgatctcacagcacaactataggcccgggtaccatacacaaactgcgggaccttggcacctgggcaagcttgagttggactttaattattgcgaggggaccacagtcgttattacggaaaactgtggaacccgtggcccaagtctgcggactacaaccgtgtctggtaaattaatccacgagtggtgctgtcgaagctgcactctcccccctctgagatacatgggggaagatggatgttggtatggcatggagataaggccaatttccgaaaaggaggagaatatggtaaaatcacttgtgagcgccggttctggcaaggtcgacaacttcacaatgggggtgctgtgcttggctatcctctttgaagaggttatgcgcggaaagttcggcaaaaagcatatgatcgccggggtgttctttaccttcgtcctgctactgtccggacagattacgtggcgggatatggcacacactctcatcatgattggcagtaatgctagcgacagaatgggtatgggggtgacctacctggcccttatagcaacatttaaaatccagcccttcttggccctgggatttttcttaaggaagctcacctctcgcgaaaacctgcttctgggcgttggcctagctatggcgactacactccaactgccggaggatattgaacagatggccaatgggatcgcattgggactgatggctttaaaactcattacccagtttgagacatatcagctgtggactgcccttatctccctgacctgttcaaacacgatattcacattgaccgtggcctggcgaactgctaccctcatcctggcaggtgtcagtctactgcctgtatgccaaagctcgtccatgcggaagacagactggcttccaatgactgtggccgcgatgggcgttccccctctccccctgtttattttctctttgaaggataccctgaaacgtagaagctggccattaaatgagggggtgatggctgtcggactcgtgtcaatcctggccagttcccttctgaggaacgacgtacctatggcaggccccttggtggccggtgggctcctgattgcttgttacgtcatcacgggaacatctgcagatctaaccgttgaaaaggccgcggacgtgacttgggaggaagaggctgaacagacaggcgtgagccataacctgatgataaccgtcgacgatgacggcactatgcgcattaaagatgacgagacagagaatatccttaccgtgctcctgaagacggccttgttaatcgtttccgggatttttccatactcaataccggcaactctgctcgtatggcacacctggcagaaacagacacaacggagcggagtgctgtgggatgtccctagtcccccagaaacccagaaggccgagcttgaagagggtgtgtatagaatcaaacagcagggcattttcgggaagacacaagttggagtgggcgtccagaaggagggtgtgtttcatactatgtggcacgtaaccaggggggctgtcctgacgtacaacggaaaacgattggaacccaattgggcctctgtgaagaaagacctaatctcctatggcggcgggtggcgcctgagcgcacagtggcaaaagggagaggaagttcaggtgattgctgtcgagcctggtaaaaacccaaagaatttccagacaatgcccggcactttccagaccacaaccggggaaatcggagccatagcgctcgattttaagcctggcacttcgggttcaccgatcattaaccgggaggggaaagtggttggactgtacggcaatggcgtggtcaccaagaacgggggatatgtgtctggtatcgcccaaacaaatgcagagccagacggccccacgcctgaacttgaggaagagatgttcaaaaagagaaacttaactattatggatctgcacccagggagtggaaaaaccaggaagtacctccccgctatcgtacgtgaagccataaagcgccggttgagaacactgattctcgctcctaccagggtggttgcagccgagatggaggaagccctgaaaggccttccgatccgatatcagactacagctaccaagtccgagcatacgggtcgggaaatcgtcgacctgatgtgccacgcgacttttacaatgcgcttgctaagccccgtgagagtgccaaattacaacctgattatcatggatgaggcacatttcaccgaccctgcctctatagctgccagggggtacattagcacccgggtcggaatgggcgaagcagccgctatctttatgactgcgacacccccaggcaccgccgatgcattccctcagtccaatgctcccattcaggacgaggagcgagacatcccagaaagatcatggaacagtgggaatgagtggataacagattttgccggaaaaactgtatggttcgtgccgagcattaaggcaggtaacgacatcgccaactgtctccgcaaaaatggcaagaaggttatccaattatctaggaaaacgtttgataccgaatatcagaagacaaaactgaacgactgggatttcgtggtcactaccgacatttccgagatgggggctaattttaaggccgatcgtgtgatcgaccctcggagatgccttaaacccgttattctgacagatggaccagagagggtgatactcgcgggccccatgcctgtcaccgcagcctcagctgcccagcgccgaggtagagtggggcggaacccacagaaggaaaatgaccaatacatcttcactggccagcccttgaacaatgatgaggaccacgctcattggacggaagcaaagatgctgctcgacaacattaatacccctgagggaatcatcccggccctgttcgaaccagagagggagaaaagtgctgccattgatggcgaatatcgccttaagggggagagccgtaaaacatttgtagaactaatgagacggggagacctgcccgtgtggttggcacacaaggttgcgtccgagggtataaaatacactgataggaagtggtgcttcgacggccagcgcaacaatcagatcttagaagagaacatggatgtcgagatttggaccaaagaaggggagaagaagaaactgcgacctagatggctcgacgcccggacatattctgatcccctggctcttaaggaatttaaagacttcgccgcaggaaggaagtcgatcgctctggatctcgtgaccgagattggccgcgtgccaagccacttggcccatagaactaggaatgcactggacaacctagtcatgctgcacacatcagaacatggtgggaaagcctaccggcacgctgttgaggagctccctgaaacgatggagacccttctgttattgggcctgatgatcctcctgactggaggcgcgatgctttttctgatatccgggaagggaatcggtaagacaagtattggcctcatctgtgtgattgcctctagcgggatgttgtggatggcagaaatccccctgcaatggatagcttccgccattgtattagagttctttatgatggtgctactgatcccagagcctgaaaaacagcgtaccccgcaggataatcaactcgcctatgtcgtgattggaatccttaccctggcagctataatcgccgcgaacgagatgggcttgctggaaacaactaagcgcgacctcggtatgtcaaaagagcccggggttgtgtctccaacgagctacctggatgtcgaccttcaccctgctagtgcctggaccctctacgcagtagccacaactgtgattacccccatgctgcgacatacaatcgaaaattccaccgctaacgttagcttggcagccattgcgaaccaggctgtggtcctgatgggcttagacaagggatggccaatctctaaaatggatctaggcgtgcctctgctcgcccttgggtgctattcacaggtcaatcccctgactttgacggcagccgtgctgctcctgataacacactacgctattatcggaccgggccttcaggccaaggcaaccagagaggctcaaaagaggactgccgcgggtatcatgaaaaacccaaccgttgacgggattatgacaatcgatttagaccctgtgatatatgattccaagttcgagaaacagctgggacaggtaatgctcttggtgctgtgtgccgtccagctactgctcatgcggactagttgggcactttgcgaagctctgaccttggccacaggccccattacgaccctgtgggagggtagcccaggcaagttttggaatactacaatcgcagtttcgatggctaacattttccgcgggtcttacctcgccggagccggcctggcgttttccatcatgaaaagcgtggggaccggaaagagaggcactggttcacaaggggaaacattaggagagaagtggaaaaagaaacttaatcagctgagtaggaaggaattcgacctctataaaaagtctggcataaccgaggtcgatcggacggaggctaaagaaggtctaaagcgaggcgagatcacccatcacgcagtgtccagagggagcgccaagctgcagtggtttgtagaacgcaacatggtgattcccgagggaagggttatcgacttgggctgtgggcggggaggctggtcatactattgcgctggtctgaaaaaggtgacagaagtccgtgggtacactaaaggaggccctggccatgaggagccggtgcccatgagtacctacgggtggaatattgtcaagctcatgagcggaaaagatgtgttctatcttccacctgaaaagtgtgacacactgttgtgcgatatcggtgagtcctctcccagccctactgttgaagagtccagaaccattagggtactgaagatggtggagccatggctcaaaaacaatcagttctgtatcaaggtcttaaacccctacatgcctacagtgatagaacacctggagcgccttcaacggaaacacggcgggatgctggttcgaaatccactatcaagaaactctacccatgaaatgtattggattagtaatggaactggcaacatcgtggcctcggtcaatatggtgagcaggctcctgttgaaccgctttacgatgacacaccggagacccaccatcgagaaggacgtagatctgggtgcagggactcgtcatgtgaacgccgaaccggagacccctaatatggacgttattggagagaggataaaacggatcaaggaagagcacaactccacatggcactacgacgatgaaaatccatataagacgtgggcttaccatggctcttatgaggtcaaagcgaccggctcagccagctccatgattaacggggtggtgaagctccttactaaaccctgggacgtcgttcctatggtgacacagatggcaatgaccgatactacaccattcggacagcaacgcgtatttaaggaaaaagtggacacccgaacacccagaagtatgccgggtactaggcgggtcatgggcatcaccgctgagtggctgtggcgcacgttagggagaaataagaagcctaggctgtgcacccgagaggaattcacaaaaaaggtgcggactaacgccgcaatgggagccgtttttaccgaggaaaatcagtgggattctgctaaagccgcggtggaggacgaagatttctggattttggtcgaccgtgagagagagctccacaagctgggcaaatgtggtagctgcgtgtacaacatgatggggaagcgcgaaaaaaagctaggagagtttggcaaggcaaaaggctcaagggccatctggtacatgtggcttggggctcggtatctggaattcgaggccctcggatttctgaatgaggatcattggttctccagagaaaacagttacagcggtgtagagggcgaagggttgcacaagctgggatatatactccgcgacatctctaaaattcccggcggtgcaatgtacgctgatgacacagccgggtgggacactaggatcaccgaggatgaccttcataatgaagagaagattacgcagcagatggatccagagcaccgacaactggctaacgccatctttaaattaacatatcagaataaggttgtgaaggtccagcggcctacccccactggaacagtgatggacataatttccagaaaagatcagaggggctcaggccaagtggggacctacggactgaacactttcaccaatatggaagcacagttgatccgccagatggagggtgaaggcgtcctcagcaaggcggacctggagaacccacacctacccgaaaaaaagatcacacagtggcttgagacgaaaggggttgagcgtctgaagcggatggccatttcgggagatgactgcgtggtaaagcctatagatgacagatttgctaacgccctcctggcattgaatgatatgggcaaagtgaggaaggacatcccacaatggcagccgtctaaaggttggcatgattggcagcaggtccccttctgtagtcaccatttccacgaattaattatgaaggacgggcgcaaactggtggttccttgccgaccacaagacgagctcatcggacgggctagaatttcccagggcgccggctggagccttagggaaaccgcatgtctggggaaggcctatgcgcagatgtggtcactaatgtactttcaccgcagagatctgcggctcgcttccaacgccatctgctctgcagtgcccgtccattgggtgcctactagcaggacaacctggagtatacacgcccatcaccaatggatgactacagaggacatgttgaccgtatggaatcgtgtttggatcgaagataacccatggatggaggacaagacgcccgtgacaacctgggagaatgtcccttacctgggaaaacgagaagatcagtggtgtggttcccttattggcctgactagccgcgctacctgggcccagaacatcccgacagcaattcagcaagtgagatctctcatcgggaatgaggaattcttagactatatgccatcaatgaagcggtttaggaaagaggaggaaagtgagggagctatttggtga

SEQ ID NO: 15381 - RNA, 9873 nt, synthetic construct
  misc_feature 1..9873: note = derived and/or modified CDS sequence (opt3) from DENV-3__KF955466__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttacgtgatcacgggaacatctgcagatctgaccgtcgaaaaggccgcggacgttacttgggaggaagaggctgaacagacaggcgtgagccataaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcacacctggcagaaacagacacaacggagcggagtactttgggatgtgcctagtcccccagaaacccagaaggccgagctggaagagggtgtctatagaatcaaacagcagggcattttcgggaagacacaagtgggagttggcgtgcagaaggagggtgtctttcatactatgtggcacgtgaccaggggggctgtattgacgtacaacggaaaacgactagaacccaattgggcctctgtcaagaaagacctgatctcctatggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttacggcaatggcgttgtgaccaagaacgggggatatgtctctggtatcgcccaaacaaatgcagagccagacggccccacgcctgaattagaggaagagatgttcaaaaagagaaacctgactattatggatctccacccagggagtggaaaaaccaggaagtacttgcccgctatcgtgcgtgaagccataaagcgccggctgagaacactcattctggctcctaccagggtagtggcagccgagatggaggaagcccttaaaggcctgccgatccgatatcagactacagctaccaagtccgagcatacgggtcgggaaatcgttgacttgatgtgccacgcgacttttacaatgcgcctactgagccccgtcagagtgccaaattacaacctcattatcatggatgaggcacatttcaccgaccctgcctctatagctgccagggggtacattagcacccgggtgggaatgggcgaagcagccgctatctttatgactgcgacacccccaggcaccgccgatgcattccctcagtccaatgctcccattcaggacgaggagcgagacatcccagaaagatcatggaacagtgggaatgagtggataacagattttgccggaaaaactgtctggttcgtaccgagcattaaggcaggtaacgacatcgccaactgtttacgcaaaaatggcaagaaggtgatccaactgtctaggaaaacgtttgataccgaatatcagaagacaaaacttaacgactgggatttcgttgtgactaccgacatttccgagatgggggctaattttaaggccgatcgtgtcatcgaccctcggagatgcctgaaacccgtgattctcacagatggaccagagagggttatattggcgggccccatgcctgtgaccgcagcctcagctgcccagcgccgaggtagagtcgggcggaacccacagaaggaaaatgaccaatacatcttcactggccagcccctgaacaatgatgaggaccacgctcattggacggaagcaaagatgctcctggacaacattaatacccctgagggaatcatcccggcccttttcgaaccagagagggagaaaagtgctgccattgatggcgaatatcgcctaaagggggagagccgtaaaacatttgtggaactgatgagacggggagacttgcccgtatggttagcacacaaggtggcgtccgagggtataaaatacactgataggaagtggtgcttcgacggccagcgcaacaatcagatcctggaagagaacatggatgttgagatttggaccaaagaaggggagaagaagaaactccgacctagatggctggacgcccggacatattctgatccccttgctctgaaggaatttaaagacttcgccgcaggaaggaagtcgatcgctctcgatttggtcaccgagattggccgcgtgccaagccacctggcccatagaactaggaatgcactagacaacctggtgatgctccacacatcagaacatggtgggaaagcctaccggcacgctgtcgaggagcttcctgaaacgatggagaccctgttattgctgggcctcatgatcctgcttactggaggcgcgatgctgtttctcatatccgggaagggaatcggtaagacaagtattggcttgatctgtgttattgcctctagcgggatgctgtggatggcagaaatccccttacaatggatagcttccgccattgtgctagagttctttatgatggtactgctcatcccagagcctgaaaaacagcgtaccccgcaggataatcaacttgcctatgtggtcattggaatcctgaccttggcagctataatcgccgcgaacgagatgggcctgctcgaaacaactaagcgcgacctgggtatgtcaaaagagcccggggtggtttctccaacgagctaccttgatgtggacctccaccctgctagtgcctggaccctgtacgcagtcgccacaactgtaattacccccatgttgcgacatacaatcgaaaattccaccgctaacgtgagcctggcagccattgcgaaccaggctgttgtgttaatgggcctagacaagggatggccaatctctaaaatggatctgggcgtccctctccttgccctggggtgctattcacaggtgaatcccttgactctgacggcagccgtcctcctgcttataacacactacgctattatcggaccgggcttacaggccaaggcaaccagagaggctcaaaagaggactgccgcgggtatcatgaaaaacccaaccgtggacgggattatgacaatcgatctggaccctgttatatatgattccaagttcgagaaacagctcggacaggtgatgttgctggtactatgtgccgtgcagctgctccttatgcggactagttgggcactgtgcgaagctttgaccctggccacaggccccattacgaccctctgggagggtagcccaggcaagttttggaatactacaatcgcagtctcgatggctaacattttccgcgggtcttacctggccggagccggcttagcgttttccatcatgaaaagcgttgggaccggaaagagaggcactggttcacaaggggaaacacttggagagaagtggaaaaagaaactgaatcagctcagtaggaaggaattcgacctatataaaaagtctggcataaccgaggtggatcggacggaggctaaagaaggtctgaagcgaggcgagatcacccatcacgcagtctccagagggagcgccaagttgcagtggtttgtggaacgcaacatggtaattcccgagggaagggtgatcgacctgggctgtgggcggggaggctggtcatactattgcgctggtctcaaaaaggttacagaagtgcgtgggtacactaaaggaggccctggccatgaggagccggtccccatgagtacctacgggtggaatattgtgaagcttatgagcggaaaagatgtcttctatctgccacctgaaaagtgtgacacattgctgtgcgatatcggtgagtcctctcccagccctactgtggaagagtccagaaccattagggttctcaagatggtagagccatggttaaaaaacaatcagttctgtatcaaggtgctgaacccctacatgcctacagtcatagaacaccttgagcgcctgcaacggaaacacggcgggatgctagtgcgaaatccactctcaagaaactctacccatgaaatgtattggattagtaatggaactggcaacatcgttgcctcggtgaatatggtcagcaggctgttgctgaaccgctttacgatgacacaccggagacccaccatcgagaaggacgtggatctcggtgcagggactcgtcatgtaaacgccgaaccggagacccctaatatggacgtgattggagagaggataaaacggatcaaggaagagcacaactccacatggcactacgacgatgaaaatccatataagacgtgggcttaccatggctcttatgaggttaaagcgaccggctcagccagctccatgattaacggggtcgtgaagcttctgactaaaccctgggacgtggtccctatggttacacagatggcaatgaccgatactacaccattcggacagcaacgcgtgtttaaggaaaaagtagacacccgaacacccagaagtatgccgggtactaggcgggtgatgggcatcaccgctgagtggttatggcgcacgctggggagaaataagaagcctaggttgtgcacccgagaggaattcacaaaaaaggtccggactaacgccgcaatgggagccgtgtttaccgaggaaaatcagtgggattctgctaaagccgcggttgaggacgaagatttctggatgctcgtggaccgtgagagagagctgcacaagctaggcaaatgtggtagctgcgtctacaacatgatggggaagcgcgaaaaaaagcttggagagtttggcaaggcaaaaggctcaagggccatttggtacatgtggctgggggctcggtatctcgaattcgaggccctgggatttttgaatgaggatcattggttctccagagaaaacagttacagcggtgtggagggcgaagggctgcacaagctcggatatatccttcgcgacatatctaaaatccccggcggtgcaatgtacgctgatgacacagccgggtgggacactaggattaccgaggatgacctgcataatgaagagaagatcacgcagcagatggatccagagcaccgacaattagctaacgccatttttaaactgacatatcagaataaggtagttaaggtgcagcggcctacccccactggaacagtcatggacatcatatccagaaaagatcagaggggctcaggccaagtggggacctacggattgaacactttcaccaatatggaagcacagctcattcgccagatggagggtgaaggcgtgctgagcaaggcggacctagagaacccacaccttcccgaaaaaaagatcacacagtggctggagacgaaaggggtcgagcgtctcaagcggatggccatctcgggagatgactgcgttgtgaagcctattgatgacagatttgctaacgccctgttggcattaaatgatatgggcaaagtaaggaaggacataccacaatggcagccgtctaaaggttggcatgattggcagcaggtgcccttctgtagtcaccatttccacgaactgatcatgaaggacgggcgcaaactcgtcgtgccttgccgaccacaagacgagcttattggacgggctagaatctcccagggcgccggctggagcctgagggaaaccgcatgtctagggaaggcctatgcgcagatgtggtcactgatgtactttcaccgcagagatctccggttggcttccaacgccatttgctctgcagttcccgtgcattgggtccctactagcaggacaacctggagtatccacgcccatcaccaatggatgactacagaggacatgctgaccgtgtggaatcgtgtatggatagaagataacccatggatggaggacaagacgcccgttacaacctgggagaatgtgccttaccttggaaaacgagaagatcagtggtgtggttccctgatcggcctcactagccgcgctacctgggcccagaacattccgacagcaatccagcaagtcagatctttaattgggaatgaggaattcctggactatatgccatcaatgaagcggtttaggaaagaggaggaaagtgagggagctatctggtga

SEQ ID NO: 15382 - RNA, 9873 nt, synthetic construct
  misc_feature 1..9873: note = derived and/or modified CDS sequence (opt3) from DENV-3__KF955468__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatactcacactgaccgttgcctggcgaactgctaccctaatcctggcaggtgtgagtcttctccctgtctgccaaagctcgtccatgcggaagacagactggctgccaatgactgtagccgcgatgggcgtgccccctttgcccctgttcattttttctttaaaggataccctcaaacgtagaagctggccactgaatgagggggttatggctgtgggacttgtctcaatcctggccagttccttgctcaggaacgacgtgcctatggcaggccccctggtagccggtgggctactgattgcttgttacgtgatcacgggaacatctgcagatcttaccgtcgaaaaggccgcggacgttacttgggaggaagaggctgaacagacaggcgtgagccataacctcatgataaccgtggacgatgacggcactatgcgcattaaagatgacgagacagagaatatcctgaccgtcttgttaaagacggccctgctcatcgtgtccgggattttcccatactcaataccggcaactctgcttgtttggcacacctggcagaaacagacacaacggagcggagtactgtgggatgtgcctagtcccccagaaacccagaaggccgagttggaagagggtgtctatagaatcaaacagcagggcatttttgggaagacacaagtgggagttggcgtgcagaaggagggtgtcttccatactatgtggcacgtgaccaggggggctgtactaacgtacaacggaaaacgactggaacccaattgggcctctgtcaagaaagacctcatctcctatggcggcgggtggcgcctgagcgcacagtggcaaaagggagaggaagtgcaggttattgctgtggagcctggtaaaaacccaaagaattttcagacaatgcccggcactttccagaccacaaccggggaaatcggagccatagcgcttgatttcaagcctggcacttcgggttcaccgatcattaaccgggaggggagagtcgtgggattatacggcaatggcgttgtgaccaaaaacgggggatatgtctctggtatcgcccaaacaaatgcagagccagacggccccacgcctgaactggaggaagagatgtttaagaaaaggaacctcactattatggatttgcacccagggagtggaaagacccgtaaatacctgcccgctatcgtgcgcgaagccataaagcggagactcaggacactgattcttgctcctacccgagtagtggcagccgagatggaggaagccctgaagggcttgccgatccggtatcagactacagctaccaaatccgagcatacgggtcgcgaaatcgttgacctaatgtgccacgcgactttcacaatgagactgctcagccccgtcagggtgccaaattacaacttaattatcatggatgaggcacattttaccgaccctgcctctatagctgcccgggggtacattagcacccgagtgggaatgggcgaagcagccgctatcttcatgactgcgacacccccaggcaccgccgatgcatttcctcagtccaatgctcccattcaggacgaggagagagacatcccagaacgctcatggaacagtgggaatgagtggataacagatttcgccggaaagactgtctggtttgtaccgagcattaaagcaggtaacgacatcgccaactgtctgaggaagaatggcaaaaaggtgatccaactttctcgtaagacgttcgataccgaatatcagaaaacaaagctgaacgactgggattttgttgtgactaccgacatttccgagatgggggctaatttcaaagccgatcgggtcatcgaccctagaaggtgcctcaagcccgtgattttgacagatggaccagagcgcgttatactggcgggccccatgcctgtgaccgcagcctcagctgcccagcgaagaggtcgggtcgggaggaacccacagaaagaaaatgaccaatacatctttactggccagcccctcaacaatgatgaggaccacgctcattggacggaagcaaagatgctgcttgacaacattaatacccctgagggaatcatcccggccctattcgaaccagagcgcgagaagagtgctgccattgatggcgaatatcgtctgaaaggggagagcagaaagacattcgtggaattgatgcggaggggagacttacccgtatggctggcacacaaagtggcgtccgagggtataaagtacactgatcgcaaatggtgctttgacggccagcgaaacaatcagatcctcgaagagaacatggatgttgagatttggaccaaggaaggggagaaaaagaagctgagacctcggtggcttgacgccaggacatattctgatcccctggctctcaaagaattcaaggactttgccgcaggacgcaaatcgatcgctttggatctggtcaccgagattggcagagtgccaagccacctagcccataggactcggaatgcactggacaacctcgtgatgcttcacacatcagaacatggtgggaaggcctaccgtcacgctgtcgaggagctgcctgaaacgatggagaccttattgctgctcggcctgatgatccttctgactggaggcgcgatgctcttcttgatatccgggaaaggaatcggtaagacaagtattggcctgatctgtgttattgcctctagcgggatgttatggatggcagaaatccccctacaatggatagcttccgccattgtgctggagtttttcatgatggtactccttatcccagagcctgaaaagcagcgcaccccgcaggataatcaactggcctatgtggtcattggaatcttgaccctggcagctataatcgccgcgaacgagatgggcctcctggaaacaactaaacgagaccttggtatgtcaaaggagcccggggtggtttctccaacgagctacctcgatgtggacctgcaccctgctagtgcctggaccttgtacgcagtcgccacaactgtaattacccccatgctgagacatacaatcgaaaattccaccgctaacgtgagcttagcagccattgcgaaccaggctgttgtgctaatgggcctggacaaaggatggccaatctctaagatggatctcggcgtccctcttctggccttggggtgctattcacaggtgaatcccctgactctcacggcagccgtcctgcttttaataacacactacgctattatcggaccgggcctgcaggccaaagcaaccagggaggctcaaaagcggactgccgcgggtatcatgaagaacccaaccgtggacgggattatgacaatcgatctcgaccctgttatatatgattccaaatttgagaagcagttgggacaggtgatgctgctagtactgtgtgccgtgcagctccttctgatgcgcactagttgggcattgtgcgaagctctgaccctcgccacaggccccattacgaccctgtgggagggtagcccaggcaaattctggaatactacaatcgcagtctcgatggctaacatttttagagggtcttacttagccggagccggccttgcgttctccatcatgaagagcgttgggaccggaaaaaggggcactggttcacaaggggaaacactgggagagaagtggaagaaaaagctcaatcagctaagtcggaaagaatttgacctgtataagaaatctggcataaccgaggtggatcgaacggaggctaaggaaggtttgaaaagaggcgagatcacccatcacgcagtctcccgcgggagcgccaagctgcagtggttcgtggaaaggaacatggtaattcccgagggacgggtgatcgacctcggctgtgggcgtggaggctggtcatactattgcgctggtcttaagaaagttacagaagtgagagggtacactaagggaggccctggccatgaggagccggtccccatgagtacctacgggtggaatattgtgaaactgatgagcggaaaggatgtcttttatttgccacctgaaaaatgtgacacactgctctgcgatatcggtgagtcctctcccagccctactgtggaagagtccaggaccattcgcgttttaaagatggtagagccatggctgaagaacaatcagttctgtatcaaagtgcttaacccctacatgcctacagtcatagaacacctggagcggctacaacgaaagcacggcgggatgctcgtgagaaatccactgtcaaggaactctacccatgaaatgtattggattagtaatggaactggcaacatcgttgcctcggtgaatatggtcagccgcttgctgctcaaccggttcacgatgacacacagacgtcccaccatcgagaaagacgtggatcttggtgcagggactaggcatgtaaacgccgaaccggagacccctaatatggacgtgattggagagcggataaagcgcatcaaagaagagcacaactccacatggcactacgacgatgaaaatccatataagacgtgggcttaccatggctcttatgaggttaaggcgaccggctcagccagctccatgattaacggggtcgtgaaactgttaactaagccctgggacgtggtccctatggttacacagatggcaatgaccgatactacaccatttggacagcaacgagtgttcaaagaaaaggtagacaccagaacacccaggagtatgccgggtactcggcgcgtgatgggcatcaccgctgagtggctgtggagaacgttggggaggaataaaaagcctcgactctgcacccgggaggaatttacaaagaaagtccgtactaacgccgcaatgggagccgtgttcaccgaggaaaatcagtgggattctgctaaggccgcggttgaggacgaagatttttggacactggtggacagagagcgcgagctacacaaacttggcaagtgtggtagctgcgtctacaacatgatggggaaaagggaaaagaaactgggagagttcggcaaggcaaagggctcacgggccatttggtacatgtggctcggggctagatatctggaatttgaggccttgggattcctgaatgaggatcattggttttcccgcgaaaacagttacagcggtgtggagggcgaagggctccacaaacttggatatatcctgagggacatatctaagatccccggcggtgcaatgtacgctgatgacactgccgggtgggacacccgaattacggaggatgacttacataatgaagagaaaatcacacagcagatggatccagagcaccggcaactggctaacgccattttcaagttgacctatcagaataaagtagttaaggtgcagagacctactcccacaggaaccgtcatggacatcatatccaggaaggatcagcgcggctcaggccaagtggggacttacggactcaacacctttacaaatatggaagcacagctgattcgtcagatggagggtgaaggcgtgctaagcaaagcggaccttgagaacccacacctgcccgaaaagaaaatcacgcagtggctcgagaccaagggggtcgagcggctgaaaagaatggccatctcgggagatgactgcgttgtgaagcctattgatgacaggttcgctaacgccttgttagcactgaatgatatgggcaaggtacgcaaagacataccacaatggcagccgtctaagggttggcatgattggcagcaggtgcccttttgtagtcaccatttccacgaactcatcatgaaagacgggcgaaagcttgtcgtgccttgccggccacaagacgagctgattggaagagctaggatctcccagggcgccggctggagcctacgcgaaactgcatgtctggggaaagcctatgcgcagatgtggtcactcatgtacttccacagacgggatttgaggctggcttccaacgccatttgctctgcagttcccgtgcattgggtccctacaagccgtaccacttggagtatccacgcccatcaccaatggatgacaaccgaggacatgcttacggtgtggaatcgagtatggatagaagataacccatggatggaggacaagacacccgttaccacttgggagaatgtgccttacctgggaaagcgcgaagatcagtggtgtggttccctcatcggcttaaccagcagagctacatgggcccagaacattccgactgcaatccagcaagtccggtctctgattgggaatgaggaatttttggactatatgccatcaatgaaaaggttccgcaaggaggaggaaagtgagggagctatctggtga

SEQ ID NO: 15383 - RNA, 9873 nt, synthetic construct
  misc_feature 1..9873: note = derived and/or modified CDS sequence (opt3) from DENV-3__FJ744726__SS-prME
  source 1..9873: mol_type = other RNA
accagcctgtgcctcatgatgatgcttcccgccacactggctttccacttgacttccagagacggcgagcctaggatgatcgtggcaaagaacgaacgggggaaatctttactgtttaagacggcctcaggaattaatatgtgtaccctaatagcgatggatctcggtgagatgtgcgacgatacagtcacttacaaatgtccactgatcgctgaagttgagccggaagacattgattgctggtgtaaccttaccagtacatgggtgacctatggcacttgcaatcaggccggggagcatcgccgagacaagcgtagcgtagcactggccccccacgtgggaatgggcttggatacaagaacccaaacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagagactttgttgaagggctgtcaggagcgacctgggtggatgtcgtgctagagcatggtggctgcgtgacgactatggcaaagaataaacccacactcgacatcgagctgcagaagaccgaagccactcaacttgctacactgaggaaattgtgtattgaggggaagatcaccaacattacgaccgatagccggtgccctacacagggagaagccatcctcccagaggaacaggaccagaattatgtctgtaaacacacttacgttgatcgcggctggggtaacgggtgcggactgttcggcaagggcagtttagtgacctgcgcaaagtttcaatgtctggagcccatagaggggaaagtagtgcagcacgaaaatctcaagtatacagtcattatcactgtgcataccggagaccagcaccaggttggtaacgacacacaaggcgtgaccgtcgagattactcctcaggcttccacggtggaagccatccttccagagtacgggacactgggattggaatgctctccgcgaaccggcctagatttcaatgagatgatcctgctcactatgaaaaacaaggcgtggatggtacatagacagtggtttttcgacctgccccttccttggaccagcggtgccacaaccgagactccaacatggaataggaaagaactgttggttacgtttaagaacgcacacgctaaaaagcaagaggtggtcgtgctcgggtcccaggaaggcgccatgcacaccgctctgactggagccacagagattcagaattcaggcgggaccagtatattcgcaggacatttaaagtgtcggctgaaaatggataagctagaactcaaaggtatgagctatgccatgtgcctgaacacatttgtccttaagaaagaggtgtctgagactcagcacggcaccatcttgattaaggttgaatacaagggggaggacgctccctgtaaaatccctttctccacggaagatggacaaggcaaggcgcataacggtcgtctgataaccgcaaatccagtggtaacaaaaaaggaggagcccgtcaacattgaagccgagccgcctttcggggaatcaaatatcgtgatcggcattggagacaaagctctcaagatcaactggtacaagaaaggcagcagtattgggaagatgtttgaggccactgcacgcggagccagaaggatggctatactgggtgataccgcctgggacttcggctctgttgggggagtgcttaattccctgggcaaaatggtccaccagatctttggtagcgcatatacagcgttgttctcgggggtgtcttggattatgaagatcggcatcggagtactcctgacttggattggcttaaactccaaaaatacctcaatgagttttagctgcatagtgatcgggattatcacgctgtacctaggagctgttgtccaggccgatatgggctgtgtgattaactggaagggtaaggaactcaaatgcgggtccggaatcttcgtgacaaatgaggtccatacctggactgagcagtataagtttcaagcagactctcccaaacggctggccacagctatagccggcgcatgggaaaacggtgtttgtggcatccgaagcaccactcgcatggagaatcttttgtggaagcagattgctaacgaactgaattacatcctctgggagaacaatattaaactgaccgtggtggtaggggatatcataggagtcttagaacagggcaagagaacactgacgccacagcctatggagcttaaatattcatggaagacctgggggaaggccaaaattgtgactgcggagacacaaaacagttccttcatcattgacggacccaacaccccagaatgccccagcgcctctagggcttggaatgtttgggaggtggaagactacggctttggtgtcttcacaactaacatctggttgaagctccgggaggtgtatacccagtcatgtgatcaccgcctgatgagtgcagccataaaagacgaaagagctgttcacgccgatatggggtactggatcgagagccagaagaatggatcctggaaactagagaaggcatcttttattgaagtgaagacgtgcacatggcctaaatcgcataccctgtggagcaacggcgtactcgagtccgacatgatcattccaaagtcactggcgggtccgatcagtcagcacaatcataggcccggctaccacactcaaaccgccgggccttggcaccttggaaaattggaactggatttcaactattgcgagggcacaactgtcgtgataaccgagaattgtgggacacgtggaccatctttacggacgaccactgtgagcggcaagctcattcatgaatggtgctgtcgatcctgcacactgccccctcttagatacatgggtgaggacgggtgttggtatggaatggaaatcaggccaatcaacgagaaagaagagaatatggtcaagtcactggttagcgctggctctggtaagatggataactttaccatgggcattttgtgcctcgccatcctgttcgaggaagtgatgcgcgggaaattcggaaagaaacacatgattgcaggcgtactatttactttcgtgctgctcctgtccgggcagataacatggcgggacatggctcatacccttatcatgattggaagtaatgccagcgatagaatgggcatgggtgtcacgtacttggcactgatcgccacttttaagattcagcccttcttagctctcgggtttttcctgaggaaacttacctctcgcgagaacctgctactcggagtgggcctggcgatggccacaaccttgcaactgccggaagacatcgagcagatggcaaatggcatagctttagggctcatgactctgaagcttatcacacagtttgaaacctatcagctgtggacagccttggtttccctcacttgttcaaacaccattttcacgctgacagtggcctggcgaaccgctactctaatcctggcaggagtcagtcttctccctctgtgccaaagctcgtccatgcggaagaccgattggttgccaatgacagtggccgcgatgggtgttccccctctgcccttatttattttctctctcaaagacactccaaagcgtagaagctggcctctgaatgagggcgtgatggctgtcgggcttgtatcaatcctggccagttccttgctcaggaacgatgtgcccatggcaggaccactggttgccggcggtctactgatagcttgttacgtgattaccgggacgtctgcagaccttacagtcgagaaagccgcggacgtgacctgggaagaggaagctgagcagactggagtaagccacaacctcatgatcacagtggatgacgatggcaccatgcgcatcaaggacgatgaaactgagaatattctgacagtcttgttaaaaaccgccctgctcatagtttccggcatctttccgtattcaattcctgcaacgctgcttgtgtggcatacttggcagaagcagacccaacggagcggggtgctgtgggacgtccccagtccacccgagacacagaaagccgaattggaggaaggagtgtacagaatcaagcagcagggtattttcggcaagacccaagttggggtaggagtgcagaaagagggcgtctttcacacaatgtggcacgtgactaggggtgctgttctaacccataacgggaagcgactggagcctaattgggcctctgtgaaaaaggatctcatctcctacggaggcggctggcgcctgagcgcacagtggcaaaaaggggaagaggtccaggtgatagctgtagaaccaggaaagaaccccaagaatttccagacgatgcctggtatcttccagacaactaccggcgagattggggccatcgcgcttgactttaaaccgggaacatcgggctcaccaattatcaaccgggaaggtaaggtcgtggggttatatggaaatggcgttgtgaccaaaaacggcgggtacgtctctggaatagcccaaactaatgcagagcccgatggtcctaccccagagctggaagaggaaatgttcaagaaaagaaacctcacaattatggacttgcaccccggcagtgggaagacgaggaagtatctgcctgctatcgtgcgtgaggccatcaaacgccggctcagaactctgattcttgctccgaccagggttgtggcagccgaaatggaggaggccctgaagggattgcccatccgataccagacaaccgctataaaatccgaacatactggccgggagattgtcgatctaatgtgccacgcgacatttaccatgcgcctgctcagcccagtgagagtacctaattataacttaatcattatggacgaagcacatttcacggatcccgcctctatcgctgccaggggttacataagcactcgggtggggatgggagaggcagccgctatttttatgacagcgaccccacctggcaccgccgaagcattcccccagtccaatgctccaatccaggacgaggagaaggacatcccggaacgatcatggaacagtggcaatgagtggattactgattttgttgggaaaacagtctggttcgtgcctagcatcaaggccggaaacgacattgcaaactgtctgagaaagaatggtaaaaaggtgatacaactttctcgcaaaacctttgatacagaatatcagaagactaggctgaacgactgggatttcgtcgtaacgaccgacatctccgagatgggcgccaattttaaagctgatcgtgtgattgacccccggagatgcctcaagccagttatcttgacagatgggcccgagagggtgatcctggccggacctatgccagtcactgcggcatcagccgctcagcgccgaggcagagtgggtcggaacccccagaaggaaaatgaccaatacattttcaccgggcagcctctcaacaatgatgaggaccacgcccactggacagaagctaaaatgctgcttgacaacataaataccccggagggcatcattccagcactattcgaacccgagagggagaagagtgccgctatcgatggagaataccgcctgaaaggcgagagccgtaagacttttgttgaattgatgagacggggggacttacctgtgtggctggcccataaagtcgcatccgagggaattaagtatacggataggaaatggtgcttcgacggtgaacgcaacaatcagatcctcgaggagaacatggatgtggaaatatggaccaaggagggcgaacgaaagaaactgagaccccggtggcttgacgcgaggacatactctgatccactggccctcaaggagtttaaagacttcgctgccgggcgcaagtcgatcgcattggatctggtaactgaaattggaagagtgcctagccacctagctcataggacccggaatgccctggacaacctcgttatgcttcacacatcagagcacggcggtcgtgcatatcgccatgccgtcgaggaactgcccgagaccatggaaactttattgctgctcgggctgatgatccttctgacaggcggagctatgctctttttgatttccggcaaagggatcggaaagacgagtataggtctgatttgtgtgatcgtgtctagcggcatgttatggatggcggatgtcccactacagtggattgcctccgcaatcgttctggagttctttatgatggtgctccttatacctgagccggaaaagcaacgaaccccccaggacaatcagctggcttacgtagtgatcgggattttgactctggccgccatcgtcacagcaaacgagatgggactcctggaaaccaccaaaagagatcttggcatgtcaaaggagccaggtgtggtttctcctacaagctatctcgacgtggacctgcaccccgctagtgcctggactttgtacgcggtcgctacgaccgtaattacaccaatgctgaggcatactatcgaaaattccaccgccaacgtgagcttagcagccatagctaaccaagcagttgtgctaatggggctggataaaggctggcctatttctaagatggacctcggagtcccccttctggccttgggctgctattcacaggtgaatccgctgacactcaccgcggctgtcctgcttttagtgactcactacgccatcatcgggccaggactgcaggcaaaagccacgcgggaggctcagaagcgcacagccgcaggcattatgaagaaccctaccgttgatggtatcatgactatagacctcgatcccgtgatttacgactccaaattcgagaagcaattggggcaggtaatgctgctagtgctgtgtgctgtccagctccttctgatgagaaccagttgggccttgtgcgaagcgctgacactcgccactggaccaatcaccacactgtgggagggcagccccggtaaattttggaatacgaccattgcagtttcgatggctaacatcttcaggggctcttatttagccggggcaggacttgctttttccataatgaagagcgtgggcactgggaaacggggaacaggctcacagggtgaaaccctgggggagaagtggaagaaaaagctcaatcaactaagtcgaaaagaattcgatctgtacaagaaatctggaatcactgaggtcgacagaacagaggccaaggaaggcttgaaacgcggtgagaccacgcatcacgccgtgtccaggggcagcgcgaagctgcagtggtttgtagaacggaacatggtgattcctgaggggcgtgttatcgatctcggatgtggcagagggggatggtcatattactgcgctggccttaagaaagtgaccgaagtcaggggttatacaaaggggggaccgggccacgaggagcccgtgccaatgagtacttacggctggaatattgtcaaactgatgagcgggaaggacgtgttctatttgcctcccgaaaaatgtgataccctgctctgcgacatcggagagtcctctcctagcccaacagttgaagagtcccgcactattcgggtattaaagatggtggagccctggctgaagaacaatcagttctgtatcaaagtccttaacccttacatgccaaccgtgatagaacatctggagcgactacagagaaagcacggtggcatgctcgttaggaatcccctgtcacgcaactctacacatgaaatgtactggattagtaatgggaccggaaacatcgtgtcgagcgtcaatatggtgtcccggttgctgctcaacagatttactatgacgcaccgtaggccgacaatcgagaaagatgtagaccttggcgcaggtacccggcacgtgaacgccgaacctgagactccaaatatggacgttattggggagcgcataaagcgaatcaaagaagagcattcttcaacctggcactatgatgacgaaaacccctacaagacatgggcttatcatggaagctacgaggtcaaggccacgggctccgcaagttctatgattaatggcgtggtgaaactgttaaccaagccttgggatgtcgttccaatggtgactcaaatggccatgacagacaccactcccttcgggcagcagagagtatttaaagaaaaggtggatacaaggaccccgcggcctatgcccggaacacgcaaagtcatggagatcactgctgagtggctgtggagaaccttgggtaggaacaagcgaccacggctctgcacgcgtgaagagttcaccaagaaagtgagaacaaatgcggccatgggcgcagtttttactgaagagaaccaatgggacagcgctcgcgccgcagtggaagatgaggagttctggaagctggtcgacagggaacgggagctacacaaacttgggaagtgtggatcatgcgtgtataatatgatgggcaaaagagaaaagaaactgggtgagtttgggaaggccaagggatcccgcgctatttggtacatgtggctcggcgccaggtatctggagttcgaagcgttgggctttctgaacgaggatcattggttcagtcgagaaaatagctactctggggtagagggagaaggtctccacaaacttggctacatcctgcgggacatatccaagatccctgggggagcaatgtatgccgatgacaccgctggctgggacacaagaattactgaggatgacttacacaacgaggaaaaaatcacccagcagatggatcccgagcataggcagctggccaatgcaatttttaagttgacgtaccaaaacaaagttgtgaaggtccagcgcccaacacccaagggtaccgtgatggacatcatatcacgtaaagatcagcgggggagcggacaggtgggcacttatggcctcaatacattcaccaacatggaagctcaactggtcagacagatggagggggaaggagttctatcgaaggtggaccttgagaatcctcacctgctcgagaaaaagattactcagtggctggaaaccaaaggtgtagagaggttgcgccgaatggccatctctggcgatgactgcgtggtcaagccaatcgatgaccggtttgctaacgccttactggcactcaacgatatggggaaggtgagaaaagacattccgcagtggcaacccagtaagggatggcatgattggcagcaggttcctttctgttcccaccacttccatgaacttataatgaaagacggcaggaagctggtggtcccatgccgcccccaggacgagctaatcggtagagcgcggattagccaaggggccggatggtcactgaaagaaacagcttgtctcggcaaggcctacgcacagatgtggtccttgatgtattttcacaggcgtgatctgcgacttgcttctaatgccatctgcagcgcagtgcctgtacattgggttccaacgagtcgcaccacttggtccattcacgcccatcaccagtggatgacaaccgaggacatgctgactgtgtggaacagagtctggatcgaggataatccctggatggaagacaagacacctgtgaccacgtgggaggatgttccgtacctcggcaaacgggaagaccaatggtgtgggagcttaataggactgacatctagggcgacctgggctcagaacatcttgactgccattcagcaggtgcgctcactgatcggtgatgaggagttcctcgactatatgccaagtatgaagagatttcggaaagaagaggaatccgagggcgcaatttggtga

SEQ ID NO: 15384 - RNA, 9873 nt, synthetic construct
  misc_feature 1..9873: note = derived and/or modified CDS sequence (opt3) from DENV-3__FJ744729__SS-prME
  source 1..9873: mol_type = other RNA
accagcctgtgcctcatgatgatgcttcccgccacactggctttccacttgacttccagagacggcgagcctaggatgatcgtggcaaagaacgaacgggggaaatctttactgtttaagacggcctcaggaattaatatgtgtaccctaatagcgatggatctcggtgagatgtgcgacgatacagtcacttacaaatgtccactgatcgctgaagttgagccggaagacattgattgctggtgtaaccttaccagtacatgggtgacctatggcacttgcaatcaggccggggagcatcgccgagacaagcgtagcgtagcactggccccccacgtgggaatgggcttggatacaagaacccaaacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagagactttgttgaagggctgtcaggagcgacctgggtggatgtcgtgctagagcatggtggctgcgtgacgactatggcaaagaataaacccacactcgacatcgagctgcagaagaccgaagccactcaacttgctacactgaggaaattgtgtattgaggggaagatcaccaacattacgaccgatagccggtgccctacacagggagaagccatcctcccagaggaacaggaccagaattatgtctgtaaacacacttacgttgatcgcggctggggtaacgggtgcggactgttcggcaagggcagtttagtgacctgcgcaaagtttcaatgtctgaaacccatagaggggaaggtagtgcagcacgagaatctcaaatatacagtcattatcactgtgcataccggagaccagcaccaggttggtaacgacacacaaggcgtgaccgtcgaaattactcctcaggcttccacggtggaggccatccttccagaatacgggacactgggattggagtgctctccgcgaaccggcctagatttcaatgaaatgatcctgctcactatgaagaacaaagcgtggatggtacatagacagtggtttttcgacctgccccttccttggaccagcggtgccacaaccgagactccaacatggaataggaaggagctgttggttacgtttaaaaacgcacacgctaagaagcaagaagtggtcgtgctcgggtcccaggagggcgccatgcacaccgctctgactggagccacagaaattcagaattcaggcgggaccagtatattcgcaggacatttaaaatgtcggctgaagatggataaactagagctcaagggtatgagctatgccatgtgcctgaacacatttgtccttaaaaaggaagtgtctgagactcagcacggcaccatcttgattaaggttgagtacaaaggggaagacgctccctgtaagatccctttctccacggaggatggacaaggcaaagcgcataacggtcgtctgataaccgcaaatccagtggtaacaaagaaagaagagcccgtcaacattgaggccgaaccgcctttcggggagtcaaatatcgtgatcggcattggagacaaggctctcaagatcaactggtacaaaaagggcagcagtattgggaaaatgtttgaagccactgcacgcggagccagaaggatggctatactgggtgataccgcctgggacttcggctctgttgggggagtgcttaattccctgggcaagatggtccaccagatctttggtagcgcatatacagcgttgttctcgggggtgtcttggattatgaaaatcggcatcggagtactcctgacttggattggcttaaactccaagaatacctcaatgagttttagctgcatagtgatcgggattatcacgctgtacctaggagctgttgtccaggccgatatgggctgtgtgattaactggaagggtaaagagctcaagtgcgggtccggaatcttcgtgacaaatgaagtccatacctggactgagcagtataaatttcaagcagactctcccaagcggctggccacagctatagccggcgcatgggagaacggtgtttgtggcatccgaagcaccactcgcatggaaaatcttttgtggaaacagattgctaacgagctgaattacatcctctgggaaaacaatattaagctgaccgtggtggtaggggatatcataggagtcttagagcagggcaaaagaacactgacgccacagcctatggaacttaagtattcatggaagacctgggggaaagccaagattgtgactgcggagacacaaaacagttccttcatcattgacggacccaacaccccagagtgccccagcgcctctagggcttggaatgtttgggaagtggaggactacggctttggtgtcttcacaactaacatctggttgaaactccgggaagtgtatacccagtcatgtgatcaccgcctgatgagtgcagccataaaggacgagagagctgttcacgccgatatggggtactggatcgaaagccagaaaaatggatcctggaagctagagaaggcatcttttattgaggtgaaaacgtgcacatggcctaagtcgcataccctgtggagcaacggcgtactcgaatccgacatgatcattccaaaatcactggcgggtccgatcagtcagcacaatcataggcccggctaccacactcaaaccgccgggccttggcaccttggaaagttggagctggatttcaactattgcgaaggcacaactgtcgtgataaccgagaattgtgggacacgtggaccatctttacggacgaccactgtgagcggcaaactcattcatgagtggtgctgtcgatcctgcacactgccccctcttagatacatgggtgaagacgggtgttggtatggaatggagatcaggccaatcaacgaaaaggaggaaaatatggtcaagtcactggttagcgctggctctggtaaaatggataactttaccatgggcattttgtgcctcgccatcctgttcgaggaggtgatgcgcgggaagttcggaaaaaagcacatgattgcaggcgtactatttactttcgtgctgctcctgtccgggcagataacatggcgggacatggctcatacccttatcatgattggaagtaatgccagcgatagaatgggcatgggtgtcacgtacttggcactgatcgccacttttaaaattcagcccttcttagctctcgggtttttcctgaggaagcttacctctcgcgaaaacctgctactcggagtgggcctggcgatggccacaaccttgcaactgccggaggacatcgaacagatggcaaatggcatagctttagggctcatgactctgaagcttatcacacagtttgagacctatcagctgtggacagccttggtttccctcacttgttcaaacaccattttcacgctgacagtggcctggcgaaccgctactctaatcctggcaggagtcagtcttctccctctgtgccaaagctcgtccatgcggaaaaccgattggttgccaatgacagtggccgcgatgggtgttccccctctgcccttatttattttctctctcaaggacactccaaaacgtagaagctggcctctgaatgaaggcgtgatggctgtcgggcttgtatcaatcctggccagttccttgctcaggaacgatgtgcccatggcaggaccactggttgccggcggtctactgatagcttgttacgtgattaccgggacgtctgcagaccttacagtcgagaaggccgcggacgtgacctgggaggaagaggctgaacagactggagtaagccacaacctcatgatcacagtggatgacgatggcaccatgcgcatcaaagacgatgagactgaaaatattctgacagtcttgttaaagaccgccctgctcatagtttccggcatctttccgtattcaattcctgcaacgctgcttgtgtggcatacttggcagaaacagacccaacggagcggggtgctgtgggacgtccccagtccacccgagacacagaaggccgagttggaagagggagtgtacagaatcaagcagcagggtattttcggcaaaacccaagttggggtaggagtgcagaaggaaggcgtctttcacacaatgtggcacgtgactaggggtgctgttctaacccataacgggaaacgactggagcctaattgggcctctgtgaagaaagatctcatctcctacggaggcggctggcgcctgagcgcacagtggcaaaagggggaggaagtccaggtgatagctgtagagccaggaaagaaccccaaaaatttccagacgatgcctggtatcttccagacaactaccggcgaaattggggccatcgcgcttgactttaagccgggaacatcgggctcaccaattatcaaccgggagggtaaagtcgtggggttatatggaaatggcgttgtgaccaagaacggcgggtacgtctctggaatagcccaaactaatgcagaacccgatggtcctaccccagagctggaggaagagatgttcaaaaagagaaacctcacaattatggacttgcaccccggcagtgggaagacgaggaaatatctgcctgctatcgtgcgtgaagccatcaagcgccggctcagaactctgattcttgctccgaccagggttgtggcagccgagatggaagaggccctgaaaggattgcccatccgataccagacaaccgctataaagtccgagcatactggccgggaaattgtcgatctaatgtgccacgcgacatttaccatgcgcctgctcagcccagtgagagtacctaattataacttaatcattatggacgaggcacatttcacggatcccgcctctatcgctgccaggggttacataagcactcgggtggggatgggagaagcagccgctatttttatgacagcgaccccacctggcaccgccgaggcattcccccagtccaatgctccaatccaggacgaagagcgagacatcccggagagatcatggaacagtggcaatgaatggattactgattttgttgggaaaacagtctggttcgtgcctagcatcaaggccggaaacgacattgcaaactgtctgcgcaagaatggtaaaaaggtgatacaactttctaggaaaacctttgatacagagtatcagaagactcgtctgaacgactgggatttcgtcgtaacgaccgacatctccgaaatgggcgccaattttaaagctgatcgggtgattgaccccagaaggtgcctcaagccagttatcttgacagatgggcccgagcgcgtgatcctggccggacctatgccagtcactgcggcatcagccgctcagcgaagaggccgggtgggtaggaacccccagaaggagaatgaccaatacattttcaccgggcagcctctcaacaatgatgaagaccacgcccactggacagaggctaaaatgctgcttgacaacataaataccccggaaggcatcattccagcactattcgagcccgaacgcgagaagagtgccgctatcgatggagagtaccgtctgaaaggcgaaagcagaaagacttttgttgagttgatgcggaggggggacttacctgtgtggctggcccataaagtcgcatccgaaggaattaagtatacggatcgcaaatggtgcttcgacggtgagcgaaacaatcagatcctcgaagagaacatggatgtggagatatggaccaaggaaggcgagagaaagaaactgcggcccaggtggcttgacgcgcgcacatactctgatccactggccctcaaggaatttaaagacttcgctgccgggagaaagtcgatcgcattggatctggtaactgagattggaagggtgcctagccacctagctcatcggacccgtaatgccctggacaacctcgttatgcttcacacatcagaacacggcggtcgcgcatatcgacatgccgtcgaggagctgcccgaaaccatggagactttattgctgctcgggctgatgatccttctgacaggcggagctatgctctttttgatttccggcaaagggatcggaaagacgagtataggtctgatttgtgtgatcgtgtctagcggcatgttatggatggcggatgtcccactacagtggattgcctccgcaatcgttctggaattctttatgatggtgctccttatacctgagccggagaagcaaagaaccccccaggacaatcagctggcttacgtagtgatcgggattttgactctggccgccatcgtcacagcaaacgaaatgggactcctggagaccaccaaaagggatcttggcatgtcaaaggaaccaggtgtggtttctcctacaagctatctcgacgtggacctgcaccccgctagtgcctggactttgtacgcggtcgctacgaccgtaattacaccaatgctgcggcatactatcgagaattccaccgccaacgtgagcttagcagccatagctaaccaagcagttgtgctaatggggctggataaaggctggcctatttctaagatggacctcggagtcccccttctggccttgggctgctattcacaggtgaatccgctgacactcaccgcggctgtcctgcttttagtgactcactacgccatcatcgggccaggactgcaggcaaaagccacgcgcgaagctcagaagagaacagccgcaggcattatgaagaaccctaccgttgatggtatcatgactatagacctcgatcccgtgatttacgactccaaattcgagaagcaattggggcaggtaatgctgctagtgctgtgtgctgtccagctccttctgatgaggaccagttgggccttgtgcgaggcgctgacactcgccactggaccaatcaccacactgtgggaaggcagccccggtaaattttggaatacgaccattgcagtttcgatggctaacatcttccggggctcttatttagccggggcaggacttgctttttccataatgcgaagcgtgggcactgggaagagaggaacaggctcacagggtgagaccctgggggaaaaatggaagaagaaactcaatcaactaagtcgcaaggagttcgatctgtacaaaaagtctggaatcactgaagtcgacaggacagaggccaaagagggcttgaagcggggtgaaaccacgcatcacgccgtgtcccgtggcagcgcgaaactgcagtggtttgtagagagaaacatggtgattcctgaagggagggttatcgatctcggatgtggccgcgggggatggtcatattactgcgctggccttaagaaggtgaccgaggtccggggttatacaaaagggggaccgggccacgaagagcccgtgccaatgagtacttacggctggaatattgtcaagctgatgagcgggaaagacgtgttctatttgcctcccgagaagtgtgataccctgctctgcgacatcggagaatcctctcctagcccaacagttgaggaatcccgaactattagagtattaaaaatggtggagccctggctgaagaacaatcagttctgtatcaaggtccttaacccttacatgccaaccgtgatagagcatctggaaaggctacagcgcaaacacggtggcatgctcgttcggaatcccctgtcaagaaactctacacatgagatgtactggattagtaatgggaccggaaacatcgtgtcgagcgtcaatatggtgtcccgtttgctgctcaacaggtttactatgacgcaccggcgcccgacaatcgaaaaggatgtagaccttggcgcaggtacccgacacgtgaacgccgagcctgaaactccaaatatggacgttattggggagagaataaaaaggatcaaggaggaacattcttcaacctggcactatgatgacgagaacccctacaaaacatgggcttatcatggaagctacgaagtcaaggccacgggctccgcaagttctatgattaatggcgtggtgaagctgttaaccaaaccttgggatgtcgttccaatggtgactcaaatggccatgacagacaccactcccttcgggcagcagcgggtatttaaggagaaagtggatacacgcaccccgagacctatgcccggaacaaggaaggtcatggaaatcactgctgagtggctgtggcgaaccttgggtcggaacaaacgtccaagactctgcacgcgcgaggaattcaccaagaaggtgaggacaaatgcggccatgggcgcagtttttactgaggaaaaccaatgggacagcgctcgggccgcagtggaggatgaagagttctggaaactggtcgacagagagcgcgaactacacaagcttgggaaatgtggatcatgcgtgtataatatgatgggcaagagggagaaaaagctgggtgaatttgggaaagccaagggatcccgagctatttggtacatgtggctcggcgcccggtatctggagttcgaggcgttgggctttctgaacgaagatcattggttcagtagagagaatagctactctggggtagaaggagagggtctccacaagcttggctacatcctgagggacatatccaaaatccctgggggagcaatgtatgccgatgacaccgctggctgggacacacgcattactgaagatgacttacacaacgaggagaagatcacccagcagatggatcccgaacatcgtcagctggccaatgcaatttttaaattgacgtaccaaaacaaggttgtgaaagtccagcggccaacacccaagggtaccgtgatggacatcatatcaagaaaggatcagagggggagcggacaggtgggcacttatggcctcaatacattcaccaacatggaggctcaactggtccgccagatggaaggggagggagttctatcgaaagtggaccttgaaaatcctcacctgctcgagaagaaaattactcagtggctggagaccaagggtgtagaacgattgcggagaatggccatctctggcgatgactgcgtggtcaaaccaatcgatgacaggtttgctaacgccttactggcactcaacgatatggggaaggtgcgcaaggacattccgcagtggcaacccagtaaaggatggcatgattggcagcaggttcctttctgttcccaccacttccatgagcttataatgaaggacggcagaaaactggtggtcccatgccggccccaggacgaactaatcggtagggcgcgtattagccaaggggccggatggtcactgaaggagacagcttgtctcggcaaagcctacgcacagatgtggtccttgatgtattttcaccgacgcgatctgagacttgcttctaatgccatctgcagcgcagtgcctgtacattgggttccaacgagtcggaccacttggtccattcacgcccatcaccagtggatgacaaccgaagacatgctgactgtgtggaacagggtctggatcgaggataatccctggatggaggacaagacacctgtgaccacgtgggaagatgttccgtacctcggcaagcgcgaggaccaatggtgtgggagcttaataggactgacatctagagcgacctgggctcagaacatcttgactgccattcagcaggtgcggtcactgatcggtgatgaagagttcctcgactatatgccaagtatgaaaaggtttcgaaaggaggaagagtccgaaggcgcaatttggtga

SEQ ID NO: 15385 - RNA, 9873 nt, synthetic construct
  misc_feature 1..9873: note = derived and/or modified CDS sequence (opt3) from DENV-3__FJ687448__SS-prME
  source 1..9873: mol_type = other RNA
accagcctgtgcctcatgatgatgcttcccgccacactggctttccacttgacttccagagacggcgagcctaggatgatcgtggcaaagaacgaacgggggaaatctttactgtttaagacggcctcaggaattaatatgtgtaccctaatagcgatggatctcggtgagatgtgcgacgatacagtcacttacaaatgtccactgatcgctgaagttgagccggaagacattgattgctggtgtaaccttaccagtacatgggtgacctatggcacttgcaatcaggccggggagcatcgccgagacaagcgtagcgtagcactggccccccacgtgggaatgggcttggatacaagaacccaaacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagagactttgttgaagggctgtcaggagcgacctgggtggatgtcgtgctagagcatggtggctgcgtgacgactatggcaaagaataaacccacactcgacatcgagctgcagaagaccgaagccactcaacttgctacactgaggaaattgtgtattgaggggaagatcaccaacattacgaccgatagccggtgccctacacagggagaagccatcctcccagaggaacaggaccagaattatgtctgtaaacacacttacgttgatcgcggctggggtaacgggtgcggactgttcggcaagggcagtttagtgacctgcgcaaagtttcaatgtctggagcccatagaggggaaagtagtgcagcacgaaaatctcaagtatacagtcattatcactgtgcataccggagaccagcaccaggttggtaacgacacacaaggcgtgaccgtcgagattactcctcaggcttccacggtggaagccatccttccagagtacgggacactgggattggaatgctctccgcgaaccggcctagatttcaatgagatgatcctgctcactatgaaaaacaaggcgtggatggtacatagacagtggtttttcgacctgccccttccttggaccagcggtgccacaaccgagactccaacatggaataggaaagaactgttggttacgtttaagaacgcacacgctaaaaagcaagaggtggtcgtgctcgggtcccaggaaggcgccatgcacaccgctctgactggagccacagagattcagaattcaggcgggaccagtatattcgcaggacatttaaagtgtcggctgaaaatggataagctagaactcaaaggtatgagctatgccatgtgcctgaacacatttgtccttaagaaagaggtgtctgagactcagcacggcaccatcttgattaaggttgaatacaagggggaggacgctccctgtaaaatccctttctccacggaagatggacaaggcaaggcgcataacggtcgtctgataaccgcaaatccagtggtaacaaaaaaggaggagcccgtcaacattgaagccgagccgcctttcggggaatcaaatatcgtgatcggcattggagacaaagctctcaagatcaactggtacaagaaaggcagcagtattgggaagatgtttgaggccactgcacgcggagccagaaggatggctatactgggtgataccgcctgggacttcggctctgttgggggagtgcttaattccctgggcaaaatggtccaccagatctttggtagcgcatatacagcgttgttctcgggggtgtcttggattatgaagatcggcatcggagtactcctgacttggattggcttaaactccaaaaatacctcaatgagttttagctgcatagtgatcgggattatcacgctgtacctaggagctgttgtccaggccgatatgggctgtgtgattaactggaagggtaaggaactcaaatgcgggtccggaatcttcgtgacaaatgaggtccatacctggactgagcagtataagtttcaagcagactctcccaaacggctggccacagctatagccggcgcatgggaaaacggtgtttgtggcatccgaagcaccactcgcatggagaatcttttgtggaagcagattgctaacgaactgaattacatcctctgggagaacaatattaaactgaccgtggtggtaggggatatcataggagtcttagaacagggcaagagaacactgacgccacagcctatggagcttaaatattcatggaagacctgggggaaggccaaaattgtgactgcggagacacaaaacagttccttcatcattgacggacccaacaccccagaatgccccagcgcctctagggcttggaatgtttgggaggtggaagactacggctttggtgtcttcacaactaacatctggttgaagctccgggaggtgtatacccagtcatgtgatcaccgcctgatgagtgcagccataaaagacgaaagagctgttcacgccgatatggggtactggatcgagagccagaagaatggatcctggaaactagagaaggcatcttttattgaagtgaagacgtgcacatggcctaaatcgcataccctgtggagcaacggcgtactcgagtccgacatgatcattccaaagtcactggcgggtccgatcagtcagcacaatcataggcccggctaccacactcaaaccgccgggccttggcaccttggaaaattggaactggatttcaactattgcgagggcacaactgtcgtgataaccgagaattgtgggacacgtggaccatctttacggacgaccactgtgagcggcaagctcattcatgaatggtgctgtcgatcctgcacactgccccctcttagatacatgggtgaggacgggtgttggtatggaatggaaatcaggccaatcaacgagaaagaagagaatatggtcaagtcactggttagcgctggctctggtaagatggataactttaccatgggcattttgtgcctcgccatcctgttcgaggaagtgatgcgcgggaaattcggaaagaaacacatgattgcaggcgtactatttactttcgtgctgctcctgtccgggcagataacatggcgggacatggctcatacccttatcatgattggaagtaatgccagcgatagaatgggcatgggtgtcacgtacttggcactgatcgccacttttaagattcagcccttcttagctctcgggtttttcctgaggaaacttacctctcgcgagaacctgctactcggagtgggcctggcgatggccacaaccttgcaactgccggaagacatcgagcagatggcaaatggcatagctttagggctcatgactctgaagcttatcacacagtttgaaacctatcagctgtggacagccttggtttccctcacttgttcaaacaccattttcacgctgacagtggcctggcgaaccgctactctaatcctggcaggagtcagtcttctccctctgtgccaaagctcgtccatgcggaagaccgattggttgccaatgacagtggccgcgatgggtgttccccctctgcccttatttattttctctctcaaagacactccaaagcgtagaagctggcctctgaatgagggcgtgatggctgtcgggcttgtatcaatcctggccagttccttgctcaggaacgatgtgcccatggcaggaccactggttgccggcggtctactgatagcttgttacgtgattaccgggacgtctgcagaccttacagtcgagaaagccgcggacgtgacctgggaagaggaagctgagcagactggagtaagccacaacctcatgatcacagtggatgacgatggcaccatgcgcatcaaggacgatgaaactgagaatattctgacagtcttgttaaaaaccgccctgctcatagtttccggcatctttccgtattcaattcctgcaacgctgcttgtgtggcatacttggcagaagcagacccaacggagcggggtgctgtgggacgtccccagtccacccgagacacagaaagccgaattggaggaaggagtgtacagaatcaagcagcagggtattttcggcaagacccaagttggggtaggagtgcagaaagagggcgtctttcacacaatgtggcacgtgactaggggtgctgttctaacccataacgggaagcgactggagcctaattgggcctctgtgaaaaaggatctcatctcctacggaggcggctggcgcctgagcgcacagtggcaaaaaggggaagaggtccaggtgatagctgtagaaccaggaaagaaccccaagaatttccagacgatgcctggtatcttccagacaactaccggcgagattggggccatcgcgcttgactttaaaccgggaacatcgggctcaccaattatcaaccgggaaggtaaggtcgtggggttatatggaaatggcgttgtgaccaaaaacggcgggtacgtctctggaatagcccaaactaatgcagagcccgatggtcctaccccagagctggaagaggaaatgttcaagaaaagaaacctcacaattatggacttgcaccccggcagtgggaagacgaggaagtatctgcctgctatcgtgcgtgaggccatcaaacgccggctcagaactctgattcttgctccgaccagggttgtggcagccgaaatggaggaggccctgaagggattgcccatccgataccagacaaccgctataaaatccgaacatactggccgggagattgtcgatctaatgtgccacgcgacatttaccatgcgcctgctcagcccagtgagagtacctaattataacttaatcattatggacgaagcacatttcacggatcccgcctctatcgctgccaggggttacataagcactcgggtggggatgggagaggcagccgctatttttatgacagcgaccccacctggcaccgccgaagcattcccccagtccaatgctccaatccaggacgaggagcgagacatcccggaaagatcatggaacagtggcaatgagtggattactgattttgttgggaagacagtctggttcgtgcctagcatcaaagccggaaacgacattgcaaactgtctgcgcaagaatggtaagaaagtgatacaactttctaggaagacctttgatacagaatatcagaaaactcgtctgaacgactgggatttcgtcgtaacgaccgacatctccgagatgggcgccaattttaaggctgatcgggtgattgaccccagaaggtgcctcaaaccagttatcttgacagatgggcccgagcgcgtgatcctggccggacctatgccagtcactgcggcatcagccgctcagcgaagaggccgggtgggtaggaacccccagaaggaaaatgaccaatacattttcaccgggcagcctctcaacaatgatgaggaccacgcccactggacagaagctaagatgctgcttgacaacataaataccccggagggcatcattccagcactattcgaacccgagcgcgagaaaagtgccgctatcgatggagaataccgtctgaagggcgagagcagaaaaacttttgttgaattgatgcggaggggggacttacctgtgtggctggcccataaggtcgcatccgagggaattaaatatacggatcgcaagtggtgcttcgacggtgaacgaaacaatcagatcctcgaggagaacatggatgtggaaatatggaccaaagagggcgaaagaaagaagctgcggcccaggtggcttgacgcgcgcacatactctgatccactggccctcaaagagtttaaggacttcgctgccgggagaaaatcgatcgcattggatctggtaactgaaattggaagggtgcctagccacctagctcatcggacccgtaatgccctggacaacctcgttatgcttcacacatcagagcacggcggtcgcgcatatcgacatgccgtcgaggaactgcccgagaccatggaaactttattgctgctcgggctgatgatccttctgacaggcggagctatgctctttttgatttccggcaaggggatcggaaaaacgagtataggtctgatttgtgtgatcgtgtctagcggcatgttatggatggcggatgtcccactacagtggattgcctccgcaatcgttctggagttctttatgatggtgctccttatacctgagccggaaaagcaaagaaccccccaggacaatcagctggcttacgtagtgatcgggattttgactctggccgccatcgtcacagcaaacgagatgggactcctggaaaccaccaagagggatcttggcatgtcaaaagagccaggtgtggtttctcctacaagctatctcgacgtggacctgcaccccgctagtgcctggactttgtacgcggtcgctacgaccgtaattacaccaatgctgcggcatactatcgaaaattccaccgccaacgtgagcttagcagccatagctaaccaagcagttgtgctaatggggctggataagggctggcctatttctaaaatggacctcggagtcccccttctggccttgggctgctattcacaggtgaatccgctgacactcaccgcggctgtcctgcttttagtgactcactacgccatcatcgggccaggactgcaggcaaaggccacgcgcgaggctcagaaaagaacagccgcaggcattatgaagaaccctaccgttgatggtatcatgactatagacctcgatcccgtgatttacgactccaagttcgagaaacaattggggcaggtaatgctgctagtgctgtgtgctgtccagctccttctgatgaggaccagttgggccttgtgcgaagcgctgacactcgccactggaccaatcaccacactgtgggagggcagccccggtaagttttggaatacgaccattgcagtttcgatggctaacatcttccggggctcttatttagccggggcaggacttgctttttccataatgaaaagcgtgggcactgggaagcgaggaacaggctcacagggtgaaaccctgggggagaaatggaagaagaaactcaatcaactaagtagaaaggaattcgatctgtacaaaaagtctggaatcactgaggtcgaccgcacagaggccaaagaaggcttgaagaggggtgagaccacgcatcacgccgtgtcccggggcagcgcgaaactgcagtggtttgtagaacgtaacatggtgattcctgaggggagagttatcgatctcggatgtggcagggggggatggtcatattactgcgctggccttaagaaggtgaccgaagtccgcggttatacaaaagggggaccgggccacgaggagcccgtgccaatgagtacttacggctggaatattgtcaagctgatgagcgggaaagacgtgttctatttgcctcccgaaaagtgtgataccctgctctgcgacatcggagagtcctctcctagcccaacagttgaagagtcccggactattcgagtattaaaaatggtggagccctggctgaagaacaatcagttctgtatcaaggtccttaacccttacatgccaaccgtgatagaacatctggagagactacagaggaaacacggtggcatgctcgttcgcaatcccctgtcacggaactctacacatgaaatgtactggattagtaatgggaccggaaacatcgtgtcgagcgtcaatatggtgtccagattgctgctcaaccgttttactatgacgcacaggcggccgacaatcgagaaggatgtagaccttggcgcaggtacccgccacgtgaacgccgaacctgagactccaaatatggacgttattggggagcgaataaaaagaatcaaggaagagcattcttcaacctggcactatgatgacgaaaacccctacaaaacatgggcttatcatggaagctacgaggtcaaggccacgggctccgcaagttctatgattaatggcgtggtgaagctgttaaccaaaccttgggatgtcgttccaatggtgactcaaatggccatgacagacaccactcccttcgggcagcagagggtatttaaggaaaaagtggatacacggaccccgcgccctatgcccggaacaagaaaggtcatggagatcactgctgagtggctgtggaggaccttgggtcgaaacaaacggccacgtctctgcacgagagaagagttcaccaagaaggtgcgcacaaatgcggccatgggcgcagtttttactgaagagaaccaatgggacagcgctagggccgcagtggaagatgaggagttctggaaactggtcgaccgggaaagagagctacacaagcttgggaaatgtggatcatgcgtgtataatatgatgggcaagcgcgaaaaaaagctgggtgagtttgggaaagccaagggatccagggctatttggtacatgtggctcggcgcccgatatctggagttcgaagcgttgggctttctgaacgaggatcattggttcagtcgggaaaatagctactctggggtagagggagaaggtctccacaagcttggctacatcctgagagacatatccaaaatccctgggggagcaatgtatgccgatgacaccgctggctgggacacaaggattactgaggatgacttacacaacgaggaaaagatcacccagcagatggatcccgagcatcgccagctggccaatgcaatttttaaattgacgtaccaaaacaaggttgtgaaagtccagcgtccaacacccaagggtaccgtgatggacatcatatcacggaaggatcagagagggagcggacaggtgggcacttatggcctcaatacattcaccaacatggaagctcaactggtcaggcagatggagggggaaggagttctatcgaaagtggaccttgagaatcctcacctgctcgagaagaaaattactcagtggctggaaaccaagggtgtagagcgcttgcgacggatggccatctctggcgatgactgcgtggtcaaaccaatcgatgacagatttgctaacgccttactggcactcaacgatatggggaaggtgaggaaggacattccgcagtggcaacccagtaaaggatggcatgattggcagcaggttcctttctgttcccaccacttccatgaacttataatgaaggacggccgcaaactggtggtcccatgcagaccccaggacgagctaatcggtcgggcgaggattagccaaggggccggatggtcactgaaggaaacagcttgtctcggcaaagcctacgcacagatgtggtccttgatgtattttcaccgtcgagatctgcgccttgcttctaatgccatctgcagcgcagtgcctgtacattgggttccaacgagtagaaccacttggtccattcacgcccatcaccagtggatgacaaccgaggacatgctgactgtgtggaaccgggtctggatcgaggataatccctggatggaagacaagacacctgtgaccacgtgggaggatgttccgtacctcggcaagagggaagaccaatggtgtgggagcttaataggactgacatctcgcgcgacctgggctcagaacatcttgactgccattcagcaggtgagatcactgatcggtgatgaggagttcctcgactatatgccaagtatgaaacggtttaggaaggaagaggaatccgagggcgcaatttggtga

SEQ ID NO: 15386 - RNA, 9873 nt, synthetic construct
  misc_feature 1..9873: note = derived and/or modified CDS sequence (opt3) from DENV-3__FJ744732__SS-prME
  source 1..9873: mol_type = other RNA
accagcctgtgcctcatgatgatgcttcccgccacactggctttccacttgacttccagggacggcgaacctaggatgatcgtggccaagaacgaacgggggaagtctttactgtttaagacggcctcaggaattaatatgtgtaccctaatagcgatggatctcggtgagatgtgcgacgatacagtaacttacaaatgtccactgatcgctgaagttgagccggaagacattgattgctggtgtaaccttaccagtacatgggtgacctatggcacttgcaatcaggccggggagcatcgccgagacaagcgtagcgtagcactggcaccccacgtgggaatgggcttggatacaagaacccagacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagggactttgttgaagggctgtcaggagcgacctgggtggatgtcgtgctagagcatggtggctgcgtgacgactatggcaaagaataaacccacactcgacatcgagctgcagaagaccgaagccactcagcttgctacactgaggaaattgtgtattgaggggaagatcaccaacattacgaccgatagccggtgccctacacagggagaagccatcctcccagaggaacaggaccagaattatgtctgtaaacacacttacgttgatcgcggctggggtaacgggtgcggactgttcggcaagggcagtttagtgacctgcgcaaagtttcaatgtctggagcccatagaggggaaagtagtgcagcacgaaaatctcaagtatacagtcattatcactgtgcataccggagaccagcaccaggttggtaacgacacacaaggcgtgaccgtcgagattactcctcaggcttccacggtggaagccatccttccagagtacgggacactgggattggaatgctctccgcgaaccggcctagatttcaatgagatgatcctgctcactatgaaaaacaaggcgtggatggtacatagacagtggtttttcgacctgccccttccttggaccagcggtgccacaaccgagactccaacatggaataggaaagaactgttggttacgtttaagaacgcacacgctaaaaagcaagaggtggtcgtgctcgggtcccaggaaggcgccatgcacaccgctctgactggagccacagagattcaaaattcaggcgggaccagtatattcgcaggacatttaaagtgtcggctgaaaatggataagctagaactcaaaggtatgagctatgccatgtgcctgaacacatttgtccttaagaaagaggtgtctgagactcagcacggcaccatcttgattaaggttgaatacaagggggaggacgctccctgtaaaatccctttctccacggaagatggacaaggcaaggcgcataacggtcgtctgataaccgcaaatccagtggtaaccaagaaggaggagcccgtcaacattgaagccgagccgcctttcggggaatcaaatatcgtgatcggcattggagacaaagctctcaagatcaactggtacaagaaaggcagcagtattgggaagatgtttgaggccactgcacgcggagccagaaggatggctatactgggtgataccgcctgggacttcggctctgttgggggagtgcttaattccctgggcaaaatggtccaccagatctttggtagcgcatatacagcgttgttctcgggggtgtcttggattatgaagatcggcatcggagtactcctgacttggattggcttaaactccaaaaatacctcaatgagttttagctgcatagtgatcgggattatcacgctgtacctaggagctgttgtccaggccgatatgggctgtgtgattaactggaagggtaaggaactcaaatgcgggtccggaatcttcgtgacaaatgaggtccatacctggactgagcagtataagtttcaagcagactctcccaaacggctggccacagctatagccggcgcatgggaaaacggtgtttgtggcatccgaagcaccactcgcatggagaatcttttgtggaagcagattgctaacgaactgaattacatcctctgggagaacaatattaaactgaccgtggtggtaggggatatcataggagtcttagaacagggcaagagaacactgacgccacagcctatggagcttaaatattcatggaagacctgggggaaggccaaaattgtgactgcggagacacaaaacagttccttcatcattgacggacccaacaccccagaatgccccagcgcctctagggcttggaatgtttgggaggtggaagactacggctttggtgtcttcacaactaacatctggttgaagctccgggaggtgtatacccagtcatgtgatcaccgcctgatgagtgcagccataaaagacgaaagagctgttcacgccgatatggggtactggatcgagagccagaagaatggatcctggaaactagagaaggcatcttttattgaagtgaagacgtgcacatggcctaaatcgcataccctgtggagcaacggcgtactcgagtccgacatgatcattccaaagtcactggcgggtccgatcagtcagcacaatcataggcccggctaccacactcaaaccgccgggccttggcaccttggaaaattggaactggatttcaactattgcgagggcacaactgtcgtgataaccgagaattgtgggacacgtggaccatctttacggacgaccactgtgagcggcaagctcattcatgaatggtgctgtcgatcctgcacactgccccctcttagatacatgggtgaggacgggtgttggtatggaatggaaatcaggccaatcaacgagaaagaagagaatatggtcaagtcactggttagcgctggctctggtaagatggataactttaccatgggcattttgtgcctcgccatcctgttcgaggaagtgatgcgcgggaaattcggaaagaaacacatgattgcaggcgtactatttactttcgtgctgctcctgtccgggcagataacatggcgggacatggctcatacccttatcatgattggaagtaatgccagcgatagaatgggcatgggtgtcacgtacttggcactgatcgccacttttaagattcagcccttcttagctctcgggtttttcctgaggaaacttacctctcgcgagaacctgctactcggagtgggcctggcgatggccacaaccttgcaactgccggaagacatcgagcagatggcaaatggcatagctttagggctcatgactctgaaacttatcacacagtttgaaacctatcagctgtggacagccttggtttccctcacttgttcaaacaccattttcacgctgacagtggcctggcgaaccgctactctaatcctggcaggagtcagtcttctccctctgtgccaaagctcgtccatgcggaagaccgattggttgccaatgacagtggccgcgatgggtgttccccctctgcccttatttattttctctctcaaagacactccaaagcgtagaagctggcctctgaatgagggcgtgatggctgtcgggcttgtatcaatcctggccagttccttgctcaggaacgatgtgcccatggcaggaccactggttgccggcggtctactgatagcttgttacgtgattaccgggacgtctgcagaccttacagtcgagaaagccgcggacgtgacctgggaagaggaagctgagcagactggagtaagccacaacctcatgatcacagtggatgacgatggcaccatgcgcatcaaggacgatgaaactgagaatattctgacagtcttgttaaaaaccgccctgctcatagtttccggcatctttccgtattcaattcctgcaacgctgcttgtgtggcatacttggcagaagcagacccaacggagcggggtgctgtgggacgtccccagtccacccgagacacagaaagccgaattggaggaaggagtgtacagaatcaagcagcagggtattttcggcaagacccaagttggggtaggagtgcagaaagagggcgtctttcacacaatgtggcacgtgactaggggtgctgttctaacccataacgggaagcgactggagcctaattgggcctctgtgaaaaaggatctcatctcctacggaggcggctggcgcctgagcgcacagtggcaaaaaggggaagaggtccaggtgatagctgtagaaccaggaaagaaccccaagaatttccagacgatgcctggtatcttccagacaactaccggcgagattggggccatcgcgcttgactttaaaccgggaacatcgggctcaccaattatcaaccgggaaggtaaggtcgtggggttatatggaaatggcgttgtgaccaaaaacggcgggtacgtctctggaatagcccaaactaatgcagagcccgatggtcctaccccagagctggaagaggaaatgttcaagaaaagaaacctcacaattatggacttgcaccccggcagtgggaagacgaggaagtatctgcctgctatcgtgcgtgaggccatcaaacgccggctcagaactctgattcttgctccgaccagggttgtggcagccgaaatggaggaggccctgaagggattgcccatccgataccagacaaccgctataaaatccgaacatactggccgggagattgtcgatctaatgtgccacgcgacatttaccatgcgcctgctcagcccagtgagagtacctaattataacttaatcattatggacgaagcacatttcacggatcccgcctctatcgctgccaggggttacataagcactcgggtggggatgggagaggcagccgctatttttatgacagcgaccccacctggcaccgccgaagcattcccccagtccaatgctccaatccaggacgaggagcgagacatcccggaaagatcatggaacagtggcaatgagtggattactgattttgccgggaagacagtttggttcgtccctagcatcaaagcaggaaacgacattgccaactgtctgcgcaagaatggtaagaaagtgatacaactttctaggaagacctttgatacagaatatcagaaaactcgtctgaacgactgggatttcgtggtcacgaccgacatctccgagatgggcgctaattttaaggccgatcgggtaattgaccccagaaggtgcctcaaaccagtgatcttgacagatgggcccgagcgcgttatcctggcgggacctatgccagtgactgcagcctcagctgcccagcgaagaggccgggtcggtaggaacccccagaaggaaaatgaccaatacattttcaccgggcagcctctcaacaatgatgaggaccacgctcactggacagaagcaaagatgctgcttgacaacataaataccccggagggcatcattccagccctattcgaacccgagcgcgagaaaagtgctgccatcgatggagaataccgtctgaagggcgagagcagaaaaacttttgtggaattgatgcggagaggggacttacctgtttggctggcacataaggtggcgtccgagggaattaaatatacggatcgcaagtggtgcttcgacggtgaacgaaacaatcagatcctcgaggagaacatggatgtcgaaatatggaccaaagagggcgaaagaaagaagctgcggcccaggtggcttgacgcccgcacatactctgatccactggctctcaaagagtttaaggacttcgccgcagggagaaaatcgatcgctttggatctggtgactgaaattggaagggtacctagccacctagcccatcggacccgtaatgcactggacaacctcgtgatgcttcacacatcagagcacggcggtcgcgcctatcgacatgctgttgaggaactgcccgagaccatggaaactttattgctgctcgggctgatgatccttctgacaggcggagcgatgctctttttgatttccggcaaggggatcggaaaaacgagtataggtctgatttgtgtcatcgtgtctagcggcatgttatggatggccgatgtgccactacagtggattgcatccgctatcgtcctggagttctttatgatggttctccttatacctgagccggaaaagcaaagaacaccccaggacaatcagctggcctacgtggtaatcgggattttgactctggccgcaatcgtgacagctaacgagatgggactcctggaaaccaccaagagggatcttggcatgtcaaaagagccaggtgtcgtgtctcctacaagctatctcgacgttgacctgcaccccgccagtgcgtggactttgtacgctgtggccacgaccgtcattacaccaatgctgcggcatactatcgaaaattccaccgcaaacgtcagcttagccgctatagcaaaccaagccgtggttctaatggggctggataagggctggcctatttctaaaatggacctcggagtgccccttctggcgttgggctgctattcacaggtcaatccgctgacactcaccgctgccgtgctgcttttagtcactcactacgcaatcatcgggccaggactgcaggccaaggctacgcgcgaggcccagaaaagaacagcagctggcattatgaagaaccctaccgtggatggtatcatgactatagacctcgatcccgttatttacgactccaagttcgagaaacaattgggacaggtgatgctgctagtactgtgtgccgtgcagctccttctgatgaggaccagttgggcgttgtgcgaagccctgacactcgcaactggaccaatcaccacactgtgggagggcagccccggtaagttttggaatacgaccattgctgtctcgatggccaacatcttccggggctcttatttagcaggggctggacttgccttttccataatgaaaagcgttggcactgggaagcgaggaacaggctcacagggtgaaaccctgggggagaaatggaagaagaaactcaatcaactaagtagaaaggagttcgatctgtacaaaaagtctggaatcactgaggtggaccgcacagaggccaaagaaggcttgaagaggggtgagaccacgcatcacgcggtctcccggggcagcgctaaactgcagtggtttgtggaacgtaacatggtaattcctgaggggagagtgatcgatctcggatgtggcagaggcgggtggtcatattactgcgcagggcttaagaaggttaccgaagtgcgcggttatacaaaagggggaccgggccacgaggagcccgtcccaatgagtacttacggctggaatattgtgaagctgatgagcgggaaagacgtcttctatttgcctcccgaaaagtgtgataccctgctctgcgacatcggagagtcctctcctagcccaacagtggaagagtcccggactattcgagttttaaaaatggtagagccctggctgaagaacaatcagttctgtatcaaggtgcttaacccttacatgccaaccgtcatagaacatctggagagactacagaggaaacacggtggcatgctcgtgcgcaatcccctgtcacggaactctacacatgaaatgtactggattagtaatgggaccggaaacatcgtttcgagcgtgaatatggtctccagattgctgctcaaccgttttactatgacgcacaggcggccgacaatcgagaaggatgtggaccttggcgccggtacccgccacgtaaacgctgaacctgagactccaaatatggacgtgattggggagcgaataaaaagaatcaaggaagaacactcttcaacctggcactatgatgacgaaaacccctacaaaacatgggcctatcatggaagctacgaggttaaggcaacgggctccgccagttctatgattaatggcgtcgtgaagctgttaaccaaaccttgggatgtggtcccaatggttactcaaatggctatgacagacaccactcccttcgggcagcagagggtgtttaaggaaaaagtagatacacggaccccgcgccctatgcccggaacaagaaaggtgatggagatcactgcggagtggctgtggaggaccttgggtcgaaacaaacggccacgtctctgcacgagagaagagttcaccaagaaggtccgcacaaatgccgcaatgggcgctgtgtttactgaagagaaccaatgggacagcgccagggcagccgttgaagatgaggagttctggaaactggtggaccgggaaagagagctacacaaacttgggaaatgtggatcatgcgtctataatatgatgggcaagcgcgagaagaagctgggtgagtttgggaaagctaagggatccagggccatttggtacatgtggctcggcgcgcgatatctggagttcgaagcattgggctttctgaacgaggatcattggttcagtcgggaaaatagctactctggggtggagggagaaggtctccacaaacttggctacatcctgagagacatatccaaaatccctgggggagccatgtatgctgatgacaccgccggctgggacacaaggattactgaggatgacttacacaacgaggaaaagatcacccagcagatggatcccgagcatcgccagctggcaaatgctatttttaaattgacgtaccaaaacaaggtagttaaagtgcagcgtccaacacccaagggtaccgtcatggacatcatatcacggaaggatcagagagggagcggacaggtgggcacttatggcctcaatacattcaccaacatggaagcccaactggtgaggcagatggagggggaaggagtcctatcgaaagttgaccttgagaatcctcatctgctcgagaagaaaattactcagtggctggaaaccaagggtgtggagcgcttgcgacggatggctatctctggcgatgactgcgtagtgaaaccaatcgatgacagatttgccaacgcattactggcgctcaacgatatggggaaggtcaggaaggacattccgcagtggcaacccagtaaaggatggcatgattggcaacaggtgcctttctgttcccaccacttccatgaacttataatgaaggacggccgcaaactggttgtgccatgcagaccccaggacgagctaatcggtcgggccaggattagccaaggggctggatggtcactgaaggaaacagcctgtctcggcaaagcatacgctcagatgtggtccttgatgtattttcaccgtcgagatctgcgccttgcctctaatgcaatctgcagcgccgtccctgtgcattgggtaccaacgagtagaaccacttggtccattcacgcgcatcaccagtggatgacaaccgaggacatgctgactgtttggaaccgggtgtggatcgaggataatccctggatggaagacaagacacctgtcaccacgtgggaggatgtgccgtacctcggcaagagggaagaccaatggtgtgggagcttaataggactgacatctcgcgctacctgggcccagaacatcttgactgcaattcagcaggttagatcactgatcggtgatgaggagttcctcgactatatgccaagtatgaaacggtttaggaaggaagaggaatccgagggcgccatttggtga

SEQ ID NO: 15387 - RNA, 9873 nt, synthetic construct
  misc_feature 1..9873: note = derived and/or modified CDS sequence (opt3) from DENV-3__FJ810414__SS-prME
  source 1..9873: mol_type = other RNA
accagcctgtgcctcatgatgatgcttcccgccacactggctttccacttgacttccagggacggcgaacctaggatgatcgtggccaagaacgaacgggggaagtctttactgtttaagacggcctcaggaattaatatgtgtaccctaatagcgatggatctcggtgaaatgtgcgacgatacagtaacttacaaatgtccactgatcgctgaagttgagccggaagacattgattgctggtgtaaccttaccagtacatgggtgacctatggcacttgcaatcaggccggggagcatcgccgagacaagcgtagcgtagcactggcaccccacgtgggaatgggcttggatacaagaacccagacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagggactttgttgaagggctgtcaggagcgacctgggtggatgtcgtgctagagcatggtggctgcgtgacgactatggcaaagaataaacccacactcgacatcgagctgcagaagaccgaagccactcagcttgctacactgaggaaattgtgtattgaggggaagatcaccaacattacgaccgatagccggtgccctacacagggagaagccatcctcccagaggaacaggaccagaattatgtctgtaaacacacttacgttgatcgcggctggggtaacgggtgcggactgttcggcaagggcagtttagtgacctgcgcaaagtttcaatgtctggagcccatagaggggaaagtagtgcagcacgaaaatctcaagtatacagtcattatcactgtgcataccggagaccagcaccaggttggtaacgacacacaaggcgtgaccgtcgagattactcctcaggcttccacggtggaagccatccttccagagtacgggacactgggattggaatgctctccgcgaaccggcctagatttcaatgagatgatcctgctcactatgaaaaacaaggcgtggatggtacatagacagtggtttttcgacctgccccttccttggaccagcggtgccacaaccgagactccaacatggaataggaaagaactgttggttacgtttaagaacgcacacgctaaaaagcaagaggtggtcgtgctcgggtcccaggaaggcgccatgcacaccgctctgactggagccacagagattcaaaattcaggcgggaccagtatattcgcaggacatttaaagtgtcggctgaaaatggataagctagaactcaaaggtatgagctatgccatgtgcctgaacacatttgtccttaagaaagaggtgtctgagactcagcacggcaccatcttgattaaggttgaatacaagggggaggacgctccctgtaaaatccctttctccacggaagatggacaaggcaaggcgcataacggtcgtctgataaccgcaaatccagtggtaaccaagaaggaggagcccgtcaacattgaagccgagccgcctttcggggaatcaaatatcgtgatcggcattggagacaaagctctcaagatcaactggtacaagaaaggcagcagtattgggaagatgtttgaggccactgcacgcggagccagaaggatggctatactgggtgataccgcctgggacttcggctctgttgggggagtgcttaattccctgggcaaaatggtccaccagatctttggtagcgcatatacagcgttgttctcgggggtgtcttggattatgaagatcggcatcggagtactcctgacttggattggcttaaactccaaaaatacctcaatgagttttagctgcatagtgatcgggattatcacgctgtacctaggagctgttgtccaggccgatatgggctgtgtgattaactggaagggtaaggaactcaaatgcgggtccggaatcttcgtgacaaatgaggtccatacctggactgagcagtataagtttcaagcagactctcccaaacggctggccacagctatagccggcgcatgggaaaacggtgtttgtggcatccgaagcaccactcgcatggagaatcttttgtggaagcagattgctaacgaactgaattacatcctctgggagaacaatattaaactgaccgtggtggtaggggatatcataggagtcttagaacagggcaagagaacactgacgccacagcctatggagcttaaatattcatggaagacctgggggaaggccaaaattgtgactgcggagacacaaaacagttccttcatcattgacggacccaacaccccagaatgccccagcgcctctagggcttggaatgtttgggaggtggaagactacggctttggtgtcttcacaactaacatctggttgaagctccgggaggtgtatacccagtcatgtgatcaccgcctgatgagtgcagccataaaagacgaaagagctgttcacgccgatatggggtactggatcgagagccagaagaatggatcctggaaactagagaaggcatcttttattgaagtgaagacgtgcacatggcctaaatcgcataccctgtggagcaacggcgtactcgagtccgacatgatcattccaaagtcactggcgggtccgatcagtcagcacaatcataggcccggctaccacactcaaaccgccgggccttggcaccttggaaaattggaactggatttcaactattgcgagggcacaactgtcgtgataaccgagaattgtgggacacgtggaccatctttacggacgaccactgtgagcggcaagctcattcatgaatggtgctgtcgatcctgcacactgccccctcttagatacatgggtgaggacgggtgttggtatggaatggaaatcaggccaatcaacgagaaagaagagaatatggctaagtcactggtcagcgccggctctggtaagatggataactttaccatgggcattttgtgcctcgcaatcctgttcgaggaagttatgcgcgggaaattcggaaagaaacacatgattgctggcgtgctatttactttcgtactgctcctgtccgggcagataacatggcgggacatggcccatacccttatcatgattggaagtaatgcaagcgatagaatgggcatgggtgtgacgtacttggccctgatcgctacttttaagattcagcccttcttagcgctcgggtttttcctgaggaaacttacctctcgcgagaacctgctactcggagtcggcctggccatggcaacaaccttgcaactgccggaagacatcgagcagatggctaatggcatagccttagggctcatgactctgaaacttatcacacagtttgaaacctatcagctgtggacagccttggtgtccctcacttgttcaaacaccattttcacgctgacagttgcttggcgaaccgcaactctaatcctggccggagtgagtcttctccctctgtgccaaagctcgtccatgcggaagaccgattggttgccaatgacagtcgcggctatgggtgtgccccctctgcccttatttattttctctctcaaagacactccaaagcgtagaagctggcctctgaatgagggcgttatggccgtggggcttgtctcaatcctggcaagttccttgctcaggaacgatgtacccatggccggaccactggtggctggcggtctactgatagcatgttacgttattaccgggacgtctgccgaccttacagtggagaaagcggctgacgtcacctgggaagaggaagccgagcagactggagtgagccacaacctcatgatcacagtagatgacgatggcaccatgcgcatcaaggacgatgaaactgagaatattctgacagtgttgttaaaaaccgcactgctcatagtctccggcatctttccgtattcaattcctgccacgctgcttgtttggcatacttggcagaagcagacccaacggagcggggtgctgtgggacgtgcccagtccacccgagacacagaaagctgaattggaggaaggagtctacagaatcaagcagcagggtattttcggcaagacccaagtgggggttggagtacagaaagagggcgtgtttcacacaatgtggcacgtcactaggggtgccgtgctaacccataacgggaagcgactggagcctaattgggcatctgttaaaaaggatctcatctcctacggaggcggctggcgcctgagcgctcagtggcaaaaaggggaagaggtgcaggtcatagccgtggaaccaggaaagaaccccaagaatttccagacgatgcctggtatcttccagacaactaccggcgagattggggcgatcgcccttgactttaaaccgggaacatcgggctcaccaattatcaaccgggaaggtaaggtagtcgggttatatggaaatggcgtggttaccaaaaacggcgggtacgtgtctggaatagcacaaactaatgctgagcccgatggtcctaccccagagctggaagaggaaatgttcaagaaaagaaacctcacaattatggacttgcaccccggcagtgggaagacgaggaagtatctgcctgccatcgtccgtgaggctatcaaacgccggctcagaactctgattcttgcaccgaccagggtggttgccgccgaaatggaggaggctctgaagggattgcccatccgataccagacaaccgcgataaaatccgaacatactggccgggagattgtggatctaatgtgccacgcaacatttaccatgcgcctgctcagcccagtcagagtgcctaattataacttaatcattatggacgaagcccatttcacggatcccgcttctatcgccgcaaggggttacataagcactcgggtagggatgggagaggccgctgcgatttttatgacagccaccccacctggcaccgcagaggctttcccccagtccaatgccccaatccaggacgaggagcgagacatcccggaaagatcatggaacagtggcaatgagtggattactgattttgtggggaagacagtttggttcgtccctagcatcaaagcaggaaacgacattgccaactgtctgcgcaagaatggtaagaaagtgatacaactttctaggaagacctttgatacagaatatcagaaaactcgtctgaacgactgggatttcgtggtcacgaccgacatctccgagatgggcgctaattttaaggccgatcgggtaattgaccccagaaggtgcctcaaaccagtgatcttgacagatgggcccgagcgcgttatcctggcgggacctatgccagtgactgcagcctcagctgcccagcgaagaggccgggtcggtaggaacccccagaaggaaaatgaccaatacattttcaccgggcagcctctcaacaatgatgaggaccacgctcactggacagaagcaaagatgctgcttgacaacataaataccccggagggcatcattccagccctattcgaacccgagcgcgagaaaagtgctgccatcgatggagaataccgtctgaagggcgagagcagaaaaacttttgtggaattgatgcggagaggggacttacctgtttggctggcacataaggtggcgtccgagggaattaaatatacggatcgcaagtggtgcttcgacggtgaacgaaacaatcagatcctcgaggagaacatggatgtcgaaatatggaccaaagagggcgaaagaaagaagctgcggcccaggtggcttgacgcccgcacatactctgatccactggctctcaaagagtttaaggacttcgccgcagggagaaaatcgatcgctttggatctggtgactgaaattggaagggtacctagccacctagcccatcggacccgtaatgcactggacaacctcgtgatgcttcacacatcagagcacggcggtcgcgcctatcgacatgctgttgaggaactgcccgagaccatggaaactttattgctgctcgggctgatgatccttctgacaggcggagcgatgctctttttgatttccggcaaggggatcggaaaaacgagtataggtctgatttgtgtcatcgtgtctagcggcatgttatggatggccgatgtgccactacagtggattgcatccgctatcgtcctggagttctttatgatggttctccttatacctgagccggaaaagcaaagaacaccccaggacaatcagctggcctacgtggtaatcgggattttgactctggccgcaatcgtgacagctaacgagatgggactcctggaaaccaccaagagggatcttggcatgtcaaaagagccaggtgtcgtgtctcctacaagctatctcgacgttgacctgcaccccgccagtgcgtggactttgtacgctgtggccacgaccgtcattacaccaatgctgcggcatactatcgaaaattccaccgcaaacgtcagcttagccgctatagcaaaccaagccgtggttctaatggggctggataagggctggcctatttctaaaatggacctcggagtgccccttctggcgttgggctgctattcacaggtcaatccgctgacactcaccgctgccgtgctgcttttagtcactcactacgcaatcatcgggccaggactgcaggccaaggctacgcgcgaggcccagaaaagaacagcagctggcattatgaagaaccctaccgtggatggtatcatgactatagacctcgatcccgttatttacgactccaagttcgagaaacaattgggacaggtgatgctgctagtactgtgtgccgtgcagctccttctgatgaggaccagttgggcgttgtgcgaagccctgacactcgcaactggaccaatcaccacactgtgggagggcagccccggtaagttttggaatacgaccattgctgtctcgatggccaacatcttccggggctcttatttagcaggggctggacttgccttttccataatgaaaagcgttggcactgggaagcgaggaacaggctcacagggtgaaaccctgggggagaaatggaagaagaaactcaatcaactaagtagaaaggagttcgatctgtacaaaaagtctggaatcactgaggtggaccgcacagaggccaaagaaggcttgaagaggggtgagaccacgcatcacgcggtctcccggggcagcgctaaactgcagtggtttgtggaacgtaacatggtaattcctgaggggagagtgatcgatctcggatgtggcagaggcgggtggtcatattactgcgcagggcttaagaaggttaccgaagtgcgcggttatacaaaagggggaccgggccacgaggagcccgtcccaatgagtacttacggctggaatattgtgaagctgatgagcgggaaagacgtcttctatttgcctcccgaaaagtgtgataccctgctctgcgacatcggagagtcctctcctagcccaacagtggaagagtcccggactattcgagttttaaaaatggtagagccctggctgaagaacaatcagttctgtatcaaggtgcttaacccttacatgccaaccgtcatagaacatctggagagactacagaggaaacacggtggcatgctcgtgcgcaatcccctgtcacggaactctacacatgaaatgtactggattagtaatgggaccggaaacatcgtttcgagcgtgaatatggtctccagattgctgctcaaccgttttactatgacgcacaggcggccgacaatcgagaaggatgtggaccttggcgccggtacccgccacgtaaacgctgaacctgagactccaaatatggacgtgattggggagcgaataaaaagaatcaaggaagaacactcttcaacctggcactatgatgacgaaaacccctacaaaacatgggcctatcatggaagctacgaggttaaggcaacgggctccgccagttctatgattaatggcgtcgtgaagctgttaaccaaaccttgggatgtggtcccaatggttactcaaatggctatgacagacaccactcccttcgggcagcagagggtgtttaaggaaaaagtagatacacggaccccgcgccctatgcccggaacaagaaaggtgatggagatcactgcggagtggctgtggaggaccttgggtcgaaacaaacggccacgtctctgcacgagagaagagttcaccaagaaggtccgcacaaatgccgcaatgggcgctgtgtttactgaagagaaccaatgggacagcgccagggcagccgttgaagatgaggagttctggaaactggtggaccgggaaagagagctacacaaacttgggaaatgtggatcatgcgtctataatatgatgggcaagcgcgagaagaagctgggtgagtttgggaaagctaagggatccagggccatttggtacatgtggctcggcgcgcgatatctggagttcgaagcattgggctttctgaacgaggatcattggttcagtcgggaaaatagctactctggggtggagggagaaggtctccacaaacttggctacatcctgagagacatatccaaaatccctgggggagccatgtatgctgatgacaccgccggctgggacacaaggattactgaggatgacttacacaacgaggaaaagatcacccagcagatggatcccgagcatcgccagctggcaaatgctatttttaaattgacgtaccaaaacaaggtagttaaagtgcagcgtccaacacccaagggtaccgtcatggacatcatatcacggaaggatcagagagggagcggacaggtgggcacttatggcctcaatacattcaccaacatggaagcccaactggtgaggcagatggagggggaaggagtcctatcgaaagttgaccttgagaatcctcatctgctcgagaagaaaattactcagtggctggaaaccaagggtgtggagcgcttgcgacggatggctatctctggcgatgactgcgtagtgaaaccaatcgatgacagatttgccaacgcattactggcgctcaacgatatggggaaggtcaggaaggacattccgcagtggcaacccagtaaaggatggcatgattggcaacaggtgcctttctgttcccaccacttccatgaacttataatgaaggacggccgcaaactggttgtgccatgcagaccccaggacgagctaatcggtcgggccaggattagccaaggggctggatggtcactgaaggaaacagcctgtctcggcaaagcatacgctcagatgtggtccttgatgtattttcaccgtcgagatctgcgccttgcctctaatgcaatctgcagcgccgtccctgtgcattgggtaccaacgagtagaaccacttggtccattcacgcgcatcaccagtggatgacaaccgaggacatgctgactgtttggaaccgggtgtggatcgaggataatccctggatggaagacaagacacctgtcaccacgtgggaggatgtgccgtacctcggcaagagggaagaccaatggtgtgggagcttaataggactgacatctcgcgctacctgggcccagaacatcttgactgcaattcagcaggttagatcactgatcggtgatgaggagttcctcgactatatgccaagtatgaaacggtttaggaaggaagaggaatccgagggcgccatttggtga

SEQ ID NO: 15388 - RNA, 9873 nt, synthetic construct
  misc_feature 1..9873: note = derived and/or modified CDS sequence (opt3) from DENV-3__FJ744734__SS-prME
  source 1..9873: mol_type = other RNA
accagcctgtgcctcatgatgatgcttcccgccacactggctttccacttgacttccagagacggcgagcctaggatgatcgtggcaaagaacgaacgggggaaatctttactgtttaagacggcctcaggaattaatatgtgtaccctaatagcgatggatctcggtgagatgtgcgacgatacagtcacttacaaatgtccactgatcgctgaagttgagccggaagacattgattgctggtgtaaccttaccagtacatgggtgacctatggcacttgcaatcaggccggggagcatcgccgagacaagcgtagcgtagcactggccccccacgtgggaatgggcttggatacaagaacccaaacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagagactttgttgaagggctgtcaggagcgacctgggtggatgtcgtgctagagcatggtggctgcgtgacgactatggcaaagaataaacccacactcgacatcgagctgcagaagaccgaagccactcaacttgctacactgaggaaattgtgtattgaggggaagatcaccaacattacgaccgatagccggtgccctacacagggagaagccatcctcccagaggaacaggaccagaattatgtctgtaaacacacttacgttgatcgcggctggggtaacgggtgcggactgttcggcaagggcagtttagtgacctgcgcaaagtttcaatgtctggagcccatagaggggaaagtagtgcagcacgaaaatctcaagtatacagtcattatcactgtgcataccggagaccagcaccaggttggtaacgacacacaaggcgtgaccgtcgagattactcctcaggcttccacggtggaagccatccttccagagtacgggacactgggattggaatgctctccgcgaaccggcctagatttcaatgagatgatcctgctcactatgaaaaacaaggcgtggatggtacatagacagtggtttttcgacctgccccttccttggaccagcggtgccacaaccgagactccaacatggaataggaaagaactgttggttacgtttaagaacgcacacgctaaaaagcaagaggtggtcgtgctcgggtcccaggaaggcgccatgcacaccgctctgactggagccacagagattcagaattcaggcgggaccagtatattcgcaggacatttaaagtgtcggctgaaaatggataagctagaactcaaaggtatgagctatgccatgtgcctgaacacatttgtccttaagaaagaggtgtctgagactcagcacggcaccatcttgattaaggttgaatacaagggggaggacgctccctgtaaaatccctttctccacggaagatggacaaggcaaggcgcataacggtcgtctgataaccgcaaatccagtggtaacaaaaaaggaggagcccgtcaacattgaagccgagccgcctttcggggaatcaaatatcgtgatcggcattggagacaaagctctcaagatcaactggtacaagaaaggcagcagtattgggaagatgtttgaggccactgcacgcggagccagaaggatggctatactgggtgataccgcctgggacttcggctctgttgggggagtgcttaattccctgggcaaaatggtccaccagatctttggtagcgcatatacagcgttgttctcgggggtgtcttggattatgaagatcggcatcggagtactcctgacttggattggcttaaactccaaaaatacctcaatgagttttagctgcatagtgatcgggattatcacgctgtacctaggagctgttgtccaggccgatatgggctgtgtgattaactggaagggtaaggaactcaaatgcgggtccggaatcttcgtgacaaatgaggtccatacctggactgagcagtataagtttcaagcagactctcccaaacggctggccacagctatagccggcgcatgggaaaacggtgtttgtggcatccgaagcaccactcgcatggagaatcttttgtggaagcagattgctaacgaactgaattacatcctctgggagaacaatattaaactgaccgtggtggtaggggatatcataggagtcttagaacagggcaagagaacactgacgccacagcctatggagcttaaatattcatggaagacctgggggaaggccaaaattgtgactgcggagacacaaaacagttccttcatcattgacggacccaacaccccagaatgccccagcgcctctagggcttggaatgtttgggaggtggaagactacggctttggtgtcttcacaactaacatctggttgaagctccgggaggtgtatacccagtcatgtgatcaccgcctgatgagtgcagccataaaagacgaaagagctgttcacgccgatatggggtactggatcgagagccagaagaatggatcctggaaactagagaaggcatcttttattgaagtgaagacgtgcacatggcctaaatcgcataccctgtggagcaacggcgtactcgagtccgacatgatcattccaaagtcactggcgggtccgatcagtcagcacaatcataggcccggctaccacactcaaaccgccgggccttggcaccttggaaaattggaactggatttcaactattgcgagggcacaactgtcgtgataaccgagaattgtgggacacgtggaccatctttacggacgaccactgtgagcggcaagctcattcatgaatggtgctgtcgatcctgcacactgccccctcttagatacatgggtgaggacgggtgttggtatggaatggaaatcaggccaatcaacgagaaagaagagaatatggtcaagtcactggttagcgctggctctggtaagatggataactttaccatgggcattttgtgcctcgccatcctgttcgaggaagtgatgcgcgggaaattcggaaagaaacacatgattgcaggcgtactatttactttcgtgctgctcctgtccgggcagataacatggcgggacatggctcatacccttatcatgattggaagtaatgccagcgatagaatgggcatgggtgtcacgtacttggcactgatcgccacttttaagattcagcccttcttagctctcgggtttttcctgaggaaacttacctctcgcgagaacctgctactcggagtgggcctggcgatggccacaaccttgcaactgccggaagacatcgagcagatggcaaatggcatagctttagggctcatgactctgaagcttatcacacagtttgaaacctatcagctgtggacagccttggtttccctcacttgttcaaacaccattttcacgctgacagtggcctggcgaaccgctactctaatcctggcaggagtcagtcttctccctctgtgccaaagctcgtccatgcggaagaccgattggttgccaatgacagtggccgcgatgggtgttccccctctgcccttatttattttctctctcaaagacactccaaagcgtagaagctggcctctgaatgagggcgtgatggctgtcgggcttgtatcaatcctggccagttccttgctcaggaacgatgtgcccatggcaggaccactggttgccggcggtctactgatagcttgttacgtgattaccgggacgtctgcagaccttacagtcgagaaagccgcggacgtgacctgggaagaggaagctgagcagactggagtaagccacaacctcatgatcacagtggatgacgatggcaccatgcgcatcaaggacgatgaaactgagaatattctgacagtcttgttaaaaaccgccctgctcatagtttccggcatctttccgtattcaattcctgcaacgctgcttgtgtggcatacttggcagaagcagacccaacggagcggggtgctgtgggacgtccccagtccacccgagacacagaaagccgaattggaggaaggagtgtacagaatcaagcagcagggtattttcggcaagacccaagttggggtaggagtgcagaaagagggcgtctttcacacaatgtggcacgtgactaggggtgctgttctaacccataacgggaagcgactggagcctaattgggcctctgtgaaaaaggatctcatctcctacggaggcggctggcgcctgagcgcacagtggcaaaaaggggaagaggtccaggtgatagctgtagaaccaggaaagaaccccaagaatttccagacgatgcctggtatcttccagacaactatgggcgagattggggccatcgcgcttgactttaaaccgggaacctcgggctcaccaattatcaaccgggaaggtaaggtcgtggggttatatggaaatggcgttgtgacaaaaaacggcgggtacgtctctggaatagcccaaaccaatgcagagcccgatggtcctactccagagctggaagaggaaatgttcaagaaaagaaacctcaccattatggacttgcaccccggcagtgggaagacaaggaagtatctgcctgctatcgtgcgtgaggccatcaaacgccggctcagaacgctgattcttgctccgactagggttgtggcagccgaaatggaggaggccctgaagggattgcccatccgataccagaccacagctataaaatccgaacataccggccgggagattgtcgatctaatgtgccacgcgacttttacaatgcgcctgctcagcccagtgagagtacctaattataacttaatcattatggacgaagcacatttcaccgatcccgcctctatcgctgccaggggttacataagcacgcgggtggggatgggagaggcagccgctatttttatgactgcgacaccacctggcaccgccgaagcattcccccagtccaatgctccaatccaggacgaggagcgagacatcccggaaagatcatggaacagtggcaatgagtggattaccgattttgttgggaagactgtctggttcgtgcctagcatcaaagccggaaacgacattgcaaactgtctgcgcaagaatggtaagaaagtgatacaactttctaggaagacatttgataccgaatatcagaaaacacgtctgaacgactgggatttcgtcgtaactacggacatctccgagatgggcgccaattttaaggctgatcgggtgattgaccccagaaggtgcctcaaaccagttatcttgaccgatgggcccgagcgcgtgatcctggccggacctatgccagtcacagcggcatcagccgctcagcgaagaggccgggtgggtaggaacccccagaaggaaaatgaccaatacattttcactgggcagcctctcaacaatgatgaggaccacgcccactggaccgaagctaagatgctgcttgacaacataaatacaccggagggcatcattccagcactattcgaacccgagcgcgagaaaagtgccgctatcgatggagaataccgtctgaagggcgagagcagaaaaacctttgttgaattgatgcggaggggggacttacctgtgtggctggcccataaggtcgcatccgagggaattaaatatactgatcgcaagtggtgcttcgacggtgaacgaaacaatcagatcctcgaggagaacatggatgtggaaatatggacgaaagagggcgaaagaaagaagctgcggcccaggtggcttgacgcgcgcacctactctgatccactggccctcaaagagtttaaggacttcgctgccgggagaaaatcgatcgcattggatctggtaacagaaattggaagggtgcctagccacctagctcatcggactcgtaatgccctggacaacctcgttatgcttcacacctcagagcacggcggtcgcgcatatcgacatgccgtcgaggaactgcccgagacaatggaaaccttattgctgctcgggctgatgatccttctgactggcggagctatgctctttttgatttccggcaaggggatcggaaaaacaagtataggtctgatttgtgtgatcgtgtctagcggcatgttatggatggcggatgtcccactacagtggattgcctccgcaatcgttctggagttctttatgatggtgctccttatacctgagccggaaaagcaaagaacgccccaggacaatcagctggcttacgtagtgatcgggattttgaccctggccgccatcgtcactgcaaacgagatgggactcctggaaacaaccaagagggatcttggcatgtcaaaagagccaggtgtggtttctcctaccagctatctcgacgtggacctgcaccccgctagtgcctggacattgtacgcggtcgctactacggtaattaccccaatgctgcggcatacaatcgaaaattccactgccaacgtgagcttagcagccatagctaaccaagcagttgtgctaatggggctggataagggctggcctatttctaaaatggacctcggagtcccccttctggccttgggctgctattcacaggtgaatccgctgaccctcacagcggctgtcctgcttttagtgacccactacgccatcatcgggccaggactgcaggcaaaggccactcgcgaggctcagaaaagaacggccgcaggcattatgaagaaccctacagttgatggtatcatgaccatagacctcgatcccgtgatttacgactccaagttcgagaaacaattggggcaggtaatgctgctagtgctgtgtgctgtccagctccttctgatgaggactagttgggccttgtgcgaagcgctgaccctcgccacaggaccaatcactaccctgtgggagggcagccccggtaagttttggaatacaacgattgcagtttcgatggctaacatcttccggggctcttatttagccggggcaggacttgctttttccataatgaaaagcgtgggcaccgggaagcgaggaactggctcacagggtgaaacactgggggagaaatggaagaagaaactcaatcaactaagtagaaaggaattcgatctgtacaaaaagtctggaatcaccgaggtcgaccgcactgaggccaaagaaggcttgaagaggggtgagacaacccatcacgccgtgtcccggggcagcgcgaaactgcagtggtttgtagaacgtaacatggtgattcctgaggggagagttatcgatctcggatgtggcagggggggatggtcatattactgcgctggccttaagaaggtgacggaagtccgcggttataccaaagggggaccgggccacgaggagcccgtgccaatgagtacatacggctggaatattgtcaagctgatgagcgggaaagacgtgttctatttgcctcccgaaaagtgtgatactctgctctgcgacatcggagagtcctctcctagcccaaccgttgaagagtcccggacaattcgagtattaaaaatggtggagccctggctgaagaacaatcagttctgtatcaaggtccttaacccttacatgccaactgtgatagaacatctggagagactacagaggaaacacggtggcatgctcgttcgcaatcccctgtcacggaactctacccatgaaatgtactggattagtaatgggacaggaaacatcgtgtcgagcgtcaatatggtgtccagattgctgctcaaccgttttaccatgactcacaggcggccgacgatcgagaaggatgtagaccttggcgcaggtacacgccacgtgaacgccgaacctgagaccccaaatatggacgttattggggagcgaataaaaagaatcaaggaagagcattcttcaacttggcactatgatgacgaaaacccctacaaaacctgggcttatcatggaagctacgaggtcaaggccacaggctccgcaagttctatgattaatggcgtggtgaagctgttaacgaaaccttgggatgtcgttccaatggtgacccaaatggccatgactgacacaacccccttcgggcagcagagggtatttaaggaaaaagtggatactcggacaccgcgccctatgcccggaaccagaaaggtcatggagatcacagctgagtggctgtggaggactttgggtcgaaacaaacggccacgtctctgcaccagagaagagttcacgaagaaggtgcgcaccaatgcggccatgggcgcagtttttacagaagagaaccaatgggacagcgctagggccgcagtggaagatgaggagttctggaaactggtcgaccgggaaagagagctacacaagcttgggaaatgtggatcatgcgtgtataatatgatgggcaagcgcgaaaaaaagctgggtgagtttgggaaagccaagggatccagggctatttggtacatgtggctcggcgcccgatatctggagttcgaagcgttgggctttctgaacgaggatcattggttcagtcgggaaaatagctactctggggtagagggagaaggtctccacaagcttggctacatcctgagagacatatccaaaatccctgggggagcaatgtatgccgatgacactgctggctgggacaccaggattacagaggatgacttacacaacgaggaaaagatcactcagcagatggatcccgagcatcgccagctggccaatgcaatttttaaattgacctaccaaaacaaggttgtgaaagtccagcgtccaacgcccaagggtacagtgatggacatcatatcacggaaggatcagagagggagcggacaggtgggcacctatggcctcaatactttcacaaacatggaagctcaactggtcaggcagatggagggggaaggagttctatcgaaagtggaccttgagaatcctcacctgctcgagaagaaaattacccagtggctggaaactaagggtgtagagcgcttgcgacggatggccatctctggcgatgactgcgtggtcaaaccaatcgatgacagatttgctaacgccttactggcactcaacgatatggggaaggtgaggaaggacattccgcagtggcaacccagtaaaggatggcatgattggcagcaggttcctttctgttcccaccacttccatgaacttataatgaaggacggccgcaaactggtggtcccatgcagaccccaggacgagctaatcggtcgggcgaggattagccaaggggccggatggtcactgaaggaaaccgcttgtctcggcaaagcctacgcacagatgtggtccttgatgtattttcaccgtcgagatctgcgccttgcttctaatgccatctgcagcgcagtgcctgtacattgggttccaacaagtagaacgacctggtccattcacgcccatcaccagtggatgactacagaggacatgctgaccgtgtggaaccgggtctggatcgaggataatccctggatggaagacaagactcctgtgacaacctgggaggatgttccgtacctcggcaagagggaagaccaatggtgtgggagcttaataggactgacgtctcgcgcgacatgggctcagaacatcttgaccgccattcagcaggtgagatcactgatcggtgatgaggagttcctcgactatatgccaagtatgaaacggtttaggaaggaagaggaatccgagggcgcaatttggtga

SEQ ID NO: 15389 - RNA, 9873 nt, synthetic construct
  misc_feature 1..9873: note = derived and/or modified CDS sequence (opt3) from DENV-3__FJ744737__SS-prME
  source 1..9873: mol_type = other RNA
accagcctgtgcctcatgatgatgcttcccgccacactggctttccacttgacttccagggacggcgaacctaggatgatcgtggccaagaacgaacgggggaagtctttactgtttaagacggcctcaggaattaatatgtgtaccctaatagcgatggatctcggtgaaatgtgcgacgatacagtcacttacaaatgtccactgatcgctgaagttgagccggaagacattgattgctggtgtaaccttaccagtacatgggtgacctatggcacttgcaatcaggccggggagcatcgccgagacaagcgtagcgtagcactggcaccccacgtgggaatgggcttggatacaagaacccagacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagggactttgttgaagggctgtcaggagcgacctgggtggatgtcgtgctagagcatggtggctgcgtgacgactatggcaaagaataaacccacactcgacatcgagctgcagaagaccgaagccactcagcttgctacactgaggaaattgtgtattgaggggaagatcaccaacattacgaccgatagccggtgccctacacagggagaagccatcctcccagaggaacaggaccagaattatgtctgtaaacacacttacgttgatcgcggctggggtaacgggtgcggactgttcggcaagggcagtttagtgacctgcgcaaagtttcaatgtctggagcccatagaggggaaagtagtgcagcacgaaaatctcaagtatacagtcattatcactgtgcataccggagaccagcaccaggttggtaacgacacacaaggcgtgaccgctgagattactcctcaggcctccacggtcgaagcgatccttccagagtacgggacactgggattggaatgctctccgcgaaccggcctagatttcaatgagatgatcctgctcactatgaaaaacaaggcctggatggtgcatagacagtggtttttcgacctgccccttccttggaccagcggtgcaacaaccgagactccaacatggaataggaaagaactgttggtaacgtttaagaacgctcacgccaaaaagcaagaggttgtggtcctcgggtcccaggaaggcgctatgcacaccgccctgactggagcaacagagattcaaaattcaggcgggaccagtatattcgccggacatttaaagtgtcggctgaaaatggataagctagaactcaaaggtatgagctatgctatgtgcctgaacacatttgtgcttaagaaagaggtctctgagactcagcacggcaccatcttgattaaggtggaatacaagggggaggacgcgccctgtaaaatccctttctccacggaagatggacaaggcaaggcacataacggtcgtctgataaccgccaatccagttgtgaccaagaaggaggagcccgtaaacattgaagctgagccgcctttcggggaatcaaatatcgtcatcggcattggagacaaagccctcaagatcaactggtacaagaaaggcagcagtattgggaagatgtttgaggcaactgcccgcggagctagaaggatggccatactgggtgataccgcatgggacttcggctctgtaggcggggttcttaattccctggggaaaatggtgcaccagatctttggtagcgcgtatacagctttgttctcgggggtctcttggattatgaagatcggcatcggagtgctcctgacttggattggcttaaactccaaaaatacctcaatgagttttagctgcatagtaatcgggattatcacgctgtacctaggagccgtggttcaggcagatatgggctgtgtcattaactggaagggtaaggaactcaaatgcgggtccggaatcttcgtgacaaatgaggtgcatacctggactgagcagtataagtttcaagccgactctcccaaacggctggctacagccatagcaggcgcttgggaaaacggtgtctgtggcatccgaagcaccactcgcatggagaatcttttgtggaagcagattgccaacgaactgaattacatcctctgggagaacaatattaaactgaccgttgtggtgggggatatcataggagtattagaacagggcaagagaacactgacgccacagcctatggagcttaaatattcatggaagacctgggggaaggcgaaaattgtcactgccgagacacaaaacagttccttcatcattgacggacccaacaccccagaatgccccagcgcttctagggcatggaatgtgtgggaggttgaagactacggctttggtgtgttcacaactaacatctggttgaagctccgggaggtctatacccagtcatgtgatcaccgcctgatgagtgccgctataaaagacgaaagagccgtgcacgcagatatggggtactggatcgagagccagaagaatggatcctggaaactagagaaggcgtcttttattgaagttaagacgtgcacatggcctaaatcgcataccctgtggagcaacggcgtgctcgagtccgacatgatcattccaaagtcactggccggtccgatcagtcagcacaatcataggcccggctaccacactcaaaccgctgggccttggcaccttggaaaattggaactggatttcaactattgcgagggcacaactgtagtcataaccgagaattgtgggacacgtggaccatctttacggacgaccactgtgagcggcaagctcattcatgaatggtgctgtcgatcctgcacactgccccctcttagatacatgggtgaggacgggtgttggtatggaatggaaatcaggccaatcaacgagaaagaagagaatatggtgaagtcactggtcagcgccggctctggtaagatggataactttaccatgggcattttgtgcctcgcaatcctgttcgaggaagttatgcgcgggaaattcggaaagaaacacatgattgctggcgtgctatttactttcgtactgctcctgtccgggcagataacatggcgggacatggcccatacccttatcatgattggaagtaatgcaagcgatagaatgggcatgggtgtgacgtacttggccctgatcgctacttttaagattcagcccttcttagcgctcgggtttttcctgaggaaacttacctctcgcgagaacctgctactcggagtcggcctggccatggcaacaaccttgcaactgccggaagacatcgagcagatggctaatggcatagccttagggctcatgactctgaaacttatcacacagtttgaaacctatcagctgtggacagccttggtgtccctcacttgttcaaacaccattttcacgctgacagttgcttggcgaaccgcaactctaatcctggccggagtgagtcttctccctctgtgccaaagctcgtccatgcggaagaccgattggttgccaatgacagtcgcggctatgggtgtgccccctctgcccttatttattttctctctcaaagacactccaaagcgtagaagctggcctctgaatgagggcgttatggccgtggggcttgtctcaatcctggcaagttccttgctcaggaacgatgtacccatggccggaccactggtggctggcggtctactgatagcatgttacgttattaccgggacgtctgccgaccttacagtggagaaagcggctgacgtcacctgggaagaggaagccgagcagactggagtgagccacaacctcatgatcacagtagatgacgatggcaccatgcgcatcaaggacgatgaaactgagaatattctgacagtgttgttaaaaaccgcactgctcatagtctccggcatctttccgtattcaattcctgccacgctgcttgtttggcatacttggcagaagcagacccaacggagcggggtgctgtgggacgtgcccagtccacccgagacacagaaagctgaattggaggaaggagtctacagaatcaagcagcagggtattttcggcaagacccaagtgggggttggagtacagaaagagggcgtgtttcacacaatgtggcacgtcactaggggtgccgtgctaacccataacgggaagcgactggagcctaattgggcatctgttaaaaaggatctcatctcctacggaggcggctggcgcctgagcgctcagtggcaaaaaggggaagaggtgcaggtcatagccgtggaaccaggaaagaaccccaagaatttccagacgatgcctggtatcttccagacaactaccggcgagattggggcgatcgcccttgactttaaaccgggaacatcgggctcaccaattatcaaccgggaaggtaaggtagtcgggttatatggaaatggcgtggttaccaaaaacggcgggtacgtgtctggaatagcacaaactaatgctgagcccgatggtcctaccccagagctggaagaggaaatgttcaagaaaagaaacctcacaattatggacttgcaccccggcagtgggaagacgaggaagtatctgcctgccatcgtccgtgaggctatcaaacgccggctcagaactctgattcttgcaccgaccagggtggttgccgccgaaatggaggaggctctgaagggattgcccatccgataccagacaaccgcgataaaatccgaacatactggccgggagattgtggatctaatgtgccacgcaacatttaccatgcgcctgctcagcccagtcagagtgcctaattataacttaatcattatggacgaagcccatttcacggatcccgcttctatcgccgcaaggggttacataagcactcgggtagggatgggagaggccgctgcgatttttatgacagccaccccacctggcaccgcagaggctttcccccagtccaatgccccaatccaggacgaggagcgagacatcccggaaagatcatggaacagtggcaatgagtggattactgattttgtggggaagacagtttggttcgtccctagcatcaaagcaggaaacgacattgccaactgtctgcgcaagaatggtaagaaagtgatacaactttctaggaagacctttgatacagaatatcagaaaactcgtctgaacgactgggatttcgtggtcacgaccgacatctccgagatgggcgctaattttaaggccgatcgggtaattgaccccagaaggtgcctcaaaccagtgatcttgacagatgggcccgagcgcgttatcctggcgggacctatgccagtgactgcagcctcagctgcccagcgaagaggccgggtcggtaggaacccccagaaggaaaatgaccaatacattttcaccgggcagcctctcaacaatgatgaggaccacgctcactggacagaagcaaagatgctgcttgacaacataaataccccggagggcatcattccagccctattcgaacccgagcgcgagaaaagtgctgccatcgatggagaataccgtctgaagggcgagagcagaaaaacttttgtggaattgatgcggagaggggacttacctgtttggctggcacataaggtggcgtccgagggaattaaatatacggatcgcaagtggtgcttcgacggtgaacgaaacaatcagatcctcgaggagaacatggatgtcgaaatatggaccaaagagggcgaaagaaagaagctgcggcccaggtggcttgacgcccgcacatactctgatccactggctctcaaagagtttaaggacttcgccgcagggagaaaatcgatcgctttggatctggtgactgaaattggaagggtacctagccacctagcccatcggacccgtaatgcactggacaacctcgtgatgcttcacacatcagagcacggcggtcgcgcctatcgacatgctgttgaggaactgcccgagaccatggaaactttattgctgctcgggctgatgatccttctgacaggcggagcgatgctctttttgatttccggcaaggggatcggaaaaacgagtataggtctgatttgtgtcatcgtgtctagcggcatgttatggatggccgatgtgccactacagtggattgcatccgctatcgtcctggagttctttatgatggttctccttatacctgagccggaaaagcaaagaacaccccaggacaatcagctggcctacgtggtaatcgggattttgactctggccgcaatcgtgacagctaacgagatgggactcctggaaaccaccaagagggatcttggcatgtcaaaagagccaggtgtcgtgtctcctacaagctatctcgacgttgacctgcaccccgccagtgcgtggactttgtacgctgtggccacgaccgtcattacaccaatgctgcggcatactatcgaaaattccaccgcaaacgtgagcttagccgctatagcaaaccaagccgtggttctaatggggctggataagggctggcctatttctaaaatggacctcggagtgccccttctggcgttgggctgctattcacaggtcaatccgctgacactcaccgctgccgtgctgcttttagtcactcactacgcaatcatcgggccaggactgcaggccaaggctacgcgcgaggcccagaaaagaacagcagctggcattatgaagaaccctaccgtggatggtatcatgactatagacctcgatcccgttatttacgactccaagttcgagaaacaattgggacaggtgatgctgctagtactgtgtgccgtgcagctccttctgatgaggaccagttgggcgttgtgcgaagccctgacactcgcaactggaccaatcaccacactgtgggagggcagccccggtaagttttggaatacgaccattgctgtctcgatggccaacatcttccggggctcttatttagcaggggctggacttgccttttccataatgaaaagcgttggcactgggaagcgaggaacaggctcacagggtgaaaccctgggggagaaatggaagaagaaactcaatcaactaagtagaaaggagttcgatctgtacaaaaagtctggaatcactgaggtggaccgcacagaggccaaagaaggcttgaagaggggtgagaccacgcatcacgcggtctcccggggcagcgctaaactgcagtggtttgtggaacgtaacatggtaattcctgaggggagagtgatcgatctcggatgtggcagagggggatggtcatattactgcgcaggccttaagaaggttaccgaagtgcgcggttatacaaaagggggaccgggccacgaggagcccgtcccaatgagtacttacggctggaatattgtgaagctgatgagcgggaaagacgtcttctatttgcctcccgaaaagtgtgataccctgctctgcgacatcggagagtcctctcctagcccaacagtggaagagtcccggactattcgagttttaaaaatggtagagccctggctgaagaacaatcagttctgtatcaaggtgcttaacccttacatgccaaccgtcatagaacatctggagagactacagaggaaacacggtggcatgctcgtgcgcaatcccctgtcacggaactctacacatgaaatgtactggattagtaatgggaccggaaacatcgtttcgagcgtgaatatggtctccagattgctgctcaaccgttttactatgacgcacaggcggccgacaatcgagaaggatgtggaccttggcgccggtacccgccacgtaaacgctgaacctgagactccaaatatggacgtgattggggagcgaataaaaagaatcaaggaagaacactcttcaacctggcactatgatgacgaaaacccctacaaaacatgggcctatcatggaagctacgaggttaaggcaacgggctccgccagttctatgattaatggcgtcgtgaagctgttaaccaaaccttgggatgtggtcccaatggttactcaaatggctatgacagacaccactcccttcgggcagcagagggtgtttaaggaaaaagtagatacacggaccccgcgccctatgcccggaacaagaaaggtgatggagatcactgcggagtggctgtggaggaccttgggtcgaaacaaacggccacgtctctgcacgagagaagagttcaccaagaaggtccgcacaaatgccgcaatgggcgctgtgtttactgaagagaaccaatgggacagcgccagggcagccgttgaagatgaggagttctggaaactggtggaccgggaaagagagctacacaaacttgggaaatgtggatcatgcgtctataatatgatgggcaagcgcgagaagaagctgggtgagtttgggaaagctaagggatccagggccatttggtacatgtggctcggcgcgcgatatctggagttcgaagcattgggctttctgaacgaggatcattggttcagtcgggaaaatagctactctggggtggagggagaaggtctccacaaacttggctacatcctgagagacatatccaaaatccctgggggagccatgtatgctgatgacaccgccggctgggacacaaggattactgaggatgacttacacaacgaggaaaagatcacccagcagatggatcccgagcatcgccagctggcaaatgctatttttaaattgacgtaccaaaacaaggtagttaaagtgcagcgtccaacacccaagggtaccgtcatggacatcatatcacggaaggatcagagagggagcggacaggtgggcacttatggcctcaatacattcaccaacatggaagcccaactggtgaggcagatggagggggaaggagtcctatcgaaagttgaccttgagaatcctcatctgctcgagaagaaaattactcagtggctggaaaccaagggtgtggagcgcttgcgacggatggctatctctggcgatgactgcgtagtgaaaccaatcgatgacagatttgccaacgcattactggcgctcaacgatatggggaaggtcaggaaggacattccgcagtggcaacccagtaaaggatggcatgattggcaacaggtgcctttctgttcccaccacttccatgaacttataatgaaggacggccgcaaactggttgtgccatgcagaccccaggacgagctaatcggtcgggccaggattagccaaggggctggatggtcactgaaggaaacagcctgtctcggcaaagcatacgctcagatgtggtccttgatgtattttcaccgtcgagatctgcgccttgcctctaatgcaatctgcagcgccgtccctgtgcattgggtaccaacgagtagaaccacttggtccattcacgcgcatcaccagtggatgacaaccgaggacatgctgactgtttggaaccgggtgtggatcgaggataatccctggatggaagacaagacacctgtcaccacgtgggaggatgtgccgtacctcggcaagagggaagaccaatggtgtgggagcttaataggactgacatctcgcgctacctgggcccagaacatcttgactgcaattcagcaggttagatcactgatcggtgatgaggagttcctcgactatatgccaagtatgaaacggtttaggaaggaagaggaatccgagggcgccatttggtga

SEQ ID NO: 15390 - RNA, 9873 nt, synthetic construct
  misc_feature 1..9873: note = derived and/or modified CDS sequence (opt3) from DENV-3__FJ744739__SS-prME
  source 1..9873: mol_type = other RNA
accagcctgtgcctcatgatgatgcttcccgcaacactggctttccacttgacttccagggacggcgaacctaggatgatcgtggcaaagaacgaacgggggaaatctttactgtttaagacggtctcaggaattaatatgtgtaccctaatagccatggatctcggtgagatgtgcgacgatacagttacttacaaatgtccactgatcgcggaagtggagccggaagacattgattgctggtgtaaccttaccagtacatgggtgacctatggcacttgcaatcaggctggggagcatcgccgagacaagcgtagcgtggccctggcaccccacgtcggaatgggcttggatacaaggacccagacgtggatgtccgccgagggtgcttggagacaggtggaaaaagttgagacttgggcactccggcatcctgggttcaccatcctggccctgtttctcgctcactacattggaacatctttaactcagaaggtggtcatcttcatactgcttatgttggtgaccccatcgatgacaatgcgctgtgtaggcgttggcaacagggactttgtggaagggctgtcaggagccacctgggtcgatgtggtgctagagcatggtggctgcgtcacgactatggcgaagaataaacccacactcgacatcgagctgcagaagaccgaagcaactcagcttgccacactgaggaaattgtgtattgaggggaagatcaccaacattacgaccgatagccggtgccctacacagggagaagctatcctcccagaggaacaggaccagaattatgtttgtaaacacacttacgtggatcgcggctggggtaacgggtgcggactgttcggcaagggcagtttagtaacctgcgccaagtttcaatgtctggagcccatagaggggaaagtggtccagcacgaaaatctcaagtatacagtgattatcactgttcataccggagaccagcaccaggtgggtaacgacacacaaggcgtcaccgtggagattactcctcaggcatccacggtagaagctatccttccagagtacgggacactgggattggaatgctctccgcgaaccggcctagatttcaatgagatgatcctgctcactatgaaaaacaaggcctggatggttcatagacagtggtttttcgacctgccccttccttggaccagcggtgcgacaaccgagactccaacatggaataggaaagaactgttggtgacgtttaagaacgcccacgccaagaaacaagaggtcgtggtcctcgggtcccaggaaggcgctatgcacaccgccctgactggagctacagagattcaaaattcaggcgggaccagtatattcgccggacatttaaagtgtcggctgaaaatggataagctagaactcaaaggtatgagctatgcaatgtgcctgaacacatttgtgcttaagaaagaggtttctgagactcagcacggcaccatcttgattaaggtggaatacaagggggaggacgccccctgtaaaatccctttctccacggaagatggacaaggcaaggctcataacggtcgtctgataaccgcgaatccagtagtcaccaagaaggaggagcccgtgaacattgaagcagagccgcctttcggggaatcaaatatcgttatcggcattggagacaaagccctcaagatcaactggtacaagaaaggcagcagtattgggaagatgtttgaggctactgcccgcggagcaagaaggatggccatactgggtgataccgcttgggacttcggctctgtaggcggggtccttaattccctggggaaaatggtgcaccagatctttggtagcgcctatacagcattgttctcgggggtatcttggattatgaagatcggcatcggagtgctcctgacttggattggcttaaactccaaaaatacctcaatgagttttagctgcatagttatcgggattatcacgctgtacctaggagcggtcgtgcaggctgatatgggctgtgtgattaactggaagggtaaggaactcaaatgcgggtccggaatcttcgtcacaaatgaggttcatacctggactgagcagtataagtttcaagccgactctcccaaacggctggcaacagccatagctggcgcctgggaaaacggtgtgtgtggcatccgaagcaccactcgcatggagaatcttttgtggaagcagattgcaaacgaactgaattacatcctctgggagaacaatattaaactgaccgtggtagtcggggatatcataggagtgttagaacagggcaagagaacactgacgccacagcctatggagcttaaatattcatggaagacctgggggaaggctaaaattgttactgccgagacacaaaacagttccttcatcattgacggacccaacaccccagaatgccccagcgcgtctagggcctggaatgtgtgggaggtcgaagactacggctttggtgtgttcacaactaacatctggttgaagctccgggaggtttatacccagtcatgtgatcaccgcctgatgagtgctgcaataaaagacgaaagagccgtgcacgctgatatggggtactggatcgagagccagaagaatggatcctggaaactagagaaggcctcttttattgaagtaaagacgtgcacatggcctaaatcgcataccctgtggagcaacggcgtcctcgagtccgacatgatcattccaaagtcactggcaggtccgatcagtcagcacaatcataggcccggctaccacactcaaaccgcggggccttggcaccttggaaaattggaactggatttcaactattgcgagggcacaactgtggtgataaccgagaattgtgggacacgtggaccatctttacggacgaccactgtcagcggcaagctcattcatgaatggtgctgtcgatcctgcacactgccccctcttagatacatgggtgaggacgggtgttggtatggaatggaaatcaggccaatcaacgagaaagaagagaatatggttaagtcactggtgagcgccggctctggtaagatggataactttaccatgggcattttgtgcctcgctatcctgttcgaggaagtaatgcgcgggaaattcggaaagaaacacatgattgccggcgtgctatttactttcgtcctgctcctgtccgggcagataacatggcgggacatggcacatacccttatcatgattggaagtaatgctagcgatagaatgggcatgggtgtgacgtacttggccctgatcgcaacttttaagattcagcccttcttagccctcgggtttttcctgaggaaacttacctctcgcgagaacctgctactcggagttggcctggctatggcgacaaccttgcaactgccggaagacatcgagcagatggccaatggcatagcattagggctcatgactctgaaacttatcacacagtttgaaacctatcagctgtggacagctttggtgtccctcacttgttcaaacaccattttcacgctgacagtcgcctggcgaaccgccactctaatcctggctggagtgagtcttctccctctgtgccaaagctcgtccatgcggaagaccgattggttgccaatgacagttgcagccatgggtgtgccccctctgcccttatttattttctctctcaaagacactccaaagcgtagaagctggcctctgaatgagggcgtcatggcggtagggcttgtgtcaatcctggctagttccttgctcaggaacgatgttcccatggccggaccactggtggcaggcggtctactgatagcctgttacgtcattaccgggacgtctgctgaccttacagtggagaaagcagccgacgtaacctgggaagaggaagcggagcagactggagtgagccacaacctcatgatcacagtcgatgacgatggcaccatgcgcatcaaggacgatgaaactgagaatattctgacagttttgttaaaaaccgctctgctcatagtgtccggcatctttccgtattcaattcctgccacgctgcttgtgtggcatacttggcagaagcagacccaacggagcggggtcctgtgggacgtgcccagtccacccgagacacagaaagcagaattggaggaaggagtttacagaatcaagcagcagggtattttcggcaagacccaagtaggggtgggagtccagaaagagggcgtgtttcacacaatgtggcacgttactaggggtgccgtgctaacccataacgggaagcgactggagcctaattgggcttctgtcaaaaaggatctcatctcctacggaggcggctggcgcctgagcgcccagtggcaaaaaggggaagaggtgcaggtaatagcagtcgaaccaggaaagaaccccaagaatttccagacgatgcctggtatcttccagacaactaccggcgagattggggctatcgcccttgactttaaaccgggaacatcgggctcaccaattatcaaccgggaaggtaaggtggttgggttatatggaaatggcgtggtcaccaaaaacggcgggtacgtgtctggaatagcgcaaactaatgccgagcccgatggtcctaccccagagctggaagaggaaatgttcaagaaaagaaacctcacaattatggacttgcaccccggcagtgggaagacgaggaagtatctgcctgcaatcgttcgtgaggctatcaaacgccggctcagaactctgattcttgccccgaccagggtggtcgctgcagaaatggaggaggccctgaagggattgcccatccgataccagacaaccgccataaaatccgaacatactggccgggagattgtggatctaatgtgccacgctacatttaccatgcgcctgctcagcccagtaagagtgcctaattataacttaatcattatggacgaagcgcatttcacggatcccgcatctatcgccgctaggggttacataagcactcgggttgggatgggagaggccgcagccatttttatgacagctaccccacctggcaccgcggaagccttcccccagtccaatgcaccaatccaggacgaggagcgagacatcccggaaagatcatggaacagtggcaatgagtggattactgattttgtcgggaagacagtgtggttcgtgcctagcatcaaagctggaaacgacattgccaactgtctgcgcaagaatggtaagaaagtcatacaactttctaggaagacctttgatacagaatatcagaaaactcgtctgaacgactgggatttcgtagtgacgaccgacatctccgagatgggcgcaaattttaaggccgatcgggttattgaccccagaaggtgcctcaaaccagtgatcttgacagatgggcccgagcgcgtcatcctggctggacctatgccagtgactgccgcgtcagcagcccagcgaagaggccgggttggtaggaacccccagaaggaaaatgaccaatacattttcaccgggcagcctctcaacaatgatgaggaccacgctcactggacagaagccaagatgctgcttgacaacataaataccccggagggcatcattccagctctattcgaacccgagcgcgagaaaagtgcagccatcgatggagaataccgtctgaagggcgagagcagaaaaacttttgtggaattgatgcggagaggggacttacctgtctggctggctcataaggtggcctccgagggaattaaatatacggatcgcaagtggtgcttcgacggtgaacgaaacaatcagatcctcgaggagaacatggatgtagaaatatggaccaaagagggcgaaagaaagaagctgcggcccaggtggcttgacgcacgcacatactctgatccactggcgctcaaagagtttaaggacttcgccgctgggagaaaatcgatcgccttggatctggtgactgaaattggaagggttcctagccacctagcacatcggacccgtaatgctctggacaacctcgtcatgcttcacacatcagagcacggcggtcgcgcctatcgacatgcagtggaggaactgcccgagaccatggaaactttattgctgctcgggctgatgatccttctgacaggcggagccatgctctttttgatttccggcaaggggatcggaaaaacgagtataggtctgatttgtgtgatcgtctctagcggcatgttatggatggctgatgttccactacagtggattgcgtccgccatcgtgctggagttctttatgatggtactccttatacctgagccggaaaagcaaagaacaccccaggacaatcagctggcatacgtggtcatcgggattttgactctggctgccatcgtgacagccaacgagatgggactcctggaaaccaccaagagggatcttggcatgtcaaaagagccaggtgttgtgtctcctacaagctatctcgacgtcgacctgcaccccgcaagtgcttggactttgtacgccgtagcgacgaccgtgattacaccaatgctgcggcatactatcgaaaattccaccgctaacgttagcttagccgcaatagccaaccaagctgtggtcctaatggggctggataagggctggcctatttctaaaatggacctcggagtgccccttctggcattgggctgctattcacaggtcaatccgctgacactcaccgccgcggtgctgcttttagttactcactacgctatcatcgggccaggactgcaggccaaggcaacgcgcgaggcccagaaaagaacagctgccggcattatgaagaaccctaccgtggatggtatcatgactatagacctcgatcccgtaatttacgactccaagttcgagaaacaattgggacaggtgatgctgctagtcctgtgtgcagttcagctccttctgatgaggaccagttgggctttgtgcgaagccctgacactcgcgactggaccaatcaccacactgtgggagggcagccccggtaagttttggaatacgaccattgccgtgtcgatggcaaacatcttccggggctcttatttagctggggccggacttgcattttccataatgaaaagcgtcggcactgggaagcgaggaacaggctcacagggtgaaaccctgggggagaaatggaagaagaaactcaatcaactaagtagaaaggagttcgatctgtacaaaaagtctggaatcactgaggtggaccgcacagaggctaaagaaggcttgaagaggggtgagaccacgcatcacgccgtatcccggggcagcgccaaactgcagtggtttgtggaacgtaacatggttattcctgaggggagagtgatcgatctcggatgtggcagagggggatggtcatattactgcgcgggccttaagaaggtcaccgaagtgcgcggttatacaaaagggggaccgggccacgaggagcccgtcccaatgagtacttacggctggaatattgtgaagctgatgagcgggaaagacgttttctatttgcctcccgaaaagtgtgataccctgctctgcgacatcggagagtcctctcctagcccaacagtagaagagtcccggactattcgagtgttaaaaatggtcgagccctggctgaagaacaatcagttctgtatcaaggtgcttaacccttacatgccaaccgttatagaacatctggagagactacagaggaaacacggtggcatgctcgtgcgcaatcccctgtcacggaactctacacatgaaatgtactggattagtaatgggaccggaaacatcgtctcgagcgtgaatatggtatccagattgctgctcaaccgttttactatgacgcacaggcggccgacaatcgagaaggatgtggaccttggcgctggtacccgccacgttaacgcagaacctgagactccaaatatggacgtcattggggagcgaataaaaagaatcaaggaagaacactcttcaacctggcactatgatgacgaaaacccctacaaaacatgggcctatcatggaagctacgaggtgaaggctacgggctccgccagttctatgattaatggcgtggtcaagctgttaaccaaaccttgggatgttgtgccaatggtaactcaaatggcaatgacagacaccactcccttcgggcagcagagggtgtttaaggaaaaagtcgatacacggaccccgcgccctatgcccggaacaagaaaggtgatggagatcactgccgagtggctgtggaggaccttgggtcgaaacaaacggccacgtctctgcacgagagaagagttcaccaagaaggttcgcacaaatgctgcgatgggcgccgtgtttactgaagagaaccaatgggacagcgcaagggctgccgtcgaagatgaggagttctggaaactggtggaccgggaaagagagctacacaaacttgggaaatgtggatcatgcgtatataatatgatgggcaagcgcgagaagaagctgggtgagtttgggaaagcaaagggatccagggccatttggtacatgtggctcggcgctcgatatctggagttcgaagccttgggctttctgaacgaggatcattggttcagtcgggaaaatagctactctggggttgagggagaaggtctccacaaacttggctacatcctgagagacatatccaaaatccctgggggagcgatgtatgcagatgacaccgccggctgggacacaaggattactgaggatgacttacacaacgaggaaaagatcacccagcagatggatcccgagcatcgccagctggctaatgccatttttaaattgacgtaccaaaacaaggtggtcaaagtgcagcgtccaacacccaagggtaccgtgatggacatcatatcacggaaggatcagagagggagcggacaggtcggcacttatggcctcaatacattcaccaacatggaagcacaactggttaggcagatggagggggaaggagtgctatcgaaagtagaccttgagaatcctcatctgctcgagaagaaaattactcagtggctggaaaccaagggtgtggagcgcttgcgacggatggctatctctggcgatgactgcgtcgtgaaaccaatcgatgacagatttgccaacgctttactggccctcaacgatatggggaaggttaggaaggacattccgcagtggcaacccagtaaaggatggcatgattggcaacaggtgcctttctgttcccaccacttccatgaacttataatgaaggacggccgcaaactggtcgtgccatgcagaccccaggacgagctaatcggtcgggcaaggattagccaaggggcgggatggtcactgaaggaaacagcctgtctcggcaaggcttacgcccagatgtggtccttgatgtattttcaccgtcgagatctgcgccttgcatctaatgctatctgcagcgccgtacctgttcattgggtgccaacgagtagaaccacttggtccattcacgcacatcaccagtggatgacaaccgaggacatgctgactgtctggaaccgggtgtggatcgaggataatccctggatggaagacaagacacctgttaccacgtgggaggatgtgccgtacctcggcaagagggaagaccaatggtgtgggagcttcataggattaacatctcgcgccacctgggcgcagaacatcctgactgctattcagcaggtcagatcattgatcggtgatgaggagtttctggactatatgccaagtatgaaacggttcaggaaggaagaggaatccgagggcgccatttggtga

SEQ ID NO: 15391 - RNA, 9873 nt, synthetic construct
  misc_feature 1..9873: note = derived and/or modified CDS sequence (opt3) from DENV-3__FJ744740__SS-prME
  source 1..9873: mol_type = other RNA
accagcctgtgcctcatgatgatgcttcccgccacactggctttccacttgacttccagagacggcgagcctaggatgatcgtggcaaagaacgaacgggggaaatctttactgtttaagacggcctcaggaattaatatgtgtaccctaatagcgatggatctcggtgagatgtgcgacgatacagtcacttacaaatgtccactgatcgctgaagttgagccggaagacattgattgctggtgtaaccttaccagtacatgggtgacctatggcacttgcaatcaggccggggagcatcgccgagacaagcgtagcgtagcactggccccccacgtgggaatgggcttggatacaagaacccaaacgtggatgtccgctgagggtgcatggaggcaggtcgaaaaagtggagacttgggccctccggcatcctgggttcaccatcctggctctgtttctcgcccactacattggaacatctttaactcagaaggttgtgatcttcatactgcttatgttggtcaccccatcgatgacaatgcgctgtgtgggcgtaggcaacagagactttgttgaagggctgtcaggagcgacctgggtggatgtcgtgctagagcatggtggctgcgtgacgactatcgcaaagaataaacccacactcgacattgagctgcagaagaccgaagccactcaacttgctacactgaggaaattgtgtatcgaggggaagattaccaacatcacgaccgatagccggtgccctacacagggagaagccatactcccagaggaacaggaccagaattatgtctgtaaacacacttacgttgatcgcggctggggtaacgggtgcggactgttcggcaagggcagtttagtgacctgcgcaaagtttcaatgtctggagcccattgaggggaaagtagtgcagcacgaaaatctcaagtatacagtcatcattactgtgcataccggagaccagcaccaggttggtaacgacacacaaggcgtgaccgtcgagatcactcctcaggcttccacggtggaagccatccttccagagtacgggacactgggattggaatgctctccgcgaaccggcctagatttcaatgagatgattctgctcactatgaaaaacaaggcgtggatggtacatagacagtggtttttcgacctgccccttccttggaccagcggtgccacaaccgagactccaacatggaataggaaagaactgttggttacgtttaagaacgcacacgctaaaaagcaagaggtggtcgtgctcgggtcccaggaaggcgccatgcacaccgctctgactggagccacagagatacagaattcaggcgggaccagtatcttcgcaggacatttaaagtgtcggctgaaaatggataagctagaactcaaaggtatgagctatgccatgtgcctgaacacatttgtccttaagaaagaggtgtctgagactcagcacggcaccattttgatcaaggttgaatacaagggggaggacgctccctgtaaaatacctttctccacggaagatggacaaggcaaggcgcataacggtcgtctgattaccgcaaatccagtggtaacaaaaaaggaggagcccgtcaacatcgaagccgagccgcctttcggggaatcaaatatcgtgattggcgttggagacaaagctctcaagatcaactggtacaagaaaggcagcagtattgggaagatgtttgaggccactgcacgcggagccagaaggatggctatactgggtgataccgcctgggacttcggctctgtggggggagtccttaattccctgggcaaaatggtgcaccagatctttggtagcgcatatacagcgttgttctcgggggtatcttggattatgaagatcggcatcggagtgctcctgacttggattggcttaaactccaaaaatacctcaatgagttttagctgcatagttatcgggattatcacgctgtacctaggagctgtcgtgcaggccgatatgggctgtgtgattaactggaagggtaaggaactcaaatgcgggtccggaatcttcgtcacaaatgaggttcatacctggactgagcagtataagtttcaagcagactctcccaaacggctggccacagctatagccggcgcatgggaaaacggtgtgtgtggcatccgaagcaccactcgcatggagaatcttttgtggaagcagattgctaacgaactgaattacatcctctgggagaacaatattaaactgaccgtggtagtcggggatatcataggagtgttagaacagggcaagagaacactgacgccacagcctatggagcttaaatattcatggaagacctgggggaaggccaaaattgttactgcggagacacaaaacagttccttcatcattgacggacccaacaccccagaatgccccagcgcctctagggcttggaatgtgtgggaggtcgaagactacggctttggtgtgttcacaactaacatctggttgaagctccgggaggtttatacccagtcatgtgatcaccgcctgatgagtgcagccataaaagacgaaagagctgtgcacgccgatatggggtactggatcgagagccagaagaatggatcctggaaactagagaaggcatcttttattgaagtaaagacgtgcacatggcctaaatcgcataccctgtggagcaacggcgtcctcgagtccgacatgatcattccaaagtcactggcgggtccgatcagtcagcacaatcataggcccggctaccacactcaaaccgccgggccttggcaccttggaaaattggaactggatttcaactattgcgagggcacaactgtggtgataaccgagaattgtgggacacgtggaccatctttacggacgaccactgtcagcggcaagctcattcatgaatggtgctgtcgatcctgcacactgccccctcttagatacatgggtgaggacgggtgttggtatggaatggaaatcaggccaatcaacgagaaagaagagaatatggttaagtcactggtgagcgctggctctggtaaggtagataactttaccatgggcattttgtgcctcgccatcctgttcgaggaagtgatgcgcgggaaattcggaaagaaacacatgattgcaggcgtcctatttactttcgtgctgctcctgtccgggcagataacatggcgggacatggctcatacccttatcatgattggaagtaatgccagcgatagaatgggcatgggtgttacgtacttggcactgatcgccacttttaagattcagcccttcttagctctcgggtttttcctgaggaaacttacctctcgcgagaacctgctactcggagtgggcctggcgatggccacaaccttgcaactgccggaagacatcgagcagatggcaaatggcatagctttagggctcatgactctgaagcttatcacacagtttgaaacctatcagctgtggacagccttggtctccctcacttgttcaaacaccattttcacgctgacagtggcctggcgaaccgctactctaatcctggcaggagttagtcttctccctctgtgccaaagctcgtccatgcggaagaccgattggttgccaatgacagtggccgcgatgggtgtcccccctctgcccttatttattttctctctcaaagacactccaaagcgtagaagctggcctctgaatgagggcgtaatggctgtggggcttgtttcaatcctggccagttccttgctcaggaacgatgtgcccatggcaggaccactggtcgccggcggtctactgatagcttgttacgtgattaccgggacgtctgcagaccttacagtagagaaagccgcggacgtgacctgggaagaggaagctgagcagactggagtcagccacaacctcatgatcacagttgatgacgatggcaccatgcgcatcaaggacgatgaaactgagaatattctgacagtgttgttaaaaaccgccctgctcatagtgtccggcatctttccgtattcaattcctgcaacgctgcttgtctggcatacttggcagaagcagacccaacggagcggggtgctgtgggacgttcccagtccacccgagacacagaaagccgaattggaggaaggagtatacagaatcaagcagcagggtattttcggcaagacccaagtgggggtcggagtgcagaaagagggcgtttttcacacaatgtggcacgtgactaggggtgctgtcctaacccataacgggaagcgactggagcctaattgggcctctgtgaaaaaggatctcatctcctacggaggcggctggcgcctgagcgcacagtggcaaaaaggggaagaggtacaggtcatagctgtggaaccaggaaagaaccccaagaatttccagacgatgcctggtatcttccagacaactaccggcgagattggggccatcgcgcttgactttaaaccgggaacatcgggctcaccaattatcaaccgggaaggtaaggttgtggggttatatggaaatggcgtcgtgaccaaaaacggcgggtacgtttctggaatagcccaaactaatgcagagcccgatggtcctaccccagagctggaagaggaaatgttcaagaaaagaaacctcacaattatggacttgcaccccggcagtgggaagacgaggaagtatctgcctgctatcgtgcgtgaggccatcaaacgccggctcagaactctgattcttgctccgaccagggtcgtggcagccgaaatggaggaggccctgaagggattgcccatccgataccagacaaccgctataaaatccgaacatactggccgggagattgtagatctaatgtgccacgcgacatttaccatgcgcctgctcagcccagtgagagttcctaattataacttaatcattatggacgaagcacatttcacggatcccgcctctatcgctgccaggggttacataagcactcgggtcgggatgggagaggcagccgctatttttatgacagcgaccccacctggcaccgccgaagcattcccccagtccaatgctccaatccaggacgaggagcgagacatcccggaaagatcatggaacagtggcaatgagtggattactgattttgtggggaagacagtgtggttcgtccctagcatcaaagccggaaacgacattgcaaactgtctgcgcaagaatggtaagaaagtaatacaactttctaggaagacctttgatacagaatatcagaaaactcgtctgaacgactgggatttcgtggttacgaccgacatctccgagatgggcgccaattttaaggctgatcgggtgattgaccccagaaggtgcctcaaaccagtcatcttgacagatgggcccgagcgcgtgatcctggccggacctatgccagttactgcggcatcagccgctcagcgaagaggccgggtgggtaggaacccccagaaggaaaatgaccaatacattttcaccgggcagcctctcaacaatgatgaggaccacgcccactggacagaagctaagatgctgcttgacaacataaataccccggagggcatcattccagcactattcgaacccgagcgcgagaaaagtgccgctatcgatggagaataccgtctgaagggcgagagcagaaaaacttttgtcgaattgatgcggaggggggacttacctgtgtggctggcccataaggtagcatccgagggaattaaatatacggatcgcaagtggtgcttcgacggtgaacgaaacaatcagatcctcgaggagaacatggatgtggaaatatggaccaaagagggcgaaagaaagaagctgcggcccaggtggcttgacgcgcgcacatactctgatccactggccctcaaagagtttaaggacttcgctgccgggagaaaatcgatcgcattggatctggttactgaaattggaagggtccctagccacctagctcatcggacccgtaatgccctggacaacctcgtgatgcttcacacatcagagcacggcggtcgcgcatatcgacatgccgtggaggaactgcccgagaccatggaaactttattgctgctcgggctgatgatccttctgacaggcggagctatgctctttttgatttccggcaaggggatcggaaaaacgagtataggtctgatttgtgtcatcgtttctagcggcatgttatggatggcggatgtgccactacagtggattgcctccgcaatcgtactggagttctttatgatggtgctccttatacctgagccggaaaagcaaagaaccccccaggacaatcagctggcttacgtcgtgatcgggattttgactctggccgccatcgttacagcaaacgagatgggactcctggaaaccaccaagagggatcttggcatgtcaaaagagccaggtgtggtctctcctacaagctatctcgacgtagacctgcaccccgctagtgcctggactttgtacgcggtggctacgaccgttattacaccaatgctgcggcatactatcgaaaattccaccgccaacgtgagcttagcagccatagctaaccaagcagtcgtgctaatggggctggataagggctggcctatttctaaaatggacctcggagtcccccttctggccttgggctgctattcacaggtgaatccgctgacactcaccgcggctgttctgcttttagtgactcactacgccatcatcgggccaggactgcaggcaaaggccacgcgcgaggctcagaaaagaacagccgcaggcattatgaagaaccctaccgtagatggtatcatgactatagacctcgatcccgtgatttacgactccaagttcgagaaacaattggggcaggtcatgctgctagttctgtgtgctgtgcagctccttctgatgaggaccagttgggccttgtgcgaagcgctgacactcgccactggaccaatcaccacactgtgggagggcagccccggtaagttttggaatacgaccattgcagtctcgatggctaacatcttccggggctcttatttagccggggcaggacttgctttttccataatgaaaagcgtgggcactgggaagcgaggaacaggctcacagggtgaaaccctgggggagaaatggaagaagaaactcaatcaactaagtagaaaggaattcgatctgtacaaaaagtctggaatcactgaggtagaccgcacagaggccaaagaaggcttgaagaggggtgagaccacgcatcacgccgtgtcccggggcagcgcgaaactgcagtggtttgttgaacgtaacatggtgattcctgaggggagagtcatcgatctcggatgtggcagggggggatggtcatattactgcgctggccttaagaaggtgaccgaagtccgcggttatacaaaagggggaccgggccacgaggagcccgtgccaatgagtacttacggctggaatattgttaagctgatgagcgggaaagacgtattctatttgcctcccgaaaagtgtgataccctgctctgcgacatcggagagtcctctcctagcccaacagtggaagagtcccggactattcgagtcttaaaaatggtggagccctggctgaagaacaatcagttctgtatcaaggttcttaacccttacatgccaaccgtgatagaacatctggagagactacagaggaaacacggtggcatgctcgtccgcaatcccctgtcacggaactctacacatgaaatgtactggattagtaatgggaccggaaacatcgtgtcgagcgtaaatatggtgtccagattgctgctcaaccgttttactatgacgcacaggcggccgacaatcgagaaggatgttgaccttggcgcaggtacccgccacgtcaacgccgaacctgagactccaaatatggacgtgattggggagcgaataaaaagaatcaaggaagagcattcttcaacctggcactatgatgacgaaaacccctacaaaacatgggcttatcatggaagctacgaggtgaaggccacgggctccgcaagttctatgattaatggcgtcgttaagctgttaaccaaaccttgggatgtggtaccaatggtgactcaaatggccatgacagacaccactcccttcgggcagcagagggtctttaaggaaaaagtggatacacggaccccgcgccctatgcccggaacaagaaaggttatggagatcactgctgagtggctgtggaggaccttgggtcgaaacaaacggccacgtctctgcacgagagaagagttcaccaagaaggtgcgcacaaatgcggccatgggcgcagtctttactgaagagaaccaatgggacagcgctagggccgcagtggaagatgaggagttctggaaactggtagaccgggaaagagagctacacaagcttgggaaatgtggatcatgcgtttataatatgatgggcaagcgcgaaaaaaagctgggtgagtttgggaaagccaagggatccagggctatttggtacatgtggctcggcgcccgatatctggagttcgaagcgttgggctttctgaacgaggatcattggttcagtcgggaaaatagctactctggggtggagggagaaggtctccacaagcttggctacatcctgagagacatatccaaaatccctgggggagcaatgtatgccgatgacaccgctggctgggacacaaggattactgaggatgacttacacaacgaggaaaagatcacccagcagatggatcccgagcatcgccagctggccaatgcaatttttaaattgacgtaccaaaacaaggtcgtgaaagtgcagcgtccaacacccaagggtaccgtcatggacatcatatcacggaaggatcagagagggagcggacaggttggcacttatggcctcaatacattcaccaacatggaagctcaactggtgaggcagatggagggggaaggagtactatcgaaagtggaccttgagaatcctcacctgctcgagaagaaaattactcagtggctggaaaccaagggtgtcgagcgcttgcgacggatggccatctctggcgatgactgcgtggttaaaccaatcgatgacagatttgctaacgccttactggcactcaacgatatggggaaggtgaggaaggacattccgcagtggcaacccagtaaaggatggcatgattggcagcaggtccctttctgttcccaccacttccatgaacttataatgaaggacggccgcaaactggtggtaccatgcagaccccaggacgagctaatcggtcgggcgaggattagccaaggggccggatggtcactgaaggaaacagcttgtctcggcaaagcctacgcacagatgtggtccttgatgtattttcaccgtcgagatctgcgccttgcttctaatgccatctgcagcgcagttcctgtgcattgggtcccaacgagtagaaccacttggtccattcacgcccatcaccagtggatgacaaccgaggacatgctgactgtgtggaaccgggtttggatcgaggataatccctggatggaagacaagacacctgtgaccacgtgggaggatgtcccgtacctcggcaagagggaagaccaatggtgtgggagcttaataggactgacatctcgcgcgacctgggctcagaacatcttgactgccattcagcaggtgagatcactgatcggtgatgaggagttcctcgactatatgccaagtatgaaacggtttaggaaggaagaggaatccgagggcgcaatttggtga

SEQ ID NO: 15392 - RNA, 9873 nt, synthetic construct
  misc_feature 1..9873: note = derived and/or modified CDS sequence (opt3) from DENV-3__GQ868593__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccacatatcgcggaagttgagccggaagacattgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccatcctcgccctgtttctggctcattacattggcacatctctcactcagaaggttgtgatcttcatattactgatccttgtcaccccatcgatggccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccatattgccagaggaacaggaccagaattatgtctgtaaacacacatacgttgatcgcggttgggggaacggatgcggcctcttcggcaaggggagtctggtgacttgcgcaaagtttcaatgtttagagtccattgagggaaaagtagtgcagcatgaaaatctgaagtataccgtcatcattacagtgcacactggtgaccagcatcaggttggcaacgagacccaaggggtgacagctgaaatcaccccccaggcctctactgtcgaggcgatcctccctgaatacggaacgcttggcctggagtgcagcccacgaacaggtttggacttcaatgagatgattctactgaccatgaaaaacaaggcctggatggtgcacagacagtggtttttcgatctcccgctgccctggacttccggggcaaccacagaaacccctacttggaataggaaagagcttctggtaacatttaagaacgctcacgccaaaaagcaagaagttgtggtcttgggctcacaggagggagctatgcatacggccctcaccggcgcaactgaaatacagaatagtgggggaacaagcatcttcgccggtcacctgaagtgtcggttaaaaatggacaagctggagctaaaaggcatgtcttatgctatgtgcctcaacacctttgtgctgaagaaagaggtctccgaaacacagcatgggactattcttatcaaggtggagtacaagggagaagatgcgccatgtaaaatacccttctcaaccgaggacggccaaggtaaggcacacaacgggcgtttgattacggccaatcctgttgtgaccaaaaaggaggaaccagtaaacatcgaggctgaacccccgttcggcgagagcaatatcgtcattggaatcggcgataaagccctgaagattaactggtacaagaaagggagttctataggaaagatgtttgaagcaacagcccgcggtgctagaaggatggccatcctcggcgacactgcatgggatttcgggtccgtgggaggcgttctgaatagccttggtaaaatggtgcatcagatttttgggtcggcgtataccgctctgttctctggcgtctcctggatcatgaagatcggaattggcgtgttgctcacatggatagggctgaactcaaaaaatactagtatgagcttttcctgcatcgccattggaatcattaccttatacctgggcgcagtagtgcaggccgacatgggttgtgttatcaactggaaggggaaggagctaaaatgcggatctggcatattcgtcacgaatgaggtgcacacatggaccgaacagtataagtttcaagctgatagccctaaacggctcgccactgcaatcgctggtgcctgggagaacggcgtgtgtgggattcgatcaacaacccgcatggaaaatctgctttggaagcagatcgcgaacgagttgaattacattctgtgggaaaacaatatcaaactcactgtcgttgtgggagacataattggcgtgctggagcaggggaagagaaccttaacaccccagccaatggagctgaaatatagttggaagacgtggggaaaggccaaaatcgtaaccgctgaaactcaaaactccagcttcattatcgatggccctaacacacccgagtgcccatctgcatcaagggcctggaatgtctgggaagtggaggactacggttttggggttttcaccacaaacatatggcttaagttgcgggaagtgtatactcagctctgtgaccaccgcctgatgagtgctgccgtcaaagatgagagagcagtgcatgcggacatgggatactggatcgagagccagaagaatggctcctggaaactagaaaaggcctctctgattgaggttaagacctgcacgtggcccaaatcgcacacactctggagcaacggtgtgctggaatccgatatgatcattcctaagtcacttgctggcccaatcagtcagcataatcacaggccggggtaccacacccaaactgccggaccctggcatttgggcaaactggagttagactttaactattgcgaggggaccacagtagtcataactgaaaattgtggaacccgtggcccttctctccggacaacgaccgtgagcggtaagctgattcacgagtggtgctgtcgatcctgcactcttccacccctgagatacatgggggaagatggatgttggtatggcatggagatcaggcctatcaacgaaaaagaggagaatatggtgaagtcattggcaagcgctggttctggcaaggtcgacaacttcacaatgggggttctctgcctggccattctatttgaagaggtgatgcgcggaaaattcggcaagaaacatatgatcgcaggggtactgctcaccttcgtgctgcttttgtccggacagattacttggcgggatatggcccacacactgataatgatcggcagtaatgctagcgacagaatgggtatgggggtcacctacttagcgctcattgccacgtttaagatccagccattcctggcacttggatttttcctgaggaaactaacttctcgcgaaaacctcctgttgggcgtgggcctggctatggccaccacattacaactccccgaggatattgaacagatggccaatgggatcgctctgggacttatggcactgaagttgataacccagtttgagacttatcagctctggacagccctggtttccctaacctgttcaaacacaatcttcactctgaccgtggcgtggcgaacggctacacttattctcgccggtgtcagtctgttgccggtgtgccaaagctcgtccatgcggaagaccgactggctgcctatggcagttgccgctatgggcgtgccacccttacctctctttatcttctctctgaaagatactcttaagcgtagaagctggcccctgaatgagggggtcatggcagtaggattggtgtcaattctcgccagttccctgctaaggaacgacgttccaatggcgggccctctggtggctggtgggcttctcatcgcctgttacgtcataaccggaacatctgcagatctgactgtggaaaaagccgctgacgtaacctgggaggaagaggccgaacagacgggcgtgagccataacttgatgattacagtcgacgatgacggcaccatgcgcatcaaggatgacgagactgagaatatcttaacagttctgctcaaaaccgcactgcttattgtgtccgggatatttccctattcaatcccagctactctgttggtgtggcacacatggcagaagcagacccaacggagcggagtcctatgggatgtgccgagtcctcccgaaacgcagaaagccgagctggaagagggtgtttacagaattaagcagcagggcatcttcgggaagactcaagtaggagtgggcgtccagaaagagggtgtgtttcacaccatgtggcatgttacaaggggggcggtgctcacccacaacggaaagcgactggaaccaaattgggcctctgtcaaaaaggaccttatttcctacggcggcgggtggcgcttaagcgcacagtggcaaaaaggagaggaagtgcaggtaatcgctgtcgagcccggtaagaaccctaagaatttccagacaatgccaggcatatttcagactaccacgggggaaatcggagccattgctctggatttcaaacccggcacatcgggttcacctatcattaaccgggaggggaaggtggttggactctatggcaatggcgtggtcactaaaaacgggggatacgtgtctggtatcgcacaaaccaatgccgagccggacggcccaacacccgaattggaggaagagatgttcaagaaaagaaacctgaccataatggatctccatcctgggagtggaaagactaggaagtatctgccagccattgttcgtgaagctatcaaacgccggcttagaaccctgatcttggcgcccacaagggtggtcgcagccgagatggaggaagctctaaagggcctgcctattcgataccagacgactgccaccaaatccgagcacacaggtcgggaaatcgtggacctcatgtgccatgcaacctttactatgcgcttactgagcccggtaagagtgcccaattataaccttataattatggatgaggcccacttcacagacccagcttctatcgcggccagggggtacattagcacccgggttggaatgggcgaagcagctgccatctttatgacggcaactcctcccggcacagccgatgctttcccacagtccaatgcccctatacaggacgaggagcgagacattcccgaaagatcatggaacagtgggaatgagtggatcaccgattttgtcggaaagaccgtgtggttcgtgccaagcatcaaagcgggtaacgacattgcaaactgtctgcgcaagaatggcaagaaagtcatccaactctctaggaagacttttgatacagaatatcagaaaaccaagttgaacgactgggatttcgtagtgacaactgacatttccgagatgggggccaattttaaagctgatcgtgttatagacccgcggagatgcctgaagcctgtgatcctcacggatggacccgagagggtcattctggccggcccaatgcccgtgaccgctgcatcagccgctcagcgccgaggtagagttgggcggaaccctcagaaggaaaatgaccaatacatcttcacaggccagccacttaacaatgatgaggaccacgcccattggactgaagcaaaaatgctactggacaacatcaatacccccgagggaattatacctgcgttgtttgaaccggagagggagaagagtgccgctatcgatggcgaataccgcttaaaaggggagagccgtaagacattcgtggaactgatgagacggggagacctcccagtctggctggcccacaaagtggcatccgagggtattaagtataccgataggaaatggtgcttcgacggcgaacgcaacaatcagatccttgaggagaacatggatgtagaaatttggactaaggagggggaaaagaaaaagctgcgacccagatggctcgacgctcggacgtactctgatcctttggccctgaaagagtttaaggacttcgcagccggaaggaaatcgatcgctctagatctggtgaccgaaataggccgcgttcccagccatctcgcgcacagaacaaggaatgcccttgacaacctggtcatgttacacacttcagagcatggtgggcgggcatatcgtcacgctgtggaggaattgccagagaccatggaaacactgctcctgcttggcctgatgatcctcttgaccggaggcgccatgctgtttttaatttccgggaagggaatcggtaagactagtattggcctaatctgtgtgatagcctctagcgggatgctgtggatggcagatgtccctctccagtggattgcttccgccatcgttcttgagttctttatgatggtgctgttgattcccgagccagaaaaacaacgcacacctcaggacaatcagctggcgtacgtagtgatcggaatactcacgctggctgccatcgtcgcagccaacgagatgggccttctcgaaaccactaagcgagatctgggtatgtcaaaagagccgggggtggtttctcccacaagctatttggacgtggacctgcatccagctagtgcatggaccttatacgccgtcgcgaccacagtaattactcctatgctaagacacacgatcgaaaattccaccgctaacgtgagcctggccgcaattgccaaccaagctgttgtgctcatgggccttgataagggatggcccatctctaaaatggacctgggcgtcccattgctggccctcgggtgctattcacaggtgaatcctctgacacttactgcagctgtcttactgctcgccacccattacgcgataattggacccggcttgcaggccaaggcaacaagggaggctcagaagcggaccgccgcaggtatcatgaaaaacccgactgtggatgggatcatgacgattgacctggatccagttatctacgactccaagttcgagaaacaactaggacaggtgatgctgctcgtactttgtgctgtgcagctgttgctgatgcgcacaagttgggccctctgcgaagccctgaccttagcgactggccctataaccacactttgggagggtagccccggcaagttttggaatactaccattgctgtctcgatggcaaacatcttcagagggtcttatctggccggagctggcctcgccttttccattatgaaaagcgttgggacaggaaagaggggcacgggttcacagggggaaaccctaggagagaagtggaaaaagaaactgaatcaattgagtcggaaggaattcgatctgtacaaaaagtctggcatcactgaggtggaccgaacagaggcaaaagaaggtctcaagagaggcgagataacccgccacgccgtctccagggggagcgctaagcttcagtggtttgtggaacggaacatggtaatcccagagggacgtgtgattgatctgggctgtgggagaggaggctggtcatattactgcgcgggtttgaaaaaggttactgaagtgagggggtatacaaaaggaggccccggccacgaggagcctgtcccgatgagtacctacgggtggaatatcgtgaagctgatgagcggaaaagacgtcttctatctccccccagaaaagtgtgatacgttactgtgcgacattggtgagtcctctcctagccccaccgtggaagagtcccgcacaatccgggttcttaagatggtagagccttggctgaaaaacaatcagttttgtattaaggtgctaaacccatacatgcccactgtcatcgaacatctcgagcgactgcagagaaaacacggcgggatgttggtgaggaatcctctgtcacgcaactctacccatgaaatgtactggataagtaatggaacaggcaacattgtttcgagcgtgaatatggtctcccggctccttctgaacagattcactatgacccaccgtaggccaacaatcgagaaggatgtggacttaggtgccgggacccggcacgtaaacgcagaacccgagactccgaatatggacgtgatcggagagcgcattaaacgaataaaggaagagcataactctacgtggcactatgatgacgaaaatccttacaagacatgggcttatcatggctcatacgaggttaaagccaccggcagcgcatccagtatgatcaacggggtcgtgaagctgttgactaaaccatgggatgtggtccccatggttattcaaatggccatgaccgacacaacgcctttcggacagcagagagtgtttaaggaaaaagtagataccaggactccacggcccatgccgggtacacgcaaggtgatggagatcaccgctgagtggctctggagaactctgggcaggaataagcgacctcggctatgcacacgtgaagagttcaccaaaaaggtcagaacaaacgccgcgatgggggcagtgtttactgaagagaatcaatgggactctgcccgcgctgccgttgaagatgaggagttctggaaacttgtggacagggaacgggagctgcacaagctcggaaaatgtggcagctgcgtctataacatgatgggtaagagagaaaaaaagctgggggagtttggaaaggcaaaaggctcacgcgctatttggtacatgtggttgggcgccaggtatctggagttcgaagctctcgggtttcttaatgaggatcattggttctcccgagaaaacagttacagcggagtggagggtgaaggcctgcacaagttagggtacatcctgcgggacatatctaaaatccccggaggcgccatgtatgcagatgacaccgcgggttgggacacgagaattaccgaggatgacttgcacaatgaggaaaagatcacacagcagatggatccagagcataggcagctcgccaacgctatttttaaactgacttaccaaaataaggtagttaaggtgcagcgccctacccccaaagggacagtcatggacatcatatcccgtaaggatcagcggggatcaggccaggtgggcacttatgggctaaacaccttcacgaatatggaagcccaacttgtgagacagatggagggagaaggtgtcctgagcaaagcagacctcgagaacccacacctgttggagaagaaaattacacagtggttagaaaccaagggcgttgagaggctgaagcgcatggctatctcgggggatgactgcgtggtaaaacccatcgatgaccgatttgccaacgcactccttgccctgaatgatatgggaaaggtgcggaaagacattcctcagtggcaaccatctaagggctggcatgattggcagcaggtcccgttctgtagtcaccactttcatgaactaataatgaaagacggtagaaagctggtggttccctgcaggcctcaggacgagctcatcgggcgcgcgagaatttcccaaggagctggctggagcttgaaggaaactgcctgtctgggcaaagcatacgcccagatgtggtcacttatgtatttccaccggagggatctgcgtctcgcttccaacgccatctgctctgcagtgccagtccattgggtgcccacaagccgaaccacttggagtattcacgctcatcaccagtggatgaccacagaggacatgttaacggtatggaatcgcgtttggatcgaggataacccttggatggaagacaagaccccagtgactacatgggaggatgtcccctacctggggaaaagagaagaccaatggtgtggatccttgataggtctgaccagccgggccacttgggcgcagaatatcctcacagctattcagcaggtgaggtctcttatcggcaacgaggagttcctggattatatgccttcaatgaagcgctttaaaaaggaagaggaaagtgagggggccatttggtga

SEQ ID NO: 15393 - RNA, 9873 nt, synthetic construct
  misc_feature 1..9873: note = derived and/or modified CDS sequence (opt3) from DENV-3__FJ898459__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaaccataggcccgggtatcacacacaaactgctggaccttggcaccttggcaagttggagctggactttaattactgcgaggggaccacagtcgtgattacggaaaactgtggaacccgtggcccaagtttacggactacaaccgtgtctggtaaactcatccatgagtggtgctgtcgaagctgcactctgccccctcttagatatatgggggaagatggatgttggtacggcatggagataaggccaatttccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcacatgatcgctggggtcttctttaccttcgtgctactgctctccggacagattacgtggcgggatatggcccatactctgatcatgattggcagtaatgcaagcgacagaatgggtatgggggttacctatcttgccttgatagctacatttaaagtgcagcccttcctggcgttaggatttttcctcaggaagctgacctctcgcgaaaaccttctgctaggcgtcggcctcgccatggcaactacactgcaattgccggaggatatcgaacagatggctaatgggattgccctgggattaatggccctcaaactgatcacccagtttgagacataccagctttggactgctctgatttccttgacctgttcaaacacgatgttcacactcaccgtggcatggcgaactgccaccctgatcctagcgggtgttagtctgcttcctgtgtgccaaagctcgtccatgcggaagacagactggctcccaatggctgtcgccgcaatgggcgtaccccctctgcccttgtttatattctctctgaaggatactttaaaacgtagaagctggccactcaatgagggggtgatggccgttggactggtgtcaatccttgctagttccctgttgaggaacgacgtccctatggcaggccccctcgtggccggtgggctgctaattgcgtgttatgtaatcaccggaacgtctgctgatctgacagtggaaaaggccgcagacattacctgggaggaagaggccgaacagactggcgtcagccacaaccttatgatcacagttgacgatgacggcaccatgcgcataaaagatgacgagactgagaatattctcacagtgctgttgaagaccgctttactgatcgtgtccggggtctttccatactcaatcccggccacgctcctggtgtggcatacttggcagaaacagacccaacggagcggagttctttgggatgtacctagtcccccagaaacacagaaggcagagctggaagagggtgtgtacagaattaaacagcagggcatattcgggaagacccaagtcggagtgggcgttcagaaggagggtgtgtttcacacaatgtggcacgtcactaggggggctgtgttgacctataacggaaaacgactagaacccaattgggcctctgtaaagaaagacctgatctcctacggcggcgggtggcgcctcagcgcgcagtggcaaaagggagaggaagtccaggtgattgccgttgagcctggtaaaaacccaaagaatttccagacgatgcccggcacattccagactaccacaggggaaatcggagcaattgctctggattttaagcctggcacctcgggttcaccgatcataaaccgggaggggaaagtggtcggactttatggcaatggcgtggttactaagaacgggggatacgtgtctggtatcgcccaaaccaatgctgagccagacggccccacacctgaattagaggaagagatgttcaaaaagagaaacctgacgattatggatctccatccagggagtggaaaaactaggaagtatttgcccgcaatcgtccgtgaagccattaagcgccggctgagaaccctcatcctggcccctacaagggtggtagctgcggagatggaggaagcacttaaaggcctgccgatacgataccagaccactgccacaaagtccgagcacaccggtcgggaaattgtggacttgatgtgccatgctacgtttactatgcgcctactgagccccgttagagtcccaaattataacctcatcatcatggatgaggcccacttcacagaccctgcatctattgccgctagggggtacatcagcacccgggtgggaatgggcgaagcggccgcaatatttatgaccgctactcccccaggcacagccgatgcattccctcagtccaatgcccccattcaggacgaggagcgagacatcccagaaagatcatggaacagtgggaatgagtggattaccgattttgctggaaaaacagtgtggttcgtcccgagcatcaaggccggtaacgacatagcgaactgtttacgcaaaaatggcaagaaggtaattcaactgtctaggaaaacttttgatacggaataccagaagaccaaacttaacgactgggatttcgtggttacaactgacatctccgagatgggggcaaattttaaggccgatcgtgtgatcgaccctcggagatgcctgaaacccgtcattctcaccgatggaccagagagggtgatcttggctggccccatgcctgttacagccgcttcagcagcccagcgccgaggtagagtggggcggaacccacagaaggaaaatgaccaatatattttcaccggccagcccctgaacaatgatgaggaccatgctcactggactgaagccaagatgctcctggacaacataaatacgcctgagggaatcattccggcacttttcgaaccagagagggagaaaagtgcggccatcgatggcgaataccgcctaaagggggagagccgtaaaacctttgtcgaactgatgagacggggagacttgcccgtgtggttagctcacaaggtagcctccgagggtatcaaatatacagataggaagtggtgcttcgacggccagcgcaacaatcagattctggaagagaacatggatgtggagatatggactaaagaaggggagaagaagaaactccgacctagatggctggacgcacggacctactctgatccccttgctctgaaggaatttaaagacttcgccgcaggaaggaagtcgatcgccctcgatttggttacagagattggccgcgtcccaagccatctggctcacagaaccaggaatgcgctagacaacctggtgatgctccatacttcagaacacggtgggcgggcctatcgtcacgcagtggaggagcttcctgaaacaatggagacgctgttattgctgggcctcatgatcctgcttaccggaggcgctatgctgtttctcatttccgggaaaggaatcggtaagactagtataggcttgatctgtgtcattgcctctagcgggatgctgtggatggccgaaatccccttacaatggattgcatccgctatcgttctagagttctttatgatggtgctgctcataccagagcctgaaaagcagcgcacaccgcaggataatcaacttgcctacgtagtgattggaatcctgaccttggcggctattatcgccgcaaacgagatgggcctgctcgaaaccacaaaacgagacctgggtatgtcaaaggagcccggggtcgtgtctccaactagctatcttgatgttgacctccatcctgccagtgcttggacgctgtacgcagtggccaccacagtcataactcccatgttgagacacaccatcgaaaattccacagcgaacgtaagcctggctgccattgcaaaccaggccgtggttttaatgggcctagacaaaggatggccaatctctaagatggatctgggcgtgcctctccttgctctggggtgctactcacaggtcaatcccttgaccctgactgccgcagtgctcctgcttattacgcattatgctatcataggaccgggcttacaggccaaagcgacaagggaggcccaaaagcggaccgcagctggtattatgaagaacccaactgtcgacgggatcatgaccatcgatctggaccctgtgatttacgattccaaattcgagaagcagctcggacaggttatgttgctggtgctatgtgccgtacagctgctccttatgcgcacaagttgggcactgtgcgaagctttgactctggccaccggccccatcacaacgctctgggagggtagcccaggcaaattttggaataccactatagccgtgtcgatggcgaacattttcagagggtcttatctggctggagcaggcttagccttttccatcatgaagagcgtcgggacaggaaaaaggggcaccggttcacaaggggaaactcttggagagaagtggaagaaaaagctgaatcagctcagtcggaaagaattcgacctatacaagaaatctggcattacagaggttgatcgaaccgaggctaaggaaggtctgaaaagaggcgagacgacccaccatgccgtgtcccgcgggagcgcaaagttgcagtggtttgtcgaaaggaacatggtgatccccgagggacgggtaatagacctgggctgtgggcgtggaggctggtcatattactgcgccggtctcaagaaagtgacagaagttagagggtatactaagggaggccctggccacgaggagccggtgcccatgagtacctacgggtggaatatcgtcaaacttatgagcggaaaggatgtgttctacctgccacctgaaaaatgtgacacattgctgtgcgatattggtgagtcctctcccagccctactgtcgaagagtccaggaccatccgcgtgctcaagatggttgagccatggttaaagaacaatcagttctgtattaaagtactgaacccctatatgcctacagtgatcgaacaccttgagcggctgcaacgaaagcatggcgggatgctagtcagaaatccactctcaaggaactctacccacgaaatgtactggattagtaatggaactggcaacatcgtggcttcggttaatatggtgagccgcctgttgctgaaccggtttacgatgacacatagacgtcccaccatagagaaagacgtcgatctcggtgcggggactaggcacgtgaacgccgaaccggagacccctaatatggacgtaattggagagcggatcaagcgcatcaaagaagagcacaactccacatggcattatgacgatgaaaatccatacaagacgtgggcatatcacggctcttacgaggtgaaggctaccggctcagccagctccatgattaacggggttgtcaaacttctgactaagccctgggacgtggtgcctatggtcacacagatggcaatgaccgatactacaccattcggacagcaacgagtttttaaagaaaaggtggacaccagaacacccaggagtatgccgggtactcggcgcgtaatgggcataaccgccgagtggttatggagaacgctggggaggaataaaaagcctcgattgtgcacccgggaggaattcacaaagaaagtgcgtactaacgctgccatgggagcggtctttaccgaggaaaatcagtgggattctgcaaaggccgctgtggaggacgaagatttctggaaactcgttgacagagagcgcgagctgcataagctaggcaaatgtggtagctgcgtgtataacatgatggggaagagggaaaaaaagcttggagagtttggcaaggccaaaggctcacgggcaatctggtacatgtggctgggggctagatacctcgaattcgaggccctgggatttttgaatgaggatcactggttctcccgcgaaaacagttatagcggtgtcgagggcgaagggctgcataagctcggatacattcttagggacatctctaaaattcccggcggtgctatgtatgccgatgacacagcagggtgggacactcgaatcaccgaggatgacctgcacaatgaagagaagataacgcagcagatggatccagagcaccggcaattagcgaacgccatctttaaactgacataccagaataaggtggtaaaggttcagagacctacccccactggaacagtgatggacattatctccaggaaagatcagcgcggctcaggccaagtcgggacctatggattgaacactttcaccaatatggaagctcagctcattcgtcagatggagggtgaaggcgtgctgagcaaggccgacctagagaacccacatcttcccgaaaaaaagatcacacagtggctggagacgaaaggggtggagcggctcaagagaatggcaatatcgggagatgactgcgtcgttaagcctattgatgacaggtttgctaacgccctgttggcattaaatgatatgggcaaagtgcgcaaggacatcccacaatggcagccgtctaaaggttggcacgattggcagcaggtacccttctgtagtcatcacttccacgaactgatcatgaaggacgggcgaaaactcgtggtcccttgccggccacaagacgagcttattggaagagccaggatatcccagggcgcgggctggagcctgcgcgaaaccgcttgtctagggaaggcctacgcacagatgtggtcactgatgtattttcatagacgggatctcaggttggcctccaacgctatctgctctgccgtgcccgttcactgggtgcctactagccgtacaacctggagtattcatgcacaccatcaatggatgactacagaggacatgctgaccgtctggaatcgagtgtggatcgaagataacccatggatggaggacaagacgcccgtaacaacctgggagaatgttccttaccttggaaaacgcgaagatcagtggtgtggttccctgattggcctcactagcagagctacctgggcccagaacatcccgacagcgatacagcaagtgcggtctttaatcgggaatgaggaattcctggactacatgccatcaatgaagaggtttcgcaaagaggaggaaagtgagggagctatttggtga

SEQ ID NO: 15394 - RNA, 9873 nt, synthetic construct
  misc_feature 1..9873: note = derived and/or modified CDS sequence (opt3) from DENV-3__EU482555__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggagtgatcaccctgtatttaggcgccgttgtccaggcagacatgggttgtgtgattaattggaaagggaaggagctgaagtgcggatccggcatcttcgtgactaacgaggtccatacatggaccgaacagtacaaatttcaagccgattctcccaagcggctagctactgccattgcaggtgcttgggagaatggcgtttgtgggatccgaagcaccacacgcatggaaaacctcctgtggaaacagatagccaatgagcttaactatatcttgtgggaaaataacattaagctgacggtggtggtaggagacatcattggcgtcctcgagcaggggaaaagaaccctgactccacagcctatggagttaaagtactcatggaaaacatggggaaaggcgaagatcgtgaccgccgaaatacaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggacctggattttaattattgcgaggggactaccgtggtgattacagagaactgtggaacgcgtggcccaagtttacggaccactacagtctctggtaaactcatccacgaatggtgctgtcgaagctgcaccctgccccctcttagatacatgggggaggacggatgttggtatggcatggaaataaggccaatttccgagaaggaagagaatatggttaaatcactggtgagcgccggttctggcaaggtagataacttcactatgggggtgttgtgcctcgcaatcctgtttgaggaagtcatgcgcggaaagttcggcaaaaagcatatgatcgctggggtgttctttacattcgttctactgctctccggacagattacctggcgggacatggcccacacgctgatcatgattggcagtaatgcaagcgataaaatgggtatgggggtgacttaccttgccttgatagctacctttaagatccagcccttcctggcgttaggatttttcctcagaaaactgacatctagggagaaccttctgctaggcgtcggcctcgccatggcaaccactctgcaattgccggaagacattgagcagatggctaatgggatcgccctgggattaatggccctcaagctgattacacagtttgaaacctatcagctttggacagctctgatctccttgacttgttcaaacaccatgttcacgctcacagtggcatggcgcaccgccactctgatactagcgggtgttagtctgcttcctgtgtgccaaagctcgtccatgcgaaagaccgattggctcccaatggctgtcgccgcaatgggcgtaccccctctgcccttgtttatcttctctctgaaagacacattaaagcggcgtagctggccactcaatgagggggtgatggccgttggactggtgtcaattcttgctagttccctgttgagaaacgatgtccctatggcaggccccctcgtggccggtgggctgctaatcgcgtgttacgtaattactggaacctctgctgacctgacggtggagaaagccgcagacatcacatgggaagaggaagccgagcagaccggcgtcagccataaccttatgataactgttgatgacgatggcacaatgaggattaaggacgatgaaaccgagaatatcctcactgtgctgttgaaaacagctttactgatcgtgtccggggtctttccatactcaattccggccaccctcctggtgtggcacacgtggcagaagcagactcaacgcagcggagttctttgggacgtacctagtcccccagagacccagaaagcagaactggaggaaggtgtgtatcggataaagcagcagggcatcttcgggaagacacaagtcggagtgggcgttcagaaagagggtgtgtttcataccatgtggcacgtcacaagaggggctgtgttgacttacaacggaaagaggctagagcccaattgggcctctgtaaaaaaggatctgatttcctatggcggcgggtggcgactcagcgcgcagtggcaaaaaggagaagaggtccaggtgatcgccgttgaacctggtaagaacccaaagaatttccagaccatgcccggcacgttccagacaactaccggggagattggagcaatcgctctggactttaaacctggcacatcgggttcaccgataatcaaccgcgaagggaaggtggtcggactttacggcaatggcgtggttaccaaaaacgggggatatgtgtctggtattgcccaaactaatgctgagccagatggccccacccctgagttagaagaggaaatgttcaagaaacggaacctgacaatcatggacctccacccagggagtggaaagacgagaaagtacttgcccgcaattgtcagggaggccatcaaacgtcgcctgcggactctcatactggcccctaccagagtggtagctgcggaaatggaggaggcacttaagggcctgccgattaggtatcagacaaccgccactaaatccgaacatacaggtcgagagatcgtggatttgatgtgccacgctacctttacgatgcggctactgagccccgttcgcgtcccaaattacaacctcatcattatggacgaagcccatttcactgatcctgcatctatcgccgctagagggtacataagcacaagggtgggaatgggcgaggcggccgcaatttttatgaccgctacccccccaggcactgccgacgcattccctcagtccaatgcccccatccaggacgaagagcgggatattccagagcgatcatggaacagtgggaatgaatggatcacagactttgctggaaagaccgtgtggttcgtcccgagcataaaagccggtaacgatattgcgaactgtttaagaaagaatggcaagaaagtaatccaactgtctcgcaagacatttgacactgagtatcagaaaacgaagcttaacgattgggacttcgtggttaccacagatatctccgaaatgggggcaaattttaaagccgacagggtgattgatcctcgtcggtgcctgaagcccgtcatcctcactgacggaccagagagagtgattttggctggccccatgcctgttaccgccgcttcagcagcccagaggcgcggtcgagtggggagaaacccacagaaggagaatgatcaatacatattcacaggccagcccctgaacaatgacgaagaccacgctcattggaccgaggccaaaatgctcctggataacatcaatactcctgaaggaattatcccggcacttttcgagccagaacgggagaagagtgcggccatcgacggcgagtataggctaaaaggggaaagccgcaagacgtttgtcgagctgatgcgtagaggagatttgcccgtgtggttagctcacaaagtagcctccgaaggtattaagtacaccgaccggaaatggtgcttcgatggccagaggaacaatcagatactggaggaaaacatggacgtggagatctggacaaaggagggggaaaagaaaaagctccgccctcgatggctggatgcaagaacttattctgacccccttgctctgaaagagtttaaggatttcgccgcaggacggaaatcgattgccctcgacttggttaccgaaatcggcagggtcccaagccacctggctcatcgcacaagaaatgcgctagataacctggtgatgctccacacctcagagcatggtgggagggcctaccggcacgcagtggaagagcttcctgagactatggaaacactgttattgctgggcctcatgattctgcttacgggaggcgctatgctgtttctcatctccgggaagggaataggtaagaccagtatcggcttgatttgtgtcatcgcctctagcgggatgctgtggatggccgagattcccttacaatggatcgcatccgctatagttctagaattctttatgatggtgctgctcattccagagcctgagaaacagcgtactccgcaggacaatcaacttgcctatgtagtgatcggaattctgacattggcggctatcatagccgcaaacgaaatgggcctgctcgagaccaccaagcgcgatctgggtatgtcaaaagaacccggggtcgtgtctccaacaagctaccttgacgttgacctccaccctgccagtgcttggactctgtacgcagtggccacgaccgtcatcacacccatgttgcgacatactattgagaattccaccgcgaacgtaagcctggctgccatcgcaaaccaggccgtggttttaatgggcctagataagggatggccaatttctaaaatggacctgggcgtgcctctccttgctctggggtgctattcacaggtcaatcccttgacactgaccgccgcagtgctcctgcttatcactcactacgctataattggaccgggcttacaggccaaggcgacgagagaagcccaaaagaggacagcagctggtatcatgaaaaacccaaccgtcgatgggatcatgactattgacctggatcctgtgatctatgactccaagttcgagaaacagctcggacaggttatgttgctggtgctatgtgccgtacagctgctccttatgcggaccagttgggcactgtgcgaggctttgacactggccactggccccataaccacactctgggaaggtagcccaggcaagttttggaatacgaccattgccgtgtcgatggcgaacatcttccgcgggtcttacctggctggagcaggcttagccttttccattatgaaaagcgtcgggactggaaagagaggcacaggttcacaaggggagacccttggagaaaagtggaaaaagaaactgaatcagctcagtaggaaggagttcgatctatataaaaagtctggcatcactgaagttgaccggacagaggctaaagagggtctgaagcgaggcgaaaccacgcatcacgccgtgtccagagggaccgcaaagttgcagtggtttgtcgagcgcaacatggtgatacccgaaggaagggtaatcgatctgggctgtgggcggggaggctggagctactattgcgccggtctcaaaaaggtgacagaggttcgtgggtacactaaaggaggccctggccatgaagagccggtgcccatgtcaacctacgggtggaatattgtcaagcttatgagtggaaaagacgtgttctatctgccacctgagaagtgtgatacattgctgtgcgacatcggtgaaagctccccctctcctactgtcgaggaaagcagaaccattagggtgctcaagatggttgagccatggttaaaaaacaatcagttctgtatcaaggtactgaacccctacatgcctacagtgattgagcaccttgaacgcctgcaacggaaacacggcgggatgctagtccgaaatccactctccagaaactcaacccatgagatgtattggatctctaatggaactggcaacatagtggctagtgttaatatggtgtcgaggctgttgctgaaccgctttacgatgacacaccggagacccaccattgaaaaggatgtcgacctcggtgcggggactcgtcatgtgaacgccgagccggaaacccctaatatggacgtaatcggagagaggatcaaacggattaaggaggaacacaacagcacatggcactacgatgacgagaatccatataagacgtgggcataccatggctcctatgaagtgaaagctaccggctctgcctcaagcatgataaacggggttgtcaagcttctgactaaaccctgggatgtggtgcctatggtcacacagatggcaatgaccgacactacaccattcggacagcaacgcgtttttaaggagaaagtggatacccgaacacccagatccatgccgggtactaggcgggtaatgggcatcaccgccgaatggttatggcgcacgctggggagaaataagaagcctaggttgtgcacccgagaggagttcacaaaaaaggtgcggactaacgctgccatgggagcggtctttaccgaagagaatcagtgggacagtgcaaaagccgctgtggaagatgaggacttctggaagctcgttgatcgtgaaagagagctgcacaaactaggcaagtgtggttcttgcgtgtacaacatgatggggaaacgcgagaagaagcttggagaatttggcaaagccaagggcagcagggcaatttggtacatgtggctgggggctcggtatctcgagttcgaagccctgggatttttgaatgaggaccattggttctcaagagagaactcctacagtggtgtcgaaggcgaggggctgcacaaactcggatatatccttcgcgatattagcaagatccccggcggtgctatgtacgccgacgacacagcagggtgggatactaggataaccgaagacgatctgcataatgaggaaaaaatcacgcagcagatggacccagagcaccgacaattagcgaacgccatttttaagctgacatatcagaataaggtggtaaaagttcagcggcctacccccactggaacagtgatggatatcatttctagaaaggaccagaggggctccggccaagtcgggacctacggattgaacactttcaccaatatggaggctcagctcatccgccagatggaaggtgagggcgtgctgtcaaaagccgatctagaaaacccacaccttcccgagaagaaaataacacagtggctggaaacgaagggggtggagcgtctccggagaatggcaattagcggagacgattgcgtcgttaagcctatcgacgataggtttgctaacgccctgttggcattaaatgacatgggcaaagtgcgcaaggatatcccacaatggcagccgtcgaaaggttggcatgactggcagcaggtacccttctgttctcaccatttccacgagctgattatgaaggacgggcgaaaactcgtggtcccttgccggccacaagatgaacttataggaagagccaggatcagtcagggcgcgggctggtccctgcgcgagaccgcttgtctagggaaggcctatgcacagatgtggagcctgatgtactttcacagacgggacctcaggttggcctcaaacgctatttgctccgccgtgcccgttcattgggtgcctacttctcgtacaacctggagcatccacgcacatcaccaatggatgactacagaagatatgctgaccgtctggaatcgagtgtggattgaggacaacccatggatggaagataagacgcccgtaacaacctgggagaatgttccttaccttggaaaacgcgaggaccagtggtgtggtagtctgatcggcctcacttccagagctacctgggcccagaacataccgacagcgatccagcaagtgcggagcttaattgggaatgaagagttcctggattatatgccatctatgaagaggtttcgcaaagaagaggagtcagaaggagctatctggtga

SEQ ID NO: 15395 - RNA, 9873 nt, synthetic construct
  misc_feature 1..9873: note = derived and/or modified CDS sequence (opt3) from DENV-3__EU529692__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggagtgatcaccctgtatttaggcgccgttgtccaggcagacatgggttgtgtgattaattggaaagggaaggagctgaagtgcggatccggcatcttcgtgactaacgaggtccatacatggaccgaacagtacaaatttcaagccgattctcccaagcggctagctactgccattgcaggtgcttgggagaatggcgtttgtgggatccgaagcaccacacgcatggaaaacctcctgtggaaacagatagccaatgagcttaactatatcttgtgggaaaataacattaagctgacggtggtggtaggagacatcattggcgtcctcgagcaggggaaaagaaccctgactccacagcctatggagttaaagtactcatggaaaacatggggaaaggcgaagatcgtgaccgccgaaatacaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggacctggattttaattattgcgaggggactaccgtggtgattacagagaactgtggaacgcgtggcccaagtttacggaccactacagtctctggtaaactcatccacgaatggtgctgtcgaagctgcaccctgccccctcttagatacatgggggaggacggatgttggtatggcatggaaataaggccaatttccgagaaggaagagaatatggttaaatcactggtgagcgccggttctggcaaggtagataacttcactatgggggtgttgtgcctcgcaatcctgtttgaggaagtcatgcgcggaaagttcggcaaaaagcatatgatcgctggggtgttctttacattcgttctactgctctccggacagattacctggcgggacatggcccacacgctgatcatgattggcagtaatgcaagcgataaaatgggtatgggggtgacttaccttgccttgatagctacctttaagatccagcccttcctggcgttaggatttttcctcagaaaactgacatctagggagaaccttctgctaggcgtcggcctcgccatggcaaccactctgcaattgccggaagacattgagcagatggctaatgggatcgccctgggattaatggccctcaagctgattacacagtttgaaacctatcagctttggacagctctgatctccttgacttgttcaaacaccatgttcacgctcacagtggcatggcgcaccgccactctgatactagcgggtgttagtctgcttcctgtgtgccaaagctcgtccatgcgaaagaccgattggctcccaatggctgtcgccgcaatgggcgtaccccctctgcccttgtttatcttctctctgaaagacacattaaagcggcgtagctggccactcaatgagggggtgatggccgttggactggtgtcaattcttgctagttccctgttgagaaacgatgtccctatggcaggccccctcgtggccggtgggctgctaatcgcgtgttacgtaattactggaacctctgctgacctgacggtggagaaagccgcagacatcacatgggaagaggaagccgagcagaccggcgtcagccataaccttatgataactgttgatgacgatggcacaatgaggattaaggacgatgaaaccgagaatatcctcactgtgctgttgaaaacagctttactgatcgtgtccggggtctttccatactcaattccggccaccctcctggtgtggcacacgtggcagaagcagactcaacgcagcggagttctttgggacgtacctagtcccccagagacccagaaagcagaactggaggaaggtgtgtatcggataaagcagcagggcatcttcgggaagacacaagtcggagtgggcgttcagaaagagggtgtgtttcataccatgtggcacgtcacaagaggggctgtgttgacttacaacggaaagaggctagagcccaattgggcctctgtaaaaaaggatctgatttcctatggcggcgggtggcgactcagcgcgcagtggcaaaaaggagaagaggtccaggtgatcgccgttgaacctggtaagaacccaaagaatttccagaccatgcccggcacgttccagacaactaccggggagattggagcaatcgctctggactttaaacctggcacatcgggttcaccgataatcaaccgcgaagggaaggtggtcggactttacggcaatggcgtggttaccaaaaacgggggatatgtgtctggtattgcccaaactaatgctgagccagatggccccacccctgagttagaagaggaaatgttcaagaaacggaacctgacaatcatggacctccacccagggagtggaaagacgagaaagtacttgcccgcagtcgtgagggaggccattaaacgtcgcctgcggactctcatcctggcccctaccagagtagtggctgcggaaatggaggaggcacttaagggcctgccgataaggtatcagacaaccgccactaaatccgaacatacaggtcgagagattgttgatttgatgtgccacgctacctttacgatgcggctactgagccccgtccgcgtgccaaattacaacctcatcatcatggacgaagcccatttcactgatcctgcatctattgccgctagagggtacatcagcacaagggtgggaatgggcgaggcggccgcaatatttatgaccgctacccccccaggcactgccgacgcattccctcagtccaatgcccccattcaggacgaagagcgggatatcccagagcgatcatggaacagtgggaatgaatggattacagactttgctggaaagaccgtctggttcgtaccgagcatcaaagccggtaacgatatagcgaactgtttaagaaagaatggcaagaaagtgattcaactgtctcgcaagacatttgacactgagtatcagaaaacgaagcttaacgattgggacttcgttgtgaccacagatatctccgaaatgggggcaaattttaaagccgacagggtcatcgatcctcgtcggtgcctgaagcccgtgattctcactgacggaccagagagagttatcttggctggccccatgcctgtgaccgccgcttcagcagcccagaggcgcggtcgagtcgggagaaacccacagaaggagaatgatcaatacattttcacaggccagcccctgaacaatgacgaagaccacgctcattggaccgaggccaaaatgctcctggataacataaatactcctgaaggaatcattccggcacttttcgagccagaacgggagaagagtgcggccatcgacggcgagtataggctaaaaggggaaagccgcaagacgtttgtggagctgatgcgtagaggagatttgcccgtatggttagctcacaaagtggcctccgaaggtatcaagtacaccgaccggaaatggtgcttcgatggccagaggaacaatcagattctggaggaaaacatggacgttgagatatggacaaaggagggggaaaagaaaaagctccgccctcgatggctggatgcaagaacttattctgacccccttgctctgaaagagtttaaggatttcgccgcaggacggaaatcgatcgccctcgacttggtcaccgaaattggcagggtgccaagccacctggctcatcgcacaagaaatgcgctagataacctggtgatgctccacacctcagagcatggtgggagggcctaccggcacgcagtcgaagagcttcctgagactatggaaacactgttattgctgggcctcatgatcctgcttacgggaggcgctatgctgtttctcatttccgggaagggaatcggtaagaccagtataggcttgatctgtgttattgcctctagcgggatgctgtggatggccgagatccccttacaatggattgcatccgctatcgtgctagaattctttatgatggtactgctcataccagagcctgagaaacagcgtactccgcaggacaatcaacttgcctatgtggtcattggaatcctgacattggcggctattatcgccgcaaacgaaatgggcctgctcgagaccaccaagcgcgatctgggtatgtcaaaagaacccggggtggtttctccaacaagctaccttgacgtggacctccaccctgccagtgcttggactctgtacgcagtcgccacgaccgtaataacacccatgttgcgacatactatcgagaattccaccgcgaacgtgagcctggctgccattgcaaaccaggccgttgtgttaatgggcctagataagggatggccaatctctaaaatggacctgggcgtccctctccttgctctggggtgctattcacaggtgaatcccttgacactgaccgccgcagtcctcctgcttattactcactacgctatcataggaccgggcttacaggccaaggcgacgagagaagcccaaaagaggacagcagctggtattatgaaaaacccaaccgtggatgggatcatgactatcgacctggatcctgttatttatgactccaagttcgagaaacagctcggacaggtgatgttgctggtactatgtgccgtgcagctgctccttatgcggaccagttgggcactgtgcgaggctttgacactggccactggccccatcaccacactctgggaaggtagcccaggcaagttttggaatacgaccatagccgtctcgatggcgaacattttccgcgggtcttacctggctggagcaggcttagccttttccatcatgaaaagcgttgggactggaaagagaggcacaggttcacaaggggagacccttggagaaaagtggaaaaagaaactgaatcagctcagtaggaaggagttcgatctatataaaaagtctggcattactgaagtggaccggacagaggctaaagagggtctgaagcgaggcgaaaccacgcatcacgccgtctccagagggaccgcaaagttgcagtggtttgtggagcgcaacatggtaatccccgaaggaagggtgatagatctgggctgtgggcggggaggctggagctactattgcgccggtctcaaaaaggttacagaggtgcgtgggtacactaaaggaggccctggccatgaagagccggtccccatgtcaacctacgggtggaatatcgtgaagcttatgagtggaaaagacgtcttctatctgccacctgagaagtgtgatacattgctgtgcgacattggtgaaagctccccctctcctactgtggaggaaagcagaaccatcagggttctcaagatggtagagccatggttaaaaaacaatcagttctgtattaaggtgctgaacccctacatgcctacagtcatcgagcaccttgaacgcctgcaacggaaacacggcgggatgctagtgcgaaatccactctccagaaactcaacccatgagatgtattggatttctaatggaactggcaacatcgttgctagtgtgaatatggtctcgaggctgttgctgaaccgctttacgatgacacaccggagacccaccatagaaaaggatgtggacctcggtgcggggactcgtcatgtaaacgccgagccggaaacccctaatatggacgtgattggagagaggatcaaacggatcaaggaggaacacaacagcacatggcactacgatgacgagaatccatataagacgtgggcataccatggctcctatgaagttaaagctaccggctctgcctcaagcatgattaacggggtcgtgaagcttctgactaaaccctgggatgtggtccctatggttacacagatggcaatgaccgacactacaccattcggacagcaacgcgtgtttaaggagaaagtagatacccgaacacccagatccatgccgggtactaggcgggtgatgggcataaccgccgaatggttatggcgcacgctggggagaaataagaagcctaggttgtgcacccgagaggagttcacaaaaaaggtccggactaacgctgccatgggagcggtgtttaccgaagagaatcagtgggacagtgcaaaagccgctgttgaagatgaggacttctggaagctcgtggatcgtgaaagagagctgcacaaactaggcaagtgtggttcttgcgtctacaacatgatggggaaacgcgagaagaagcttggagaatttggcaaagccaagggcagcagggcaatctggtacatgtggctgggggctcggtatctcgagttcgaagccctgggatttttgaatgaggaccattggttctcaagagagaactcctacagtggtgtggaaggcgaggggctgcacaaactcggatatattcttcgcgatatcagcaagattcccggcggtgctatgtacgccgacgacacagcagggtgggatactaggatcaccgaagacgatctgcataatgaggaaaaaataacgcagcagatggacccagagcaccgacaattagcgaacgccatctttaagctgacatatcagaataaggtagttaaagtgcagcggcctacccccactggaacagtcatggatattatctctagaaaggaccagaggggctccggccaagtggggacctacggattgaacactttcaccaatatggaggtgcagctcattcgccagatggaaggtgagggcgtcctgtcaaaagctgatctagaaaacccacaccttcccgagaagaaaatcacacagtggctggaaacgaagggggttgagcgtctccggagaatggccataagcggagacgattgcgtggtaaagcctattgacgataggtttgcaaacgctctgttggccttaaatgacatgggcaaagtgcgcaaggatatcccacaatggcagccgtcgaaaggttggcatgactggcagcaggtccccttctgttctcaccatttccacgagctgatcatgaaggacgggcgaaaactcgtggttccttgccggccacaagatgaacttattggaagagcaaggataagtcagggcgccggctggtccctgcgcgagaccgcgtgtctagggaaggcttatgcccagatgtggagcctgatgtactttcacagacgggacctcaggttggcatcaaacgccatctgctccgctgtgcccgtccattgggtgcctacttctcgtacaacctggagcattcacgcccatcaccaatggatgactacagaagatatgctgaccgtatggaatcgagtttggatcgaggacaacccatggatggaagataagacgcccgtgacaacctgggagaatgtcccttaccttggaaaacgcgaggaccagtggtgtggtagtctgattggcctcacttccagagcaacctgggctcagaacatcccgacagccatacagcaagtgcggagcttaatcgggaatgaagagttcctggattatatgccatctatgaagaggtttcgcaaagaagaggagtcagaaggagcgatttggtga

SEQ ID NO: 15396 - RNA, 9873 nt, synthetic construct
  misc_feature 1..9873: note = derived and/or modified CDS sequence (opt3) from DENV-3__EU482558__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacagattacgtggcgggatatggctcacactctgatcatgattggcagtaataccagcgacagaatgggtatgggggtgacataccttgccttgatagcaacctttaaaatccagcccttcctggccttaggatttttcctcaggaagctgacttctcgcgaaaaccttctgctaggcgtcggcctcgctatggcgacaaccctgcaattgccggaggatattgaacagatggccaatgggatcgcactgggattaatggctctcaaactgattacacagtttgagacttatcagctttggaccgccctgatctccttgacgtgttcaaacacaatattcaccctcactgtggcctggcgaaccgctacactgatcctagcaggtgttagtctgcttcctgtgtgccaaagctcgtccatgcggaagactgactggctcccaatgaccgtcgccgcgatgggcgtaccccctctgcccttgtttattttctctctgaaggatacgttaaaacgtagaagctggccactcaatgagggggtgatggctgttggactggtgtcaatccttgccagttccctgttgaggaacgacgtccctatggcaggccccctcgtggccggtgggctgctaattgcttgttacgtaatcacaggaacctctgcagatctgactgtggaaaaggccgcggacgtcacatgggaggaagaggctgaacagaccggcgttagccataaccttatgataactgtggacgatgacggcacaatgcgcattaaagatgacgagaccgagaatatcctcacggtgctgttgaagactgccttactgatcgtctccgggatttttccatactcaataccggcaaccctcctggtgtggcacacatggcagaaacagacccaacggagcggagttctttgggatgtacctagtcccccagaaacacagaaggccgagctggaagagggtgtgtatagaatcaaacagcagggcattttcgggaagactcaagtcggagtgggcgttcagaaggagggtgtgtttcataccatgtggcacgtcacgaggggggctgtgttgacatacaacggaaaacgactagaacccaattgggcctctgtaaagaaagacctgatctcctatggcggcgggtggcgcctcagcgcacagtggcaaaagggagaggaagtccaggtgattgctgttgagcctggtaaaaacccaaagaatttccagactatgcccggcaccttccagacaaccactggggaaatcggagccatagcgctggattttaagcctggcacctcgggttcaccgatcattaaccgggaggggaaagtggtcggactttacggcaatggcgtggttacaaagaacgggggatatgtgtctggtatcgcccaaacgaatgcagagccagacggccccactcctgaattagaggaagagatgttcaaaaagagaaacctgaccattatggatctccacccagggagtggaaaaacaaggaagtacttgcccgctatcgtccgtgaagccataaagcgccggctgagaaccctcattctggctcctactagggtggtagcagccgagatggaggaagcccttaaaggcctgccgatccgatatcagacaaccgctacgaagtccgagcatactggtcgggaaatcgtggacttgatgtgccacgcgacatttaccatgcgcctactgagccccgttagagtcccaaattacaacctcattatcatggatgaggcacatttcaccgaccctgcctctatagctgccagggggtacattagcactcgggtgggaatgggcgaagcagccgctatctttatgacagcgacccccccaggcacagccgatgcattccctcagtccaatgctcccattcaggacgaggagcgagacatcccagaaagatcatggaacagtgggaatgagtggataactgattttgccggaaaaacggtgtggttcgtcccgagcattaaggcaggtaacgacatcgccaactgtttacgcaaaaatggcaagaaggtaatccaactgtctaggaaaacctttgatacagaatatcagaagactaaacttaacgactgggatttcgtggttaccacagacatttccgagatgggggctaattttaaggccgatcgtgtgatcgaccctcggagatgcctgaaacccgtcattctcaccgatggaccagagagggtgatattggcgggccccatgcctgttactgcagcctcagctgcccagcgccgaggtagagtggggcggaacccacagaaggaaaatgaccaatacatcttcacgggccagcccctgaacaatgatgaggaccacgctcattggaccgaagcaaagatgctcctggacaacattaatacacctgagggaatcatcccggcccttttcgaaccagagagggagaaaagtgctgccattgatggcgaatatcgcctaaagggggagagccgtaaaacttttgtcgaactgatgagacggggagacttgcccgtgtggttagcacacaaggtagcgtccgagggtataaaatacaccgataggaagtggtgcttcgacggccagcgcaacaatcagatcctggaagagaacatggatgtggagatttggacaaaagaaggggagaagaagaaactccgacctagatggctggacgcccggacctattctgatccccttgctctgaaggaatttaaagacttcgccgcaggaaggaagtcgatcgctctcgatttggttactgagattggccgcgtcccaagccacctggcccatagaacaaggaatgcactagacaacctggtgatgctccacacgtcagaacatggtgggaaagcctaccggcacgctgtggaggagcttcctgaaaccatggagactctgttattgctgggcctcatgatcctgcttacaggaggcgcgatgctgtttctcatatccgggaagggaatcggtaagaccagtattggcttgatctgtgtcattgcctctagcgggatgctgtggatggcagaaatccccttacaatggatagcttccgccattgttctagagttctttatgatggtgctgctcatcccagagcctgaaaaacagcgtaccccgcaggataatcaacttgcctatgtagtgattggaatcctgacattggcagctataatcgccgcgaacgagatgggcctgctcgaaactacgaagcgcgacctgggtatgtcaaaagagcccggggtcgtgtctccaaccagctaccttgatgttgacctccaccctgctagtgcctggacactgtacgcagtggccactaccgtcattacacccatgttgcgacataccatcgaaaattccactgctaacgtaagcctggcagccattgcgaaccaggctgtggttttaatgggcctagacaagggatggccaatctctaaaatggatctgggcgtgcctctccttgccctggggtgctattcacaggtcaatcccttgacgctgacagcagccgtgctcctgcttataacccactacgctattatcggaccgggcttacaggccaaggcaactagagaggctcaaaagaggaccgccgcgggtatcatgaaaaacccaacagtcgacgggattatgactatcgatctggaccctgtgatatatgattccaagttcgagaaacagctcggacaggttatgttgctggtgctatgtgccgtacagctgctccttatgcggaccagttgggcactgtgcgaagctttgacactggccacgggccccattaccactctctgggagggtagcccaggcaagttttggaatacaaccatcgcagtgtcgatggctaacattttccgcgggtcttacctggccggagccggcttagcgttttccatcatgaaaagcgtcgggactggaaagagaggcacaggttcacaaggggaaacccttggagagaagtggaaaaagaaactgaatcagctcagtaggaaggaattcgacctatataaaaagtctggcataacggaggttgatcggaccgaggctaaagaaggtctgaagcgaggcgagatcacacatcacgcagtgtccagagggagcgccaagttgcagtggtttgtcgaacgcaacatggtgattcccgagggaagggtaatcgacctgggctgtgggcggggaggctggtcatactattgcgctggtctcaaaaaggtgactgaagttcgtgggtacaccaaaggaggccctggccatgaggagccggtgcccatgagtacatacgggtggaatattgtcaagcttatgagcggaaaagatgtgttctatctgccacctgaaaagtgtgacactttgctgtgcgatatcggtgagtcctctcccagccctaccgtcgaagagtccagaacaattagggtgctcaagatggttgagccatggttaaaaaacaatcagttctgtatcaaggtactgaacccctacatgcctaccgtgatagaacaccttgagcgcctgcaacggaaacacggcgggatgctagtccgaaatccactctcaagaaactctactcatgaaatgtattggattagtaatggaacgggcaacatcgtggcctcggttaatatggtgagcaggctgttgctgaaccgctttacaatgacccaccggagacccactatcgagaaggacgtcgatctcggtgcagggacccgtcatgtgaacgccgaaccggagacacctaatatggacgtaattggagagaggataaaacggatcaaggaagagcacaactccacgtggcactacgacgatgaaaatccatataagacctgggcttaccatggctcttatgaggtgaaagcgactggctcagccagctccatgattaacggggttgtcaagcttctgacaaaaccctgggacgtggtgcctatggtcacccagatggcaatgactgatacaaccccattcggacagcaacgcgtttttaaggaaaaagtggacacacgaactcccagaagtatgccgggtaccaggcgggtaatgggcatcacggctgagtggttatggcgcaccctggggagaaataagaagcctaggttgtgcacacgagaggaattcactaaaaaggtgcggaccaacgccgcaatgggagccgtctttacagaggaaaatcagtgggattctgctaaagccgcggtggaggacgaagatttctggaagctcgttgaccgtgagagagagctgcacaaactaggcaagtgtggtagctgcgtgtacaacatgatggggaaacgcgaaaagaagcttggagagtttggcaaagcaaagggctcaagggccatttggtacatgtggctgggggctcggtatctcgaattcgaggccctgggatttttgaatgaggatcattggttctccagagaaaacagttacagcggtgtcgagggcgaagggctgcacaaactcggatatatccttcgcgacatatctaagatccccggcggtgcaatgtacgctgatgacactgccgggtgggacaccaggattacggaggatgacctgcataatgaagagaaaatcacacagcagatggatccagagcaccgacaattagctaacgccatttttaagctgacctatcagaataaggtggtaaaagttcagcggcctactcccacaggaaccgtgatggacatcatatccagaaaggatcagaggggctcaggccaagtcgggacttacggattgaacaccttcacaaatatggaagcacagctcattcgccagatggagggtgaaggcgtgctgagcaaagcggacctagagaacccacaccttcccgaaaagaaaatcacgcagtggctggagaccaagggggtggagcgtctcaagcggatggccatctcgggagatgactgcgtcgttaaacctattgatgacagatttgctaacgccctgttggcattaaatgatatgggcaaggtgaggaaagacataccacaatggcagccgtctaagggttggcatgattggcagcaggtacccttctgtagtcaccatttccacgaactgatcatgaaagacgggcgcaagctcgtggtcccttgccgaccacaagacgagcttattggacgggctagaatctcccagggcgccggctggagcctgagggaaactgcatgtctagggaaggcctatgcgcagatgtggtcactgatgtactttcaccgcagagatctccggttggcttccaacgccatttgctctgcagtgcccgttcattgggtgcctacaagcaggaccacttggagtatccacgcccatcaccaatggatgacaaccgaggacatgctgacggtctggaatcgtgtgtggatagaagataacccatggatggaggacaaaacacccgtaaccacttgggagaatgttccttaccttggaaagcgagaagatcagtggtgtggttccctgatcggcctcaccagccgcgctacatgggcccagaacattccgactgcaatccagcaagtgagatctttaattgggaatgaggaattcctggactatatgccatcaatgaaacggtttaggaaggaggaggaaagtgagggagctatctggtga

SEQ ID NO: 15397 - RNA, 9873 nt, synthetic construct
  misc_feature 1..9873: note = derived and/or modified CDS sequence (opt3) from DENV-3__EU482563__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcgtcttactgatgcttgtgactccatcgatgaccatgcgctgtgtaggcgttgggaacagagactttgtggaaggattgtcaggtgcgacatgggtcgatgtggtgctggagcacggcgggtgcgtcaccacgatggcaaagaataaacccactctagacatcgagctccagaagacagaagccacccaactggctactcttaggaaactgtgtattgagggaaagatcacaaacattaccacggatagccggtgccctacccagggcgaagccgttttgccagaggaacaggaccagaattatgtgtgtaaacacacatacgtagatcgcggttgggggaacggatgcggcctcttcggcaaggggagtctggtgacttgcgcaaagtttcaatgtttagagcccatcgagggaaaagtcgtgcagtatgaaaatctgaagtacaccgttataattacagtgcatactggtgaccagcaccaggtcggcaacgagacccaaggggtgacagctgaaatcacccctcaggcctccactacggaggcgattctcccagaatatggaacacttggcctggagtgctctccgcgaaccggtttggacttcaatgagatgatcctactgactatgaaaaacaaggcctggatggtacatagacagtggtttttcgatctccccctgccttggaccagcggggcaacaaccgaaactccaacatggaataggaaagagcttctggttacgtttaagaacgctcacgccaaaaagcaagaagtggtcgtgttgggctcccaggagggagctatgcacaccgccctcactggcgcaacagaaatccagaattcagggggaaccagtattttcgccggtcatctgaagtgtcggttaaaaatggacaagctggagctaaaaggcatgagctacgctatgtgcacaaacacttttgtcctcaagaaagaggtgtctgaaacccagcacgggacgatactgatcaaggttgagtacaagggagaagatgcgccctgtaaaattcctttctccaccgaggacggccaaggtaaggcacataacgggcgtcttatcacagccaatccagtggtaactaaaaaggaggaacccgtcaacatagaggctgaaccgcctttcggcgagtcaaatattgtgatcggaatcggcgataacgccttgaaaattaattggtataagaaggggagcagtatcggaaaaatgtttgaagcaaccgcccgcggtgctagaaggatggccattctgggcgacacagcatgggatttcgggtctgttggaggcgtgctcaactccctgggtaagatggtccaccagatatttgggagcgcgtacactgctcttttctcgggcgtgtcttgggtaatgaaaatcggaattggcgtgctgttgacctggatcgggctcaattccaagaacacgtcaatgagttttagctgcatcgccattggaataatcacactgtatttaggcgcagttgtccaggccgacaccggttgtgtgattaattggaaagggaaggagctgaagtgcggatccggcatcttcgtgactaacgaggtccatacatggaccgaacagtacaaatttcaagctgattctcccaagcggctagccactgcaattgctggtgcctgggagaatggcgtttgtgggatccgaagcaccacacgcatggaaaacctcctgtggaaacaggtggcgaatgagcttaactatatattgtgggaaaataacatcaagctgacggtggtagtcggagacattatcggcgtgctcgagcaggggaaaagaaccctgactccacagcctatggagttaaagtactcatggaaaacatggggaaaggccaagattgttaccgctgaaacacaaaacagttccttcatcatagatggccccaatactccagagtgccccagcgcatctagggcctggaacgtgtgggaagtcgaggactatggttttggggtgttcaccacgaatatttggctgaaacttcgggaagtttacacacagttgtgtgaccaccgcctcatgtcagctgccgtgaaggatgagagagcagtacacgcggacatgggatactggatcgagagtcagaaaaacggcagctggaagctggaaaaagcctccctaattgaggtcaagacctgcacttggcctaagtctcataccctgtggtcgaatggtgtgctcgaaagcgatatgatcataccaaaatccctggctggcccgatctcacagcacaactataggcccgggtaccatacacaaactgccggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagattaggccaatctccgaaaaggaggagaatatggtgaaatcactggtaagcgcaggttctggcaaggtggacaacttcacaatgggggtcttgtgcctcgctatactgtttgaagaggtgatgcgcggaaagttcggcaaaaagcatatgattgccggggttttctttaccttcgtgctactgctctccggacagatcacgtggcgggatatggcacacactctgatcatgattggcagtaatgccagcgacagaatgggtatgggggtcacctaccttgctttgatcgcgacatttaaaattcagcccttcctggccttaggatttttcctcaggaagctgacctctcgcgaaaaccttctgctaggcgtgggcctcgcaatggctactacactgcaattgccggaggatatagaacagatggccaatgggatcgccctgggattaatggctctcaaactgattacccagtttgagacatatcagctttggactgcactgatctccttgacctgttcaaacacgattttcacactcaccgttgcctggcgaactgcgaccctgatcctagctggtgtgagtctgcttcctgtctgccaaagctcgtccatgcggaagtctgactggctcccaatgacagtagccgcaatgggcgtgccccctctgcccttgtttatattcagcctgaaggatactttaaaacgtagatcatggccactcaatgagggggttatggccgtgggactggtcagtatccttgcttcctctctgttgaggaacgacgtgcctatggcaggccccctcgtagccggtgggctgctaattgcgtgttacgtgatcaccggaacgagcgctgatctgacagtcgaaaaggccgcagacgttacctgggaggaagaggccgaacagactggcgtgtcccataaccttatgattacagtggacgatgacggcaccatgcgcatcaaagatgacgagactgagaatatactcacagtcctgttgaagaccgctttactgattgtgtcagggatctttccatacagcatcccggccacgctcctggtttggcacacttggcagaaacagacccggagaagtggagtactttgggatgtgccttctcccccagaaacacaaaaggcagagctggaagagggtgtctataggattaaacagcagggcatattcgggaagacccaggtgggagttggcgtgcaaaaggagggtgtctttcatacaatgtggcacgtgactcgaggggctgtattgacctacaacggaaaacgcctagaacccaattgggcctccgtcaagaaagacctgatcagctatggcggcgggtggcggctctcggcgcagtggcagaagggagaggaagtgcaagttattgccgtggagcctggtaaaaacccaaagaatttccagacgatgcccggcacattccagactaccacaggggaaatcggagcaattgctctggattttaagcctggcacctcaggttctccgatcataaacagagaggggaaagtcgtgggactttacggcaatggcgttgtgactaagaacgggggatatgtcagtggtatcgcccagaccaatgctgagccagacggccccacacctgaattagaggaagagatgttcaaaaagaggaacctgacgattatggatctccacccagggtccggaaaaactcgtaagtacttgcccgcaatcgtgcgcgaagccattaagcggagactgaggaccctcatcctggcccctacacgagtagtggctgcggagatggaggaagcacttaaaggcctgccgatacggtatcaaaccactgccacaaagagcgagcataccggtcgcgaaattgttgacttgatgtgccacgctacgtttactatgagactactgtctcccgtcagggtgccaaattacaacctcatcatcatggatgaggcccatttcacagaccctgcaagcattgccgctcgggggtacatctccacccgagtgggaatgggcgaagcggccgcaatatttatgaccgctactcccccaggcacagccgatgcattccctcagtcaaatgcccccattcaggacgaggagagagacatcccagaacgcagttggaacagcgggaatgagtggattaccgattttgctggaaaaacagtctggttcgtaccgtctatcaaggccggtaacgacatagcgaactgtttaaggaaaaatggcaagaaggtgattcagctgtcccgtaaaacttttgatacggaatatcaaaagaccaaacttaacgactgggatttcgttgtgacaactgacatctcagagatgggggcaaattttaaggccgatcgggtcatcgaccctagaaggtgcctgaaacccgtgattctcaccgatggaccagagcgcgttatcttggctggccccatgcctgtgacagccgctagtgcagcccagcgaagaggtcgggtcgggaggaacccacagaaggaaaatgaccagtacattttcaccggccaacccctgaacaatgatgaggaccacgctcattggactgaagccaagatgctcctggacaacataaatacgcctgagggaatcattccggcacttttcgaaccagagcgcgagaaaagcgcggccatcgatggcgaatatcgtctaaagggggagtccagaaaaacctttgtggaactgatgcggaggggagacttgcccgtatggttagctcacaaggtggcctctgagggtatcaaatacacagatcgcaagtggtgcttcgacggccagcgaaacaatcagattctggaagagaacatggatgttgagatatggactaaagaaggggagaagaagaaactcagacctcggtggctggacgcaaggacctattcggatccccttgctctgaaggaatttaaagacttcgccgcaggacgcaagagcatcgccctcgatttggtcacagagattggcagagtgccatcacacctggctcataggacccggaatgcgctagacaacctggtgatgctccacacttccgaacatggtgggaaagcctaccgtcacgcagtcgaggagcttcctgaaacaatggagacgctgttattgctgggcctcatgatcctgcttaccggaggcgctatgctgtttctcattagtgggaagggaatcggtaagacttctataggcttgatctgtgttattgccagctccgggatgctgtggatggccgaaatccccttacagtggattgcatcagctatcgtgctagagttctttatgatggtactgctcataccagagcctgaaaaacaacgcacaccgcaggataatcagcttgcctatgtggtcattggaatcctgaccttggcggctattatcgccgcaaacgagatgggcctgctcgaaaccacaaagcgagacctgggtatgtctaaagagcccggggtggttagcccaactagttaccttgatgtggacctccaccctgcctccgcttggacgctgtacgcagtcgccaccacagtaataactcccatgttgagacataccatcgaaaatagcacagcgaacgtgtctctggctgccattgcaaaccaagccgttgtgttaatgggcctagacaagggatggccaatctcaaaaatggatctgggcgtccctctccttgctctggggtgctattcccaggtgaatcccttgaccctgactgccgcagtcctcctgcttattacgcactacgctatcataggaccgggcttacaggccaaggcgacaagggaggcccagaagcggaccgcagctggtattatgaaaaacccaactgtggacgggatcatgaccatcgatctggaccctgttatttatgatagtaagttcgagaaacaactcggacaggtgatgttgctggtactatgtgccgtgcagctgctccttatgcgcacaagctgggcactgtgcgaagctttgactctggccaccggccccatcacaacgctctgggagggttcgccaggcaagttttggaataccactatagccgtctctatggcgaacattttcagagggtcctacctggctggagcaggcttagcctttagcatcatgaaatcagttgggacaggaaagaggggcaccggtagtcagggggaaactcttggagagaagtggaaaaagaaactgaatcaactctctcggaaggaattcgacctatataaaaagtccggcattacagaggtggatcgaaccgaggctaaagaaggtctgaagagaggcgagatcacgcatcacgccgtcagccgcgggtcagcaaagttgcagtggtttgtggaaaggaacatggtaatacccgagggacgggtgatcgacctgggctgtgggcgtggaggctggagttactattgcgccggtctcaaaaaggttaccgaagtgagagggtacacaaaaggaggccctggccatgaggagccggtccccatgagcacttacgggtggaatattgtgaagcttatgtccggaaaagatgtcttctatctgccacctgaaaagtgtgacaccttgctgtgcgatatcggtgagtctagcccctcccctacagtggaagagtcaaggactattcgcgttctcaagatggtagagccatggttaaaaaacaatcagttctgtatcaaggtgctgaacccctacatgcctaccgtcattgaacaccttgagcggctgcagcgaaaacacggcgggatgctagtgagaaatccactctctaggaacagtacacatgaaatgtattggatctcgaatggaaccggcaacatagttgctagcgtgaatatggtctcccgcctgttgctgaaccggtttactatgacgcacagacgtcccacaattgagaaggacgtggatctcggtgcggggaccaggcatgtaaacgccgaaccggagactcctaatatggacgtgatcggagagcggatcaaacgcattaaggaagagcacaactctacctggcactacgacgatgaaaatccatataagacatgggcataccatggctcatatgaggttaaagctacgggcagcgcctccagtatgataaacggggtcgtgaagcttctgaccaaaccctgggacgtggtccctatggttactcaaatggcaatgacagataccactccattcggacagcagcgagtgtttaaggaaaaagtagacacaagaacccccaggtctatgccgggtacacggcgcgtgatgggcatcactgccgagtggttatggagaaccctggggaggaataagaagcctcgattgtgcacgcgggaggaattcaccaaaaaggtccgtacaaacgctgccatgggagcggtgtttactgaggaaaatcaatgggatagcgcaaaagccgctgttgaggacgaagatttctggaagctcgtggacagagagcgcgagctgcacaaactaggcaagtgtggttcatgcgtctacaacatgatggggaaaagggaaaagaagcttggagagtttggcaaagccaagggctcccgggcaatttggtacatgtggctgggggctagatatctcgaattcgaggccctgggatttttgaatgaggatcattggttcagtcgcgaaaacagctactctggtgtggagggcgaagggctgcacaaactcggatatatccttagggacatttccaagatccccggcggtgctatgtacgccgatgacaccgcagggtgggacacacgaataactgaggatgacctgcataatgaagagaaaatcacccagcagatggatccagagcaccggcagttagcgaacgccatttttaagctgacgtatcaaaataaggtagttaaagtgcagagacctacacccaccggaactgtcatggacatcatttcaaggaaggatcagcgcggcagcggccaggtggggacatacggattgaacaccttcactaatatggaagctcaactcatccgtcagatggagggtgaaggcgtgctgaccaaagccgacctagagaacccacacctttcggaaaagaaaataacacagtggctggagacgaagggggtcgagcggctcaagagaatggcaatttctggagatgactgcgttgtgaaacccatcgatgacaggtttgctaacgccctgttggcattaaatgatatgggcaaggtacgcaaagacatccctcagtggcaaccaagtaagggttggcatgattggcagcaggtgccgttctgttcccaccatttccacgaactgattatgaaagacgggcgaaagctcgtcgtgccctgccggcctcaggacgagcttataggaagagccaggatcagccaaggcgcgggctggtcactgcgcgaaaccgcttgtctagggaaggcctatgcacagatgtggtccctgatgtactttcacagacgggatctcaggttggcctctaacgctatttgcagcgccgttccagtgcattgggtccccactagtcgtacaacctggtccatccacgcacatcaccagtggatgactacagaggacatgctgaccgtgtggaatcgagtatggattgaagataacccttggatggaggacaaaacgccagttacaacctgggagaatgtgccctaccttggaaagcgcgaagatcaatggtgtggtagcctgatcggcctcacttctagagctacctgggcccagaacatacctacagcgatccagcaggtccggtcattaattgggaatgaggaattcctggactatatgccgagtatgaaaaggtttcgcaaggaggaggaatccgagggagctatctggtga

SEQ ID NO: 15398 - RNA, 9873 nt, synthetic construct
  misc_feature 1..9873: note = derived and/or modified CDS sequence (opt3) from DENV-3__EU529696__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggagtgatcaccctgtatttaggcgccgttgtccaggcagacatgggttgtgtgattaattggaaagggaaggagctgaagtgcggatccggcatcttcgtgactaacgaggtccatacatggaccgaacagtacaaatttcaagccgattctcccaagcggctagctactgccattgcaggtgcttgggagaatggcgtttgtgggatccgaagcaccacacgcatggaaaacctcctgtggaaacagatagccaatgagcttaactatatcttgtgggaaaataacattaagctgacggtggtggtaggagacatcattggcgtcctcgagcaggggaaaagaaccctgactccacagcctatggagttaaagtactcatggaaaacatggggaaaggcgaagatcgtgaccgccgaaatacaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggacctggattttaattattgcgaggggactaccgtggtgattacagagaactgtggaacgcgtggcccaagtttacggaccactacagtctctggtaaactcatccacgaatggtgctgtcgaagctgcaccctgccccctcttagatacatgggggaggacggatgttggtatggcatggaaataaggccaatttccgagaaggaagagaatatggttaaatcactggtgagcgccggttctggcaaggtagataacttcactatgggggtgttgtgcctcgcaatcctgtttgaggaagtcatgcgcggaaagttcggcaaaaagcatatgatcgctggggtgttctttacattcgttctactgctctccggacagattacctggcgggacatggcccacacgctgatcatgattggcagtaatgcaagcgataaaatgggtatgggggtgacttaccttgccttgatagctacctttaagatccagcccttcctggcgttaggatttttcctcagaaaactgacatctagggagaaccttctgctaggcgtcggcctcgccatggcaaccactctgcaattgccggaagacattgagcagatggctaatgggatcgccctgggattaatggccctcaagctgattacacagtttgaaacctatcagctttggacagctctgatctccttgacttgttcaaacaccatgttcacgctcacagtggcatggcgcaccgccactctgatactagcgggtgttagtctgcttcctgtgtgccaaagctcgtccatgcgaaagaccgattggctcccaatggctgtcgccgcaatgggcgtaccccctctgcccttgtttatcttctctctgaaagacacattaaagcggcgtagctggccactcaatgagggggtgatggccgttggactggtgtcaattcttgctagttccctgttgagaaacgatgtccctatggcaggccccctcgtggccggtgggctgctaatcgcgtgttacgtaattactggaacctctgctgacctgacggtggagaaagccgcagacatcacatgggaagaggaagccgagcagaccggcgtcagccataaccttatgataactgttgatgacgatggcacaatgaggattaaggacgatgaaaccgagaatatcctcactgtgctgttgaaaacagctttactgatcgtgtccggggtctttccatactcaattccggccaccctcctggtgtggcacacgtggcagaagcagactcaacgcagcggagttctttgggacgtacctagtcccccagagacccagaaagcagaactggaggaaggtgtgtatcggataaagcagcagggcatcttcgggaagacacaagtcggagtgggcgttcagaaagagggtgtgtttcataccatgtggcacgtcacaagaggggctgtgttgacttacaacggaaagaggctagagcccaattgggcctctgtaaaaaaggatctgatttcctatggcggcgggtggcgactcagcgcgcagtggcaaaaaggagaagaggtccaggtgatcgccgttgaacctggtaagaacccaaagaatttccagaccatgcccggcacgttccagacaactaccggggagattggagcaatcgctctggactttaaacctggcacatcgggttcaccgataatcaaccgcgaagggaaggtggtcggactttacggcaatggcgtggttaccaaaaacgggggatatgtgtctggtattgcccaaactaatgctgagccagatggccccacccctgagttagaagaggaaatgttcaagaaacggaacctgacaatcatggacctccacccagggagtggaaagacgagaaagtacttgcccgcagtcgtgagggaggccattaaacgtcgcctgcggactctcatcctggcccctaccagagtagtggctgcggaaatggaggaggcacttaagggcctgccgataaggtatcagacaaccgccactaaatccgaacatacaggtcgagagattgttgatttgatgtgccacgctacctttacgatgcggctactgagccccgtccgcgtgccaaattacaacctcatcatcatggacgaagcccatttcactgatcctgcatctattgccgctagagggtacatcagcacaagggtgggaatgggcgaggcggccgcaatatttatgaccgctacccccccaggcactgccgacgcattccctcagtccaatgcccccattcaggacgaagagcgggatatcccagagcgatcatggaacagtgggaatgaatggattacagactttgctggaaagaccgtctggttcgtaccgagcatcaaagccggtaacgatatagcgaactgtttaagaaagaatggcaagaaagtgattcaactgtctcgcaagacatttgacactgagtatcagaaaacgaagcttaacgattgggacttcgttgtgaccacagatatctccgaaatgggggcaaattttaaagccgacagggtcatcgatcctcgtcggtgcctgaagcccgtgattctcactgacggaccagagagagttatcttggctggccccatgcctgtgaccgccgcttcagcagcccagaggcgcggtcgagtcgggagaaacccacagaaggagaatgatcaatacattttcacaggccagcccctgaacaatgacgaagaccacgctcattggaccgaggccaaaatgctcctggataacataaatactcctgaaggaatcattccggcacttttcgagccagaacgggagaagagtgcggccatcgacggcgagtataggctaaaaggggaaagccgcaagacgtttgtggagctgatgcgtagaggagatttgcccgtatggttagctcacaaagtggcctccgaaggtatcaagtacaccgaccggaaatggtgcttcgatggccagaggaacaatcagattctggaggaaaacatggacgttgagatatggacaaaggagggggaaaagaaaaagctccgccctcgatggctggatgcaagaacttattctgacccccttgctctgaaagagtttaaggatttcgccgcaggacggaaatcgatcgccctcgacttggtcaccgaaattggcagggtgccaagccacctggctcatcgcacaagaaatgcgctagataacctggtgatgctccacacctcagagcatggtgggagggcctaccggcacgcagtcgaagagcttcctgagactatggaaacactgttattgctgggcctcatgatcctgcttacgggaggcgctatgctgtttctcatttccgggaagggaatcggtaagaccagtataggcttgatctgtgttattgcctctagcgggatgctgtggatggccgagatccccttacaatggattgcatccgctatcgtgctagaattctttatgatggtactgctcataccagagcctgagaaacagcgtactccgcaggacaatcaacttgcctatgtggtcattggaatcctgacattggcggctattatcgccgcaaacgaaatgggcctgctcgagaccaccaagcgcgatctgggtatgtcaaaagaacccggggtggtttctccaacaagctaccttgacgtggacctccaccctgccagtgcttggactctgtacgcagtcgccacgaccgtaataacacccatgttgcgacatactatcgagaattccaccgcgaacgtgagcctggctgccattgcaaaccaggccgttgtgttaatgggcctagataagggatggccaatctctaaaatggacctgggcgtccctctccttgctctggggtgctattcacaggtgaatcccttgacactgaccgccgcagtcctcctgcttattactcactacgctatcataggaccgggcttacaggccaaggcgacgagagaagcccaaaagaggacagcagctggtattatgaaaaacccaaccgtggatgggatcatgactatcgacctggatcctgttatttatgactccaagttcgagaaacagctcggacaggtgatgttgctggtactatgtgccgtgcagctgctccttatgcggaccagttgggcactgtgcgaggctttgacactggccactggccccatcaccacactctgggaaggtagcccaggcaagttttggaatacgaccatagccgtctcgatggcgaacattttccgcgggtcttacctggctggagcaggcttagccttttccatcatgaaaagcgttgggactggaaagagaggcacaggttcacaaggggagacccttggagaaaagtggaaaaagaaactgaatcagctcagtaggaaggagttcgatctatataaaaagtctggcattactgaagtggaccggacagaggctaaagagggtctgaagcgaggcgaaaccacgcatcacgccgtctccagagggaccgcaaagttgcagtggtttgtggagcgcaacatggtaatccccgaaggaagggtgatagatctgggctgtgggcggggaggctggagctactattgcgccggtctcaaaaaggttacagaggtgcgtgggtacactaaaggaggccctggccatgaagagccggtccccatgtcaacctacgggtggaatatcgtgaagcttatgagtggaaaagacgtcttctatctgccacctgagaagtgtgatacattgctgtgcgacattggtgaaagctccccctctcctactgtggaggaaagcagaaccatcagggttctcaagatggtagagccatggttaaaaaacaatcagttctgtattaaggtgctgaacccctacatgcctacagtcatcgagcaccttgaacgcctgcaacggaaacacggcgggatgctagtgcgaaatccactctccagaaactcaacccatgagatgtattggatttctaatggaactggcaacatcgttgctagtgtgaatatggtctcgaggctgttgctgaaccgctttacgatgacacaccggagacccaccatagaaaaggatgtggacctcggtgcggggactcgtcatgtaaacgccgagccggaaacccctaatatggacgtgattggagagaggatcaaacggatcaaggaggaacacaacagcacatggcactacgatgacgagaatccatataagacgtgggcataccatggctcctatgaagttaaagctaccggctctgcctcaagcatgattaacggggtcgtgaagcttctgactaaaccctgggatgtggtccctatggttacacagatggcaatgaccgacactacaccattcggacagcaacgcgtgtttaaggagaaagtagatacccgaacacccagatccatgccgggtactaggcgggtgatgggcataaccgccgaatggttatggcgcacgctggggagaaataagaagcctaggttgtgcacccgagaggagttcacaaaaaaggtccggactaacgctgccatgggagcggtgtttaccgaagagaatcagtgggacagtgcaaaagccgctgttgaagatgaggacttctggaagctcgtggatcgtgaaagagagctgcacaaactaggcaagtgtggttcttgcgtctacaacatgatggggaaacgcgagaagaagcttggagaatttggcaaagccaagggcagcagggcaatctggtacatgtggctgggggctcggtatctcgagttcgaagccctgggatttttgaatgaggaccattggttctcaagagagaactcctacagtggtgtggaaggcgaggggctgcacaaactcggatatattcttcgcgatatcagcaagattcccggcggtgctatgtacgccgacgacacagcagggtgggatactaggatcaccgaagacgatctgcataatgaggaaaaaataacgcagcagatggacccagagcaccgacaattagcgaacgccatctttaagctgacatatcagaataaggtagttaaagtgcagcggcctacccccactggaacagtcatggatattatctctagaaaggaccagaggggctccggccaagtggggacctacggattgaacactttcaccaatatggaggctcagctcattcgccagatggaaggtgagggcgtgctgtcaaaagccgatctagaaaacccacaccttcccgagaagaaaatcacacagtggctggaaacgaagggggtcgagcgtctccggagaatggcaataagcggagacgattgcgttgtgaagcctattgacgataggtttgctaacgccctgttggcattaaatgacatgggcaaagtacgcaaggatatcccacaatggcagccgtcgaaaggttggcatgactggcagcaggtgcccttctgttctcaccatttccacgagctgatcatgaaggacgggcgaaaactcgtcgtgccttgccggccacaagatgaacttattggaagagccaggataagtcagggcgcgggctggtccctgcgcgagaccgcttgtctagggaaggcctatgcacagatgtggagcctgatgtactttcacagacgggacctcaggttggcctcaaacgctatctgctccgccgttcccgtgcattgggtccctacttctcgtacaacctggagcattcacgcacatcaccaatggatgactacagaagatatgctgaccgtgtggaatcgagtatggatcgaggacaacccatggatggaagataagacgcccgttacaacctgggagaatgtgccttaccttggaaaacgcgaggaccagtggtgtggtagtctgattggcctcacttccagagctacctgggcccagaacatcccgacagcgatacagcaagtccggagcttaatcgggaatgaagagttcctggattatatgccatctatgaagaggtttcgcaaagaagaggagtcagaaggagctatttggtga

SEQ ID NO: 15399 - RNA, 9873 nt, synthetic construct
  misc_feature 1..9873: note = derived and/or modified CDS sequence (opt3) from DENV-3__EU529697__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcgtcttactgatgcttgtgactccatcgatgaccatgcgctgtgtaggcgttgggaacagagactttgtggaaggattgtcaggtgcgacatgggtcgatgtggtgctggagcacggcgggtgcgtcaccacgatggcaaagaataaacccactctagacatcgagctccagaagacagaagccacccaactggctactcttaggaaactgtgtattgagggaaagatcacaaacattaccacggatagccggtgccctacccagggcgaagccgcattgccagaggaacaggaccagaattatgtttgtaaacacacatacgtggatcgcggttgggggaacggatgcggcctcttcggcaaggggagtctggtaacttgcgctaagtttcaatgtttagagcccatcgagggaaaagtggtccagtatgaaaatctgaagtacaccgtgataattacagttcatactggtgaccagcaccaggtgggcaacgagacccaaggggtcacagccgaaatcacccctcaggcgtccactacggaggccattctcccagaatatggaacacttggcctggagtgctctccgcgaaccggtttggacttcaatgagatgatcctactgactatgaaaaacaaggcatggatggtgcatagacagtggtttttcgatctccccctgccttggaccagcggggctacaaccgaaactccaacatggaataggaaagagcttctggtaacgtttaagaacgcccacgctaaaaagcaagaagttgtggtcttgggctcccaggagggagccatgcacaccgcactcactggcgccacagaaatccagaattcagggggaaccagtattttcgctggtcatctgaagtgtcggttaaaaatggacaagctggagctaaaaggcatgagctacgcgatgtgcacaaacacttttgtgctcaagaaagaggtctctgaaacccagcacgggacgatactgatcaaggtggagtacaagggagaagatgcaccctgtaaaattcctttctccaccgaggacggccaaggtaaggcccataacgggcgtcttatcacagctaatccagttgtgactaaaaaggaggaacccgtaaacatagaggccgaaccgcctttcggcgagtcaaatattgtcatcggaatcggcgataacgcattgaaaattaattggtataagaaggggagcagtatcggaaaaatgtttgaagccaccgctcgcggtgccagaaggatggcaattctgggcgacacagcgtgggatttcgggtctgtgggaggcgttctcaactccctgggtaagatggtgcaccagatatttgggagcgcttacactgcccttttctcgggcgtctcttgggtgatgaaaatcggaattggcgtactgttgacctggatcgggctcaattccaagaacacgtcaatgagttttagctgcatcgcaattggaataatcacactgtatttaggcgccgtggttcaggctgacaccggttgtgtcattaattggaaagggaaggagctgaagtgcggatccggcatcttcgtgactaacgaggtgcatacatggaccgaacagtacaaatttcaagccgattctcccaagcggctagcaactgctattgccggtgcgtgggagaatggcgtctgtgggatccgaagcaccacacgcatggaaaacctcctgtggaaacaggttgccaatgagcttaactatatattgtgggaaaataacatcaagctgacggtggtggtaggagacattatcggcgtcctcgagcaggggaaaagaaccctgactccacagcctatggagttaaagtactcatggaaaacatggggaaaggctaagattgtgaccgcagaaacacaaaacagttccttcatcatagatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagccgcagttaaggatgagagagcggtgcacgccgacatgggatactggatcgagagtcagaaaaacggcagctggaagctggaaaaagcttccctaattgaggtaaagacctgcacttggcctaagtctcataccctgtggtcgaatggtgtcctcgaaagcgatatgatcataccaaaatccctggccggcccgatctcacagcacaactataggcccgggtaccatacacaaactgcaggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagattaggccaatctccgaaaaggaggagaatatggttaaatcactggtgagcgctggttctggcaaggtagacaacttcacaatgggggtgttgtgcctcgccatactgtttgaagaggtcatgcgcggaaagttcggcaaaaagcatatgattgcaggggtgttctttaccttcgttctactgctctccggacagatcacgtggcgggatatggcccacactctgatcatgattggcagtaatgctagcgacagaatgggtatgggggtgacccatcttgcgttgatcgccacatttaaaattcagcccttcctggcattaggatttttcctcaggaagctgacctctcgcgaaaaccttctgctaggcgtcggcctcgctatggccactacactgcaattgccggaggatatagaacagatggccaatgggatcgctctgggattaatggcactcaaactgattacccagtttgagacataccagctttggactgccctgatctccttgacctgttcaaacacgattttcacactcaccgtggcgtggcgaactgctaccctgatcctagccggtgttagtctgcttcctgtgtgccaaagctcgtccatgcggaagtctgactggctcccaatgacagtcgcagccatgggcgtaccccctctgcccttgtttatattcagcctgaaggatactttaaaacgtagatcatggccactcaatgagggggtgatggctgttggactggtgagtatccttgcatcctctctgttgaggaacgacgtccctatggccggccccctcgtggcgggtgggctgctaattgcttgttatgtaatcaccggaacgagcgccgatctgacagtggaaaaggcagccgacgtcacctgggaggaagaggctgaacagactggcgtttcccacaaccttatgattacagtggacgatgacggcaccatgcgcatcaaagatgacgagactgagaatatactcacagtgctgttgaagaccgccttactgattgtctcagggatctttccatacagcatcccggcaacgctcctggtgtggcatacttggcagaaacagacccggagaagtggagttctttgggatgtaccttctcccccagaaacacaaaaggctgagctggaagagggtgtgtacaggattaaacagcagggcatattcgggaagacccaggtcggagtgggcgttcaaaaggagggtgtgtttcacacaatgtggcacgtcactcgaggggccgtgttgacctataacggaaaacgcctagaacccaattgggcgtccgtaaagaaagacctgatcagctacggcggcgggtggcggctctcggcccagtggcagaagggagaggaagtccaagtgattgcagttgagcctggtaaaaacccaaagaatttccagacgatgcccggcacattccagactaccacaggggaaatcggagctattgccctggattttaagcctggcacctcaggttctccgatcataaacagagaggggaaagtggtcggactttatggcaatggcgtggttactaagaacgggggatacgtgagtggtatcgctcagaccaatgcagagccagacggccccacacctgaattagaggaagagatgttcaaaaagaggaacctgacgattatggatctccatccagggtccggaaaaactcgtaagtatttgcccgccatcgtccgcgaagccattaagcggagactgaggaccctcatcctggctcctacacgagtggtagcggcagagatggaggaagcccttaaaggcctgccgatacggtaccaaaccactgctacaaagagcgagcacaccggtcgcgaaattgtggacttgatgtgccatgccacgtttactatgagactactgtctcccgttagggtcccaaattataacctcatcatcatggatgaggcacacttcacagaccctgccagcattgctgcgcgggggtacatctccacccgagtgggaatgggcgaagccgcagctatatttatgaccgccactcccccaggcacagcagatgccttccctcagtcaaatgctcccattcaggacgaggagagagacatcccagaacgcagttggaacagcgggaatgagtggattaccgattttgccggaaaaacagtgtggttcgtcccgtctatcaaggcgggtaacgacatagcaaactgtttaaggaaaaatggcaagaaggtaattcagctgtcccgtaaaacttttgatacggaataccaaaagaccaaacttaacgactgggatttcgtggttacaactgacatctcagagatgggggccaattttaaggctgatcgggtgatcgaccctagaaggtgcctgaaacccgtcattctcaccgatggaccagagcgcgtgatcttggccggccccatgcctgttacagctgcaagtgccgctcagcgaagaggtcgggtggggaggaacccacagaaggaaaatgaccagtatattttcaccggccaacccctgaacaatgatgaggaccatgcccactggactgaagcaaagatgctcctggacaacataaatacgcctgagggaatcattccggcgcttttcgaaccagagcgcgagaaaagcgccgctatcgatggcgaataccgtctaaagggggagtccagaaaaacctttgtcgaactgatgcggaggggagacttgcccgtgtggttagcccacaaggtagcatctgagggtatcaaatatacagatcgcaagtggtgcttcgacggccagcgaaacaatcagattctggaagagaacatggatgtggagatatggactaaagaaggggagaagaagaaactcagacctcggtggctggacgctaggacctactcggatccccttgccctgaaggaatttaaagacttcgcagccggacgcaagagcatcgctctcgatttggttacagagattggcagagtcccatcacatctggcgcacaggacccggaatgccctagacaacctggtgatgctccatacttccgaacacggtgggaaagcatatcgtcacgctgtggaggagcttcctgaaacaatggagacgctgttattgctgggcctcatgatcctgcttaccggaggcgccatgctgtttctcattagtgggaagggaatcggtaagacttctataggcttgatctgtgtcattgccagctccgggatgctgtggatggcagaaatccccttacagtggattgcttcagccatcgttctagagttctttatgatggtgctgctcataccagagcctgaaaaacaacgcacaccgcaggataatcagcttgcgtacgtagtgattggaatcctgaccttggctgccattatcgcagccaacgagatgggcctgctcgaaaccacaaagcgagacctgggtatgtctaaagagcccggggtcgtgagcccaactagttatcttgatgttgacctccatcctgcttccgcatggacgctgtacgccgtggcgaccacagtcataactcccatgttgagacacaccatcgaaaatagcacagctaacgtatctctggccgcaattgccaaccaagctgtggttttaatgggcctaaataagggatggccaatctcaaaaatggacctgggcgtgcctctccttgccctggggtgctactcccaggtcaaccccttgaccctgactgcagctgtgctcctgcttattacgcattatgccatcataggaccgggcttacaggcgaaggccacaagggaggcacagaagcggaccgctgccggtattatgaaaaatccaactgtcgatgggatcatgaccatcgacctggatcctgtgatttacgacagtaagttcgagaaacaactcggacaggttatgttgctggtgctatgtgcagtacagctgctccttatgcgcacaagctgggctctgtgcgaagccttgactctggccaccggccccatcacaacgctctgggagggttcgccaggcaagttttggaacaccactatagcggtgtctatggctaatattttcagagggtcctatctggcaggagccggcttagcttttagcatcatgaaatcagtcgggacaggaaagaggggcaccggtagtcagggggaaactcttggagagaagtggaaaaagaaactgaaccaactctctcggaaggaattcgatctatacaaaaagtccggcattacagaggttgaccgaaccgaggccaaagaaggtctgaagagaggcgagatcacgcaccatgcagtgagccgcgggtcagccaagttgcagtggtttgtcgaaaggaatatggtgatacccgagggacgggtaatcgatctgggctgtgggcgtggaggctggagttattactgcgctggtctcaaaaaggtgaccgaagttagagggtatacaaaaggaggccctggccacgaggagccggtgcccatgagcacttacgggtggaacattgtcaagcttatgtccggaaaagacgtgttctacctgccacctgaaaagtgtgataccttgctgtgcgacatcggtgagtctagcccctcccctacagtcgaagagtcaaggactattcgcgtgctcaagatggttgagccatggttaaaaaataaccagttctgtatcaaggtactgaatccctatatgcctaccgtgattgaacaccttgagcggctgcagcgaaaacatggcgggatgctagtcagaaacccactctctaggaatagtacacacgaaatgtactggatctcgaacggaaccggcaatatagtggcgagcgttaacatggtgtcccgcctgttgctgaaccggtttactatgacgcatagacgtcccacaattgagaaggatgtcgacctcggtgccgggaccaggcacgtgaatgcagaaccggagactcctaacatggatgtaatcggagagcggatcaaacgcattaaggaagagcacaattctacctggcattatgacgacgaaaacccatacaagacatgggcttatcacggctcatacgaggtgaaagccacgggcagcgcatccagtatgataaatggggttgtcaagcttctgaccaaaccctgggatgtggtgcctatggtcactcaaatggccatgacagacaccactccattcggacagcagcgagtttttaaggaaaaagtggatacaagaacccccaggtctatgccgggtacacggcgcgtaatgggcatcactgctgagtggttatggagaaccctggggaggaacaagaagcctcgattgtgcacgcgggaggaattcaccaaaaaggtgcgtacaaatgccgcgatgggagcagtctttactgaggaaaaccaatgggacagcgccaaagctgccgtggaggatgaagacttctggaagctcgttgatagagagcgcgagctgcataaactaggcaagtgtggttcatgcgtgtataatatgatggggaaaagggaaaagaagcttggagagtttggcaaagcaaagggctcccgggctatttggtacatgtggctgggggccagatacctcgaattcgaggctctgggatttttgaacgaggaccactggttcagtcgcgaaaatagctattctggtgtcgagggcgaagggctgcataaactcggatacatccttagggatatttccaagatccccggcggtgccatgtatgcagacgataccgcggggtgggacacacgaataactgaggacgatctgcacaacgaagagaaaatcacccagcagatggacccagagcaccggcagttagccaatgctatttttaagctgacgtaccaaaacaaggtggtaaaagttcagagacctacacccaccggaactgtgatggatatcatttcaaggaaggaccagcgcggcagcggccaggtcgggacatatggattgaataccttcactaacatggaagcccaactcatccgtcagatggagggtgaaggcgtgctgaccaaagcagatctagagaacccacatctttcggaaaagaaaataacacagtggctggagacgaagggggtggagcggctcaagagaatggctatttctggagacgattgcgtcgttaaacccatcgacgataggtttgccaatgcactgttggccttaaacgacatgggcaaggtgcgcaaagatatccctcagtggcaaccaagtaagggttggcacgactggcagcaggtaccgttctgttcccatcacttccacgaactgattatgaaagatgggcgaaagctcgtggtcccctgccggcctcaggacgagcttataggaagagcgaggatcagccaaggcgctggctggtcactgcgcgaaaccgcctgtctagggaaggcatacgcccagatgtggtccctgatgtattttcatagacgggacctcaggttggcttctaatgccatttgcagcgcagtgccagttcactgggtgcccactagtcgtacaacctggtccatccatgctcaccatcagtggatgactacagaggatatgctgaccgtctggaaccgagtgtggattgaagacaatccttggatggaggataaaacgccagtaacaacctgggagaacgttccctaccttggaaagcgcgaagaccaatggtgtggtagcctgatcggcctcacttctagagccacctgggcgcagaatatacctacagctatccagcaggtgcggtcattaattgggaacgaggaattcctggattacatgccgagtatgaaaaggtttcgcaaggaggaggaatccgagggagccatctggtga

SEQ ID NO: 15400 - RNA, 9873 nt, synthetic construct
  misc_feature 1..9873: note = derived and/or modified CDS sequence (opt3) from DENV-3__EU482564__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggagtgatcaccctgtatttaggcgccgttgtccaggcagacatgggttgtgtgattaattggaaagggaaggagctgaagtgcggatccggcatcttcgtgactaacgaggtccatacatggaccgaacagtacaaatttcaagccgattctcccaagcggctagctactgccattgcaggtgcttgggagaatggcgtttgtgggatccgaagcaccacacgcatggaaaacctcctgtggaaacagatagccaatgagcttaactatatcttgtgggaaaataacattaagctgacggtggtggtaggagacatcattggcgtcctcgagcaggggaaaagaaccctgactccacagcctatggagttaaagtactcatggaaaacatggggaaaggcgaagatcgtgaccgccgaaatacaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggacctggattttaattattgcgaggggactaccgtggtgattacagagaactgtggaacgcgtcggccaagtttacgaaccactacagtctctggcaaactcatccacgaatggtgctgtagaagctgcaccctgccccctcttaggtacatgggtgaggacgggtgttggtatggaatggaaatacgcccaatttccgagaaggaagagaatatggttaaatcactggtgagcgccggctctggtaaggtagataacttcactatgggcgtgttgtgcctcgcaatcctgtttgaggaagtcatgcgggggaagttcggaaaaaagcatatgatcgctggcgtgttctttacattcgttctactgctctccgggcagattacctggagagacatggcccacacgctgatcatgattggaagtaatgcaagcgataaaatgggcatgggtgtgacttaccttgccttgatagctacctttaagatccagcccttcctggcgttagggtttttcctcaggaaactgacatctcgcgagaaccttctgctaggagtcggcctcgccatggcaaccactctgcaattgccggaagacattgagcagatggctaatggcatcgccctggggttaatggccctcaagctgattacacagtttgaaacctatcagctttggacagctctgatctccttgacttgttcaaacaccatgttcacgctcacagtggcatggcgaaccgccactctgatactagcgggagttagtctgcttcctgtgtgccaaagctcgtccatgcggaagaccgattggctcccaatggctgtcgccgcaatgggtgtaccccctctgcccttgtttatcttctctctgaaagacacattaaagcgtagaagctggccactcaatgagggcgtgatggccgttgggctggtgtcaattcttgctagttccctgttgaggaacgatgtccctatggcaggacccctcgtggccggcggtctgctaatcgcgtgttacgtaattactgggacctctgctgacctgacggtggagaaagccgcagacatcacatgggaagaggaagccgagcagaccggagtcagccataaccttatgataactgttgatgacgatggcacaatgcgcattaaggacgatgaaaccgagaatatcctcactgtgctgttgaaaacagctttactgatcgtgtccggcgtctttccatactcaattccggccaccctcctggtgtggcacacgtggcagaagcagactcaacggagcggggttctttgggacgtacctagtcccccagagacccagaaagcagaactggaggaaggagtgtatagaataaagcagcagggtatcttcggcaagacacaagtcggggtgggagttcagaaagagggcgtgtttcataccatgtggcacgtcacaaggggtgctgtgttgacttacaacgggaagcgactagagcccaattgggcctctgtaaaaaaggatctgatttcctatggaggcggctggcgcctcagcgcgcagtggcaaaaaggggaagaggtccaggtgatcgccgttgaacctggaaagaacccaaagaatttccagaccatgcccggtacgttccagacaactaccggcgagattggggcaatcgctctggactttaaacctggaacatcgggctcaccgataatcaaccgggaaggtaaggtggtcgggctttacggaaatggcgtggttaccaaaaacggcgggtatgtgtctggaattgcccaaactaatgctgagccagatggtcccacccctgagttagaagaggaaatgttcaagaaaagaaacctgacaatcatggacctccacccaggcagtgggaagacgaggaagtacttgcccgcagtcgtgcgtgaggccattaaacgccggctgagaactctcatcctggcccctaccagggtagtggctgcggaaatggaggaggcacttaagggactgccgatacgatatcagacaaccgccactaaatccgaacatacaggccgggagattgttgatttgatgtgccacgctacctttacgatgcgcctactgagccccgtcagagtgccaaattacaacctcatcatcatggacgaagcccatttcactgatcctgcatctattgccgctaggggttacatcagcacacgggtggggatgggagaggcggccgcaatatttatgaccgctacccccccaggcactgccgacgcattccctcagtccaatgcccccattcaggacgaagagcgagatatcccagagagatcatggaacagtggcaatgaatggattacagactttgctgggaagaccgtctggttcgtaccgagcatcaaagccggaaacgatatagcgaactgtttacgcaagaatggtaagaaagtgattcaactgtctaggaagacatttgacactgagtatcagaaaacgaagcttaacgattgggacttcgttgtgaccacagatatctccgaaatgggcgcaaattttaaagccgaccgtgtcatcgatcctcggagatgcctgaagcccgtgattctcactgacgggccagagagggttatcttggctggacccatgcctgtgaccgccgcttcagcagcccagcgccgaggcagagtcggtcggaacccacagaaggagaatgatcaatacattttcacagggcagcccctgaacaatgacgaagaccacgctcattggaccgaggccaaaatgctcctggataacataaatactcctgaaggcatcattccggcacttttcgagccagaaagggagaagagtgcggccatcgacggagagtatcgcctaaaaggcgaaagccgtaagacgtttgtggagctgatgagacggggggatttgcccgtatggttagctcacaaagtggcctccgaaggaatcaagtacaccgacaggaaatggtgcttcgatggtcagcgcaacaatcagattctggaggaaaacatggacgttgagatatggacaaaggagggcgaaaagaaaaagctccgacctagatggctggatgcacggacttattctgacccccttgctctgaaagagtttaaggatttcgccgcagggaggaaatcgatcgccctcgacttggtcaccgaaattggacgcgtgccaagccacctggctcatagaacaaggaatgcgctagataacctggtgatgctccacacctcagagcatggcggtcgggcctaccgtcacgcagtcgaagagcttcctgagactatggaaacactgttattgctggggctcatgatcctgcttacgggcggagctatgctgtttctcatttccggcaaggggatcggaaagaccagtataggtttgatctgtgttattgcctctagcggcatgctgtggatggccgagatccccttacaatggattgcatccgctatcgtgctagaattctttatgatggtactgctcataccagagcctgagaaacagcgcactccgcaggacaatcaacttgcctatgtggtcattgggatcctgacattggcggctattatcgccgcaaacgaaatgggactgctcgagaccaccaagcgagatctgggcatgtcaaaagaacccggtgtggtttctccaacaagctaccttgacgtggacctccaccctgccagtgcttggactctgtacgcagtcgccacgaccgtaataacacccatgttgagacatactatcgagaattccaccgcgaacgtgagcctggctgccattgcaaaccaggccgttgtgttaatggggctagataagggctggccaatctctaaaatggacctgggagtccctctccttgctctgggctgctattcacaggtgaatcccttgacactgaccgccgcagtcctcctgcttattactcactacgctatcatagggccgggattacaggccaaggcgacgagggaagcccaaaagcggacagcagctggcattatgaaaaacccaaccgtggatggtatcatgactatcgacctggatcctgttatttatgactccaagttcgagaaacagctcgggcaggtgatgttgctggtactatgtgccgtgcagctgctccttatgcgcaccagttgggcactgtgcgaggctttgacactggccactggacccatcaccacactctgggaaggcagcccaggtaagttttggaatacgaccatagccgtctcgatggcgaacattttcagaggctcttacctggctggggcaggattagccttttccatcatgaaaagcgttggcactgggaagaggggaacaggctcacaaggtgagacccttggggaaaagtggaaaaagaaactgaatcagctcagtcggaaggagttcgatctatataaaaagtctggaattactgaagtggaccgaacagaggctaaagagggcctgaagagaggtgaaaccacgcatcacgccgtctcccgcggcaccgcaaagttgcagtggtttgtggagaggaacatggtaatccccgaagggcgggtgatagatctgggatgtggccgtgggggatggagctactattgcgccggcctcaaaaaggttacagaggtgagaggttacactaaagggggacctggccatgaagagccggtccccatgtcaacctacggctggaatatcgtgaagcttatgagtgggaaagacgtcttctatctgccacctgagaagtgtgatacattgctgtgcgacattggagaaagctccccctctcctactgtggaggaaagcaggaccatccgcgttctcaagatggtagagccatggttaaaaaacaatcagttctgtattaaggtgctgaacccctacatgcctacagtcatcgagcaccttgaacggctgcaacgaaaacacggtggcatgctagtgagaaatccactctccaggaactcaacccatgagatgtattggatttctaatgggactggaaacatcgttgctagtgtgaatatggtctcgcgcctgttgctgaaccggtttacgatgacacacagacgtcccaccatagaaaaggatgtggacctcggcgcgggtactaggcatgtaaacgccgagccggaaacccctaatatggacgtgattggggagcggatcaaacgcatcaaggaggaacacaacagcacatggcactacgatgacgagaatccatataagacgtgggcataccatggatcctatgaagttaaagctaccggctctgcctcaagcatgattaacggcgtcgtgaagcttctgactaaaccctgggatgtggtccctatggttacacagatggcaatgaccgacactacaccattcgggcagcaacgagtgtttaaggagaaagtagataccagaacacccaggtccatgccgggaactcggcgcgtgatgggtataaccgccgaatggttatggagaacgctgggcaggaataagaagcctcgattgtgcacccgggaggagttcacaaaaaaggtccgtactaacgctgccatgggggcggtgtttaccgaagagaatcagtgggacagtgcaaaagccgctgttgaagatgaggacttctggaagctcgtggatagagaacgcgagctgcacaaactaggaaagtgtggctcttgcgtctacaacatgatgggtaaaagggagaagaagcttggggaatttggaaaagccaagggcagccgggcaatctggtacatgtggctgggcgctagatatctcgagttcgaagccctggggtttttgaatgaggaccattggttctcacgcgagaactcctacagtggagtggaaggtgagggcctgcacaaactcgggtatattcttagggatatcagcaagattcccggaggcgctatgtacgccgacgacacagcaggttgggatactcgaatcaccgaagacgatctgcataatgaggaaaaaataacgcagcagatggacccagagcaccggcaattagcgaacgccatctttaagctgacatatcagaataaggtagttaaagtgcagagacctacccccactgggacagtcatggatattatctctaggaaggaccagcgcggatccggccaagtgggcacctacgggttgaacactttcaccaatatggaggctcagctcattcgtcagatggaaggagagggtgtgctgtcaaaagccgatctagaaaacccacaccttcccgagaagaaaatcacacagtggctggaaacgaagggcgtcgagcggctcagaaggatggcaataagcggggacgattgcgttgtgaagcctattgacgatcgctttgctaacgccctgttggcattaaatgacatgggaaaagtacgaaaggatatcccacaatggcagccgtcgaaaggctggcatgactggcagcaggtgcccttctgttctcaccatttccacgagctgatcatgaaggacggtcggaaactcgtcgtgccttgcagaccacaagatgaacttattgggagggcccgcataagtcagggagcgggctggtccctgagagagaccgcttgtctaggcaaggcctatgcacagatgtggagcctgatgtactttcaccggagggacctccgtttggcctcaaacgctatctgctccgccgttcccgtgcattgggtccctacttctcgaacaacctggagcattcacgcacatcaccaatggatgactacagaagatatgctgaccgtgtggaatcgcgtatggatcgaggacaacccatggatggaagataagacgcccgttacaacctgggagaatgtgccttaccttgggaaaagagaggaccagtggtgtggaagtctgattggtctcacttcccgggctacctgggcccagaacatcccgacagcgatacagcaagtcaggagcttaatcggcaatgaagagttcctggattatatgccatctatgaagcgctttagaaaagaagaggagtcagaaggggctatttggtga

SEQ ID NO: 15401 - RNA, 9873 nt, synthetic construct
  misc_feature 1..9873: note = derived and/or modified CDS sequence (opt3) from DENV-3__EU529699__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccagtttccgaaaaggaggagaatatggtgaaatcactggtaagcgctggttctggcaaggtggacaacttcaccatgggggtcttgtgcctcgccatactgtttgaagaggtgatgcgcggaaagttcggcaaaaagcatatgattgcaggggttttctttacgttcgtgctactgctctccggacagatcacttggcgggatatggctcacaccctgatcatgattggcagtaatgccagcgacagaatgggtatgggggtcacataccttgcattgatcgccacctttaaaattcagcccttcctggctttaggatttttcctcaggaagctgacttctcgcgaaaaccttctgctaggcgtgggcctcgcgatggccacaaccctgcaattgccggaggatatagaacagatggcaaatgggatcgctctgggattaatggccctcaaactgattacacagtttgagacttatcagctttggaccgccctgatctccttgacgtgttcaaacacaattttcaccctcactgttgcttggcgaaccgcaacactgatcctagccggtgtgagtctgcttcctgtctgccaaagctcgtccatgcggaagactgactggctcccaatgaccgtagcggctatgggcgtgccccctctgcccttgtttatattctctctgaaggatacgttaaaacgtagaagctggccactcaatgagggggttatggccgtgggactggtctcaatccttgcaagttccctgttgaggaacgacgtgcctatggccggccccctcgtagctggtgggctgctaattgcatgttacgtgatcacaggaacctctgccgatctgactgtcgaaaaggcggctgacgttacatgggaggaagaggccgaacagaccggcgtgagccataaccttatgattactgtggacgatgacggcacaatgcgcatcaaagatgacgagaccgagaatatactcacggtcctgttgaagactgcattactgattgtgtccgggatctttccatactcaatcccggccaccctcctggtttggcacacatggcagaaacagacccaacggagcggagtactttgggatgtgcctagtcccccagaaacacagaaggctgagctggaagagggtgtctatagaattaaacagcagggcatattcgggaagactcaagtgggagttggcgtgcagaaggagggtgtctttcataccatgtggcacgtgacgaggggggccgtattgacatacaacggaaaacgactagaacccaattgggcatctgtcaagaaagacctgatctcctatggcggcgggtggcgcctcagcgctcagtggcaaaagggagaggaagtgcaggttattgccgtggagcctggtaaaaacccaaagaatttccagactatgcccggcaccttccagacaaccactggggaaatcggagcgattgccctggattttaagcctggcacctcgggttcaccgatcataaaccgggaggggaaagtcgtgggactttacggcaatggcgttgtgacaaagaacgggggatatgtctctggtatcgcacaaacgaatgctgagccagacggccccactcctgaattagaggaagagatgttcaaaaagagaaacctgaccattatggatctccacccagggagtggaaaaacaaggaagtacttgcccgccatcgtgcgtgaagctattaagcgccggctgagaaccctcatcctggcacctactagggtagtggccgccgagatggaggaagctcttaaaggcctgccgatacgatatcagacaaccgcgacgaagtccgagcatactggtcgggaaattgttgacttgatgtgccacgcaacatttaccatgcgcctactgagccccgtcagagtgccaaattacaacctcatcatcatggatgaggcccatttcaccgaccctgcttctattgccgcaagggggtacatcagcactcgggtgggaatgggcgaagccgctgcgatatttatgacagccacccccccaggcacagcagatgctttccctcagtccaatgcccccattcaggacgaggagcgagacatcccagaaagatcatggaacagtgggaatgagtggattactgattttgcaggaaaaacggtctggttcgtaccgagcatcaaggccggtaacgacatagctaactgtttacgcaaaaatggcaagaaggtgattcaactgtctaggaaaacctttgatacagaatatcagaagactaaacttaacgactgggatttcgttgtgaccacagacatctccgagatgggggccaattttaaggcggatcgtgtcatcgaccctcggagatgcctgaaacccgtgattctcaccgatggaccagagagggttatcttggcaggccccatgcctgtgactgccgcttcagccgctcagcgccgaggtagagtcgggcggaacccacagaaggaaaatgaccaatacattttcacgggccagcccctgaacaatgatgaggaccacgcacattggaccgaagccaagatgctcctggacaacataaatacacctgagggaatcattccggctcttttcgaaccagagagggagaaaagtgccgcaatcgatggcgaatatcgcctaaagggggagagccgtaaaacttttgtggaactgatgagacggggagacttgcccgtatggttagcgcacaaggtggcctccgagggtatcaaatacaccgataggaagtggtgcttcgacggccagcgcaacaatcagattctggaagagaacatggatgttgagatatggacaaaagaaggggagaagaagaaactccgacctagatggctggacgctcggacctattctgatccccttgccctgaaggaatttaaagacttcgcagctggaaggaagtcgatcgccctcgatttggtcactgagattggccgcgtgccaagccacctggcacatagaacaaggaatgccctagacaacctggtgatgctccacacgtcagaacatggtgggaaagcttaccggcacgcggtcgaggagcttcctgaaaccatggagactctgttattgctgggcctcatgatcctgcttacaggaggcgccatgctgtttctcatttccgggaagggaatcggtaagaccagtataggcttgatctgtgttattgcatctagcgggatgctgtggatggctgaaatccccttacaatggattgcctccgccatcgtgctagagttctttatgatggtactgctcataccagagcctgaaaaacagcgtaccccgcaggataatcaacttgcatatgtggtcattggaatcctgacattggctgccattatcgcggctaacgagatgggcctgctcgaaactacgaagcgcgacctgggtatgtcaaaagagcccggggtggtttctccaaccagctaccttgatgtggacctccaccctgccagtgcatggacactgtacgccgtcgctactaccgtaataacacccatgttgcgacataccatcgaaaattccactgcaaacgtgagcctggccgcgattgctaaccaggccgttgtgttaatgggcctagacaagggatggccaatctctaaaatggatctgggcgtccctctccttgcactggggtgctattcacaggtgaatcccttgacgctgacagccgctgtcctcctgcttattacccactacgccatcataggaccgggcttacaggcaaaggctactagagaggcccaaaagaggaccgcggccggtattatgaaaaacccaacagtggacgggatcatgactatcgatctggaccctgttatttatgattccaagttcgagaaacagctcggacaggtgatgttgctggtactatgtgcagtgcagctgctccttatgcggaccagttgggctctgtgcgaagccttgacactggcaacgggccccatcaccactctctgggagggtagcccaggcaagttttggaatacaaccatagctgtctcgatggccaacattttccgcgggtcttacctggccggagcgggcttagctttttccatcatgaaaagcgttgggactggaaagagaggcacaggttcacaaggggaaacccttggagagaagtggaaaaagaaactgaatcagctcagtaggaaggaattcgacctatataaaaagtctggcattacggaggtggatcggaccgaggcaaaagaaggtctgaagcgaggcgagatcacacatcacgccgtctccagagggagcgctaagttgcagtggtttgtggaacgcaacatggtaatacccgagggaagggtgatcgacctgggctgtgggcggggaggctggtcatactattgcgccggtctcaaaaaggttactgaagtgcgtgggtacaccaaaggaggccctggccatgaggagccggtccccatgagtacatacgggtggaatattgtgaagcttatgagcggaaaagatgtcttctatctgccacctgaaaagtgtgacactttgctgtgcgatatcggtgagtcctctcccagccctaccgtggaagagtccagaacaattagggttctcaagatggtagagccatggttaaaaaacaatcagttctgtatcaaggtgctgaacccctacatgcctaccgtcattgaacaccttgagcgcctgcaacggaaacacggcgggatgctagtgcgaaatccactctcaagaaactctactcatgaaatgtattggatcagtaatggaacgggcaacatagttgcatcggtgaatatggtcagcaggctgttgctgaaccgctttacaatgacccaccggagacccactattgagaaggacgtggatctcggtgccgggacccgtcatgtaaacgctgaaccggagacacctaatatggacgtgatcggagagaggatcaaacggattaaggaagagcacaactccacgtggcactacgacgatgaaaatccatataagacctgggcgtaccatggctcttatgaggttaaagccactggctcagcaagctccatgataaacggggtcgtgaagcttctgacaaaaccctgggacgtggtccctatggttacccagatggctatgactgatacaaccccattcggacagcaacgcgtgtttaaggaaaaagtagacacacgaactcccagaagtatgccgggtaccaggcgggtgatgggcatcacggccgagtggttatggcgcaccctggggagaaataagaagcctaggttgtgcacacgagaggaattcactaaaaaggtccggaccaacgcagccatgggagctgtgtttacagaggaaaatcagtgggattctgccaaagcggcagttgaggacgaagatttctggaagctcgtggaccgtgagagagagctgcacaaactaggcaagtgtggtagctgcgtctacaacatgatggggaaacgcgaaaagaagcttggagagtttggcaaagccaagggctcaagggctatttggtacatgtggctgggggcccggtatctcgaattcgaggcactgggatttttgaatgaggatcattggttctccagagaaaacagttacagcggtgtggagggcgaagggctgcacaaactcggatatatccttcgcgacatttctaagatccccggcggtgctatgtacgccgatgacactgctgggtgggacaccaggataacggaggatgacctgcataatgaagagaaaatcacacagcagatggatccagagcaccgacaattagccaacgcaatttttaagctgacctatcagaataaggtagttaaagtgcagcggcctactcccacaggaaccgtcatggacatcatttccagaaaggatcagaggggctcaggccaagtggggacttacggattgaacaccttcacaaatatggaagcgcagctcatccgccagatggagggtgaaggcgtgctgagcaaagccgacctagagaacccacaccttcccgaaaagaaaataacgcagtggctggagaccaagggggtcgagcgtctcaagcggatggctatttcgggagatgactgcgttgtgaaacctatcgatgacagatttgccaacgcactgttggctttaaatgatatgggcaaggtaaggaaagacatcccacaatggcagccgtctaagggttggcatgattggcagcaggtgcccttctgtagtcaccatttccacgaactgattatgaaagacgggcgcaagctcgtcgtgccttgccgaccacaagacgagcttataggacgggccagaatctcccagggcgcaggctggagcctgagggaaactgcctgtctagggaaggcgtatgctcagatgtggtcactgatgtactttcaccgcagagatctccggttggcctccaacgcaatttgctctgccgttcccgtgcattgggtccctacaagcaggaccacttggagtatccacgctcatcaccaatggatgacaaccgaggacatgctgacggtgtggaatcgtgtatggattgaagataacccatggatggaggacaaaacacccgttaccacttgggagaatgtgccttaccttggaaagcgagaagatcagtggtgtggttccctgatcggcctcaccagccgcgccacatgggcacagaacataccgactgctatccagcaagtcagatctttaattgggaatgaggaattcctggactatatgccatcaatgaaacggtttaggaaggaggaggaaagtgagggagccatctggtga

SEQ ID NO: 15402 - RNA, 9873 nt, synthetic construct
  misc_feature 1..9873: note = derived and/or modified CDS sequence (opt3) from DENV-3__EU482566__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcaccttactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccaccagatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactaaaggcccaagtttacgtacaaccactgtctctggtaagctcattcacgagtggtgctgtcggagctgcacactgccccctcttcgatacatgggggaagatggatgttggtatggcatggagatcagaccaatatccgaaaaagaggagaatatggttaagtcactggtgagcgctggttctggcaaggtagacaacttcaccatgggggtgttgtgcctcgccattctgtttgaagaggtcatgaggggaaaattcggcaagaaacatatgatcgcaggggtgttctttacgttcgttctactgctctccggacagatcacttggcgcgatatggctcacaccctgattatgatcggcagtaatgccagcgaccggatgggtatgggggtgacataccttgcattgattgccacctttaagatacagcccttcctggctttaggatttttcctcagaaaactgacttctagggaaaaccttctgctaggcgtcggcctcgcgatggccacaaccctgcaattgccggaggatatcgaacagatggcaaatgggattgctctgggattaatggccctcaagctgatcacacagtttgagacttatcagctttggaccgccctgatttccttgacgtgttcaaacacaatcttcaccctcactgtggcttggcgcaccgcaacactgatactagccggtgttagtctgcttcctgtgtgccaaagctcgtccatgcgaaagactgactggctcccaatgaccgtcgcggctatgggcgtaccccctctgcccttgtttatcttctctctgaaagatacgttaaagcggcgtagctggccactcaatgagggggtgatggccgttggactggtgtcaattcttgcaagttccctgttgagaaacgacgtccctatggccggccccctcgtggctggtgggctgctaatcgcatgttacgtaattacaggaacctctgccgatctgactgtggaaaaagcggctgacgtcacatgggaggaagaggccgaacagaccggcgttagccataaccttatgatcactgtggacgatgacggcacaatgaggataaaggatgacgagaccgagaatattctcacggtgctgttgaaaactgcattactgatcgtctccgggatctttccatactcaattccggccaccctcctggtgtggcacacatggcagaagcagacccaacgcagcggagttctttgggatgtacctagtcccccagaaacacagaaagctgagctggaagagggtgtgtatcggataaagcagcagggcatcttcgggaagactcaagtcggagtgggcgttcagaaagagggtgtgtttcataccatgtggcacgtcacgagaggggccgtgttgacatacaacggaaagaggctagaacccaattgggcatctgtaaaaaaggacctgatttcctatggcggcgggtggcgactcagcgctcagtggcaaaaaggagaggaagtccaggtgatcgccgttgagcctggtaagaacccaaagaatttccagactatgcccggcaccttccagacaaccactggggaaattggagcgatcgccctggattttaaacctggcacctcgggttcaccgataatcaaccgcgaggggaaggtggtcggactttacggcaatggcgtggttacaaaaaacgggggatatgtgtctggtattgcacaaacgaatgctgagccagacggccccactcctgaattagaggaagagatgttcaagaaacggaacctgaccatcatggatctccacccagggagtggaaagacaagaaagtacttgcccgccattgtcagggaagctatcaaacgtcgcctgcggaccctcatactggcacctactagagtggtagccgccgagatggaggaagctcttaagggcctgccgattaggtatcagacaaccgcgacgaaatccgagcatactggtcgagaaatcgtggacttgatgtgccacgcaacatttaccatgcggctactgagccccgttcgcgtcccaaattacaacctcatcattatggatgaggcccatttcaccgaccctgcttctatcgccgcaagagggtacataagcactagggtgggaatgggcgaagccgctgcgatttttatgacagccacccccccaggcacagcagatgctttccctcagtccaatgcccccatccaggacgaggagcgggacattccagaacgatcatggaacagtgggaatgagtggatcactgattttgcaggaaagacggtgtggttcgtcccgagcataaaagccggtaacgacattgctaactgtttaagaaagaatggcaagaaagtaatccaactgtctcgcaagacctttgatacagaatatcagaaaactaagcttaacgactgggatttcgtggttaccacagacatctccgagatgggggccaattttaaagcggatagggtgattgaccctcgtcggtgcctgaagcccgtcatcctcaccgatggaccagagagagtgattttggcaggccccatgcctgttactgccgcttcagccgctcagaggcgcggtcgagtggggagaaacccacagaaggaaaatgaccaatacatattcacgggccagcccctgaacaatgatgaggaccacgcacattggaccgaagccaaaatgctcctggacaacatcaatacacctgagggaattatcccggctcttttcgaaccagagcgggagaagagtgccgcaatcgatggcgaatataggctaaaaggggagagccgcaagacttttgtcgaactgatgcgtagaggagacttgcccgtgtggttagcgcacaaagtagcctccgagggtattaagtacaccgatcggaaatggtgcttcgacggccagaggaacaatcagatactggaagagaacatggatgtggagatctggacaaaggaaggggagaagaaaaagctccgccctcgatggctggacgctagaacctattctgatccccttgccctgaaagaatttaaggacttcgcagctggacggaaatcgattgccctcgatttggttactgagatcggcagggtcccaagccacctggcacatcgcacaagaaatgccctagacaacctggtgatgctccacacgtcagaacatggtgggaaggcttacaggcacgcggtggaggagcttcctgaaaccatggagactctgttattgctgggcctcatgattctgcttacaggaggcgccatgctgtttctcatctccgggaagggaataggtaaaaccagtatcggcttgatttgtgtcatcgcatctagcgggatgctgtggatggctgaaattcccttacaatggatcgcctccgccatagttctagagttctttatgatggtgctgctcattccagagcctgaaaagcagcggaccccgcaggataatcaacttgcatatgtagtgatcggaattctgacattggctgccatcatagcggctaacgagatgggcctgctcgaaactacgaaacgtgacctgggtatgtcaaaggagcccggggtcgtgtctccaaccagctaccttgatgttgacctccaccctgccagtgcatggacactgtacgccgtggctactaccgtcatcacacccatgttgcgccataccattgaaaattccactgcaaacgtaagcctggccgcgatcgctaaccaggccgtggttttaatgggcctagacaaaggatggccaatttctaagatggatctgggcgtgcctctccttgcactggggtgctattcacaggtcaatcccttgacgctgacagccgctgtgctcctgcttatcacccactacgccataattggaccgggcttacaggcaaaggctactcgagaggcccaaaaaagaaccgcggccggtatcatgaagaacccaacagtcgacgggatcatgactattgatctggaccctgtgatctatgattccaaattcgagaagcagctcggacaggttatgttgctggtgctatgtgcagtacagctgctccttatgaggaccagttgggctctgtgcgaagccttgacactggcaacgggccccataaccactctctgggagggtagcccaggcaaattttggaatacaaccattgctgtgtcgatggccaacatcttccgggggtcttacctggccggagcgggcttagctttttccattatgaagagcgtcgggactggaaagcgcggcacaggttcacaaggggaaacccttggagagaaatggaagaaaaagctgaatcagctcagtagaaaagaattcgacctatataagaaatctggcatcacggaggttgataggaccgaggcaaaggaaggtctgaagcggggcgagataacacatcacgccgtgtcccgagggagcgctaaattgcagtggtttgtcgaaagaaacatggtgatccccgagggacgcgtaattgacctgggctgtgggaggggaggctggtcatactattgcgccggtctcaagaaagtgactgaagttcgggggtacaccaagggaggccctggccatgaggagccggtgcccatgagtacatacgggtggaatatcgtcaaacttatgagcggaaaggatgtgttctatctgccacctgaaaagtgtgacactttgctgtgcgatattggtgagtcctctcccagccctaccgtcgaagagtcccgtacaatcagagtgctcaaaatggttgagccatggttaaagaacaatcagttctgtattaaagtactgaacccctacatgcctaccgtgatcgaacaccttgagaggctgcaacgcaagcacggcgggatgctagtccggaatccactctcacgaaactctactcatgaaatgtattggataagtaatggaacgggcaacattgtggcatcggttaatatggtgagcagactgttgctgaacaggtttacaatgacccaccgccggcccactatcgagaaagacgtcgatctcggtgccgggaccagacatgtgaacgctgaaccggagacacctaatatggacgtaatcggagagcgtattaagaggataaaggaagagcacaactccacgtggcactacgacgatgaaaatccatataaaacctgggcgtaccatggctcttatgaggtgaaggccactggctcagcaagctccatgatcaacggggttgtcaaacttctgacaaagccctgggacgtggtgcctatggtcacccagatggctatgactgatacaaccccattcggacagcaacgggtttttaaagaaaaggtggacacacgcactccccgaagtatgccgggtaccagaagggtaatgggcattacggccgagtggttatggcggaccctggggcgcaataagaaacctagattgtgcacaagggaggaattcactaagaaagtgcgaaccaacgcagccatgggagctgtctttacagaggaaaatcagtgggattctgccaaggcggcagtggaggacgaagatttctggaaactcgttgaccgggagcgtgagctgcacaagctaggcaaatgtggtagctgcgtgtacaacatgatggggaagagagaaaagaaacttggagagtttggcaaggccaaaggctcacgcgctatctggtacatgtggctgggggccaggtatctcgaattcgaggcactgggatttttgaatgaggatcattggttctcccgggaaaacagttacagcggtgtcgagggcgaagggctgcacaagctcggatatattcttagagacatctctaaaatacccggcggtgctatgtacgccgatgacactgctgggtgggacacccgcatcacggaggatgacctgcataatgaagagaagattacacagcagatggatccagagcacaggcaattagccaacgcaatctttaagctgacctatcagaataaagtggtaaaggttcagcgacctactcccacaggaaccgtgatggacattatctcccggaaagatcagagaggctcaggccaagtcgggacttacggattgaacaccttcacaaatatggaagcgcagctcataaggcagatggagggtgaaggcgtgctgagcaaggccgacctagagaacccacaccttcccgaaaaaaagattacgcagtggctggagaccaagggggtggagcgcctcaaacgtatggctatctcgggagatgactgcgtcgttaagcctatcgatgaccggtttgccaacgcactgttggctttaaatgatatgggcaaagtgagaaaggacattccacaatggcagccgtctaaaggttggcatgattggcagcaggtacccttctgtagtcaccatttccacgaactgataatgaaggacgggaggaagctcgtggtcccttgccgcccacaagacgagcttatcggacgagcccggatttcccagggcgcaggctggagcctgagagaaactgcctgtctagggaaagcgtatgctcagatgtggtcactgatgtactttcacaggcgcgatctcagattggcctccaacgcaatctgctctgccgtgcccgttcattgggtgcctacaagccggaccacttggagtattcacgctcatcaccaatggatgacaaccgaggacatgctgacggtctggaatagggtgtggatcgaagataacccatggatggaggacaagacacccgtaaccacttgggagaatgttccttaccttggaaaacgtgaagatcagtggtgtggttccctgataggcctcaccagccgagccacatgggcacagaacatcccgactgctattcagcaagtgcgctctttaatcgggaatgaggaattcctggactatatgccatcaatgaagagatttcggaaagaggaggaaagtgagggagccatttggtga

SEQ ID NO: 15403 - RNA, 9873 nt, synthetic construct
  misc_feature 1..9873: note = derived and/or modified CDS sequence (opt3) from DENV-3__EU529702__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacgttggcacatctctcactcagaaggtggtcatcttcatattactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatcgagctccagaagaccgaagcaactcaactggccacacttaggaaactgtgtattgagggaaagatcaccaacattacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaagtacctttctccacagaggacggccaaggtaaggctcataacgggcgtcttattactgcgaatccagtcgtgaccaaaaaggaggaacccgttaacatcgaggcagaaccgcctttcggcgagtcaaatatagtgattggaatcggcgataacgccttgaaaatcaattggtataagaaggggagcagtattggaaaaatgtttgaagctacagcccgcggtgcaagaaggatggccatcctgggcgacactgcttgggatttcgggtctgtcggaggcgtgctcaactccctgggtaagatggtacaccagatttttgggagcgcctacaccgcacttttctcgggcgtgtcttgggttatgaaaataggaatcggcgtcctgttgacgtggattgggctcaattccaagaacacatcaatgagttttagctgcatcgtgatcggaattataaccctgtatttaggcgcggtggtccaggctgacatgggttgtgttatcaattggaaagggaaggagctgaagtgcggatccggcattttcgtgactaacgaggtgcatacatggaccgaacagtacaaatttcaagccgattctcccaagcggctagcaactgccatcgctggtgcctgggagaatggcgtatgtgggattcgaagcaccacacgcatggaaaacctcctgtggaaacagatcgcaaatgagcttaactatatattgtgggaaaataacatcaagctgacggtcgtggttggagacattatcggcgtgctcgagcaggggaaaagaaccctgactccacagcctatggagttaaagtactcatggaaaacatggggaaaggctaagattgtcaccgccgaaacacaaaacagttccttcatcatagatggccccaatactccagagtgccccagcgcgtctagggcctggaacgtgtgggaagttgaggactatggttttggggtgttctcaaccaatatttggctgaaacttcgggaagtatacacgcagttgtgtgaccaccgcctcatgagtgctgcagtcaaggatgagagagccgtgcacgctgacatgggatactggatcgagagccagaaaaacggctcctggaagctggaaaaagcctctctaattgaggtgaagacatgcacctggcctaagtcgcatactctgtggagcaatggtgtcctcgaatccgatatgatcataccaaaatcactggcaggcccgatcagtcagcacaactataggcccgggtaccatacccaaacagcgggaccttggcaccttggcaagttggagctggactttaattattgcgaggggactaccgttgtgattacagaaaactgtggaacgcgtggcccatctttacggaccactacagtaagcggtaaactcatccacgagtggtgctgtcgatcctgcaccctgccccctcttagatacatgggggaagatggatgttggtatggcatggagattaggccaatctcagaaaaggaggagaatatggtgaaaagcctggtctctgccggttccggcaaggtggacaacttcactatgggggctttgtgcctcgccatactgtttgaagaggttatgcgcggaaagttcggcaaaaagcatatgattgcaggggtgttctttacattcgtcctactgctcagtggacagatcacctggcgggatatggctcacacgctgatcatgattggcagcaatgcctctgacagaatgggtatgggggtgacttaccttgcattgatcgccacctttaaaattcagcccttcctggctttaggatttttcctcaggaagctgacatcccgcgaaaaccttctgctaggcgttggcctcgcgatggccaccactctgcaattgccggaggatatagaacagatggcaaatgggatcgctctgggattaatggccctcaaactgattacacagtttgagacctatcagctttggacagccctgatctcattgacttgtagtaacaccattttcacgctcacagtggcttggcgaaccgcaactctgatcctagccggtgtcagcctgcttcctgtatgccaatcgtcctctatgcggaagaccgactggctcccaatgacagtggcggctatgggcgttccccctctgcccttgtttatattcagcctgaaggatactttaaaacgtagatcatggccactcaatgagggggtgatggccgtcggactggtgagtatccttgcatcctctctgttgaggaacgacgtacctatggccggccccctcgtggctggtgggctgctaattgcatgttacgtcatcaccggaacgagcgccgatctgacagttgaaaaggcggctgacgtgacctgggaggaagaggccgaacagactggcgtgtcccataaccttatgattacagtcgacgatgacggcaccatgcgcatcaaagatgacgagactgagaatatactcacagtgctgttgaagaccgcattactgattgtttcagggatctttccatacagcatcccggccacgctcctggtatggcacacttggcagaaacagacccaacggagtggagtgctttgggatgtcccttctcccccagaaacacagaaggctgagctggaagagggtgtgtatagaattaaacagcagggcatattcgggaagacccaagttggagtgggcgtccagaaggagggtgtgtttcatacaatgtggcacgtaactaggggggccgtcttgacctacaacggaaaacgactagaacccaattgggcatccgtgaagaaagacctgatcagctatggcggcgggtggcgcctctcggctcagtggcaaaagggagaggaagttcaggtgattgccgtcgagcctggtaaaaacccaaagaatttccagacgatgcccggcacattccagactaccacaggggaaatcggagcgattgccctggattttaagcctggcacctcaggttctccgatcataaaccgggaggggaaagtggttggactttacggcaatggcgtggtcactaagaacgggggatatgtgagtggtatcgcacaaaccaatgctgagccagacggccccacacctgaattagaggaagagatgttcaaaaagagaaacctgacgattatggatctccacccagggtccggaaaaactaggaagtacttgcccgccatcgtacgtgaagctattaagcgccggctgagaaccctcatcctggcacctacaagggtggttgccgccgagatggaggaagctcttaaaggcctgccgatacgatatcagaccactgcgacaaagagcgagcataccggtcgggaaattgtcgacttgatgtgccacgcaacgtttactatgcgcctactgtctcccgtgagagtgccaaattacaacctcatcatcatggatgaggcccatttcacagaccctgctagcattgccgcaagggggtacatctccacccgggtcggaatgggcgaagccgctgcgatatttatgaccgccactcccccaggcacagcagatgctttccctcagtcaaatgcccccattcaggacgaggagcgagacatcccagaaagaagttggaacagcgggaatgagtggattaccgattttgcaggaaaaacagtatggttcgtgccgtctatcaaggccggtaacgacatagctaactgtttacgcaaaaatggcaagaaggttattcaactgtccaggaaaacttttgatacggaatatcagaagaccaaacttaacgactgggatttcgtggtcacaactgacatctcagagatgggggccaattttaaggcggatcgtgtgatcgaccctcggagatgcctgaaacccgttattctcaccgatggaccagagagggtgatcttggcaggccccatgcctgtcacagccgctagtgccgctcagcgccgaggtagagtggggcggaacccacagaaggaaaatgaccaatacattttcaccggccagcccctgaacaatgatgaggaccacgcacattggactgaagccaagatgctcctggacaacataaatacgcctgagggaatcattccggctcttttcgaaccagagagggagaaaagcgccgcaatcgatggcgaatatcgcctaaagggggagtcccgtaaaacctttgtagaactgatgagacggggagacttgcccgtgtggttagcgcacaaggttgcctctgagggtatcaaatacacagataggaagtggtgcttcgacggccagcgcaacaatcagattctggaagagaacatggatgtcgagatatggactaaagaaggggagaagaagaaactccgacctagatggctggacgctcggacctattcggatccccttgccctgaaggaatttaaagacttcgcagctggaaggaagagcatcgccctcgatttggtgacagagattggccgcgtgccatcacacctggcacatagaaccaggaatgccctagacaacctggtcatgctccacacttccgaacatggtgggaaagcttaccggcacgcggttgaggagcttcctgaaacaatggagacgctgttattgctgggcctcatgatcctgcttaccggaggcgccatgctgtttctcattagtgggaagggaatcggtaagacttctataggcttgatctgtgtgattgcaagctccgggatgctgtggatggctgaaatccccttacaatggattgcctcagccatcgtactagagttctttatgatggtgctgctcataccagagcctgaaaaacagcgtacaccgcaggataatcaacttgcatatgtcgtgattggaatcctgaccttggctgccattatcgcggctaacgagatgggcctgctcgaaaccacaaagcgcgacctgggtatgtctaaagagcccggggttgtgagcccaactagttaccttgatgtcgacctccaccctgcctccgcatggacgctgtacgccgtagctaccacagtgataactcccatgttgcgacataccatcgaaaatagcacagcaaacgtttctctggccgcgattgctaaccaggccgtggtcttaatgggcctagacaagggatggccaatctcaaaaatggatctgggcgtgcctctccttgcactggggtgctattcccaggtcaatcccttgaccctgactgccgctgtgctcctgcttattacgcactacgccatcataggaccgggcttacaggcaaaggctacaagagaggcccaaaagaggaccgcggccggtattatgaaaaacccaactgttgacgggatcatgaccatcgatctggaccctgtgatttatgatagtaagttcgagaaacagctcggacaggtaatgttgctggtgctatgtgcagtccagctgctccttatgcggacaagctgggctctgtgcgaagccttgactctggcaaccggccccatcacaacgctctgggagggttcgccaggcaagttttggaataccactatagctgtttctatggccaacattttccgcgggtcctacctggccggagcgggcttagcttttagcatcatgaaatcagtggggacaggaaagagaggcaccggtagtcaaggggaaactcttggagagaagtggaaaaagaaactgaatcagctctctaggaaggaattcgacctatataaaaagtccggcattacagaggtcgatcggaccgaggcaaaagaaggtctgaagcgaggcgagatcacgcatcacgccgtgagcagagggtcagctaagttgcagtggtttgtagaacgcaacatggtgatacccgagggaagggttatcgacctgggctgtgggcggggaggctggagttactattgcgccggtctcaaaaaggtgaccgaagtccgtgggtacacaaaaggaggccctggccatgaggagccggtgcccatgagcacttacgggtggaatattgtcaagcttatgtccggaaaagatgtgttctatctgccacctgaaaagtgtgacaccttgctgtgcgatatcggtgagtctagcccctcccctacagttgaagagtcaagaactattagggtactcaagatggtggagccatggttaaaaaacaatcagttctgtatcaaggtcctgaacccctacatgcctaccgtgattgaacaccttgagcgcctgcaacggaaacacggcgggatgctagttcgaaatccactctctagaaacagtacacatgaaatgtattggatctcgaatggaaccggcaacatagtggcaagcgtcaatatggtgtccaggctgttgctgaaccgctttactatgacgcaccggagacccacaattgagaaggacgtagatctcggtgccgggacccgtcatgtgaacgctgaaccggagactcctaatatggacgttatcggagagaggatcaaacggattaaggaagagcacaactctacctggcactacgacgatgaaaatccatataagacatgggcgtaccatggctcatatgaggtcaaagccacgggcagcgcatccagtatgataaacggggtggtgaagcttctgaccaaaccctgggacgtcgttcctatggtgactcagatggctatgacagataccactccattcggacagcaacgcgtatttaaggaaaaagtggacacacgaacccccagatctatgccgggtacaaggcgggtcatgggcatcactgccgagtggttatggcgcaccctggggagaaataagaagcctaggttgtgcacgcgagaggaattcaccaaaaaggtgcggacaaacgcagccatgggagctgtttttactgaggaaaatcagtgggatagcgccaaagcggcagtggaggacgaagatttctggaccctcgtcgaccgtgagagagagctgcacaagctaggcaaatgtggttcatgcgtgtacaacatgatggggaagcgcgaaaaaaagcttggagagtttggcaaggccaaaggctccagggctatttggtacatgtggctgggggcccggtatctcgaattcgaggcactgggatttttgaatgaggatcattggttcagtagagaaaacagctactctggtgtagagggcgaagggctgcacaagctcggatatatccttcgcgacatttccaaaatccccggcggtgctatgtacgccgatgacacagctgggtgggacactaggataaccgaggatgacctgcataatgaagagaagatcacgcagcagatggatccagagcaccgacaattagccaacgcaatttttaaactgacatatcagaataaggttgtgaaggtccagcggcctacccccactggaacagtgatggacatcatttcaagaaaagatcagaggggcagcggccaagtggggacctacggattgaacactttcaccaatatggaagcgcagctcatccgccagatggagggtgaaggcgtcctgtcgaaggccgacctagagaacccacaccttcccgaaaaaaagataacacagtggctggagacgaaaggggttgagcgtctcaagcggatggctatttctggagatgactgcgtggtaaagcctatcgatgacagatttgccaacgcactgttggctttaaatgatatgggcaaagtgaggaaggacatcccacaatggcagccgagtaaaggttggcatgattggcagcaggtccccttctgttcccaccatttccacgaactgattatgaaggacgggcgcaaactcgtggttccttgccgaccacaagacgagcttataggacgggccagaatcagccagggcgcaggctggtcactgagggaaaccgcctgtctagggaaggcgtatgctcagatgtggtccctgatgtactttcaccgcagagatctccggttggcctctaacgcaatttgcagcgccgtgcccgtccattgggtgcctactagtaggacaacctggtccatccacgctcatcaccaatggatgactacagaggacatgctgaccgtatggaatcgtgtttggattgaagataacccatggatggaggacaagacgcccgtgacaacctgggagaatgtcccttaccttggaaaacgagaagatcagtggtgtggtagcctgatcggcctcacttctcgcgccacctgggcacagaacataccgacagctatccagcaagtgagatcattaattgggaatgaggaattcctggactatatgccaagtatgaagcggtttaggaaagaggaggaatccgagggagccatctggtga

SEQ ID NO: 15404 - RNA, 9873 nt, synthetic construct
  misc_feature 1..9873: note = derived and/or modified CDS sequence (opt3) from DENV-3__EU529703__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgccttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcagaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgcgccctgtaaaatccctttctccacagaggacggccaaggtaaggcacataacgggcgtcttataactgccaatccagtggttaccaaaaaggaggaacccgtgaacattgaggctgaaccgcctttcggcgagtcaaatatcgtaatcggaattggcgataacgccttgaaaatcaattggtataagaaggggagcagtattggaaaaatgtttgaagcaacagcccgcggtgctagaaggatggccatactgggcgacactgcatgggatttcgggtctgtcggaggcgtgctcaactccctgggtaagatggttcaccagatctttgggagcgcgtacaccgctcttttctcgggcgtgtcttgggtcatgaaaattggaatcggcgtgctgttgacgtggatcgggctcaattccaagaacacatcaatgagttttagctgcattgccataggaatcattaccctgtatttaggcgcagtagtgcaggccgacatgggttgtgttatcaattggaaagggaaggagctgaagtgcggatccggcattttcgtcactaacgaggtgcatacatggaccgaacagtacaaatttcaagctgattctcccaagcggctagccactgcaatcgctggtgcctgggagaatggcgtgtgtgggatacgaagcaccacacgcatggaaaacctcctgtggaaacagatcgcgaatgagcttaactatattttgtgggaaaataacatcaagctgacggtcgttgtgggagacattatcggcgtgctcgagcaggggaaaagaaccctgactccacagcctatggagttaaagtactcatggaaaacatggggaaaggccaagatagtaaccgctgaaacacaaaacagttccttcattatcgatggccccaatactccagagtgccccagcgcatctagggcctggaacgtctgggaagtggaggactatggttttggggttttcaccacgaatatttggctgaaacttcgggaagtgtacacacagttgtgtgaccaccgcctcatgtcagctgccgtcaaggatgagagagcagtgcacgcggacatgggatactggatcgagagtcagaaaaacggcagctggaagctggaaaaagcctccctaatagaggttaagacctgcacttggcctaagtctcataccctgtggtcgaatggtgtgctcgaaagcgatatgatcattccaaaatccctggctggcccgatctcacagcacaaccataggcccgggtatcacacacaaactgccggaccttggcaccttggcaagttggagctggactttaattactgcgaggggaccacagtagtcattacggaaaactgtggaacccgtggcccaagtttacggactacaaccgtgtctggtaaactcatccatgagtggtgctgtcgaagctgcactctgccccctcttagatatatgggggaagatggatgttggtacggcatggagataaggccaatttccgaaaaggaggagaatatggtgaaatcactggtcagcgcaggttctggcaaggttgacaacttcacaatgggggtgttgtgcctcgctatcctgtttgaagaggtaatgcgcggaaagttcggcaaaaagcacatgatcgccggggtgttctttaccttcgtcctactgctctccggacagattacgtggcgggatatggcacatactctgatcatgattggcagtaatgccagcgacagaatgggtatgggggtgacctatcttgctttgatagcgacatttaaaatccagcccttcctggccttaggatttttcctcaggaagctgacctctcgcgaaaaccttctgctaggcgttggcctcgcaatggctactacactgcaattgccggaggatattgaacagatggccaatgggatcgccctgggattaatggctctcaaactgattacccagtttgagacataccagctttggactgcactgatctccttgacctgttcaaacacgatattcacactcaccgtggcctggcgaactgcgaccctgatcctagctggtgtcagtctgcttcctgtgtgccaaagctcgtccatgcggaagacagactggctcccaatggccgttgcagccatgggcgtgccccctctgcccttgtttattttctctctgaaggatactttaaaacgtagaagctggccactcaatgagggggtcatggctgtaggactggtgtcaatccttgcaagttccctgttgaggaacgacgttcctatggccggccccctcgtggcgggtgggctgctaattgcttgttatgtcatcaccggaacgtctgccgatctgacagtggaaaaggcagccgacataacctgggaggaagaggctgaacagactggcgtaagccacaaccttatgattacagtggacgatgacggcaccatgcgcatcaaagatgacgagactgagaatatcctcacagtcctgttgaagaccgccttactgattgtttccgggatatttccatactcaatcccggcaacgctcctggtgtggcatacttggcagaaacagacccaacggagcggagtgctttgggatgtccctagtcccccagaaacacagaaggctgagctggaagagggtgtgtacagaattaaacagcagggcatcttcgggaagacccaagttggagtaggcgtgcagaaggagggtgtctttcacacaatgtggcacgtgactaggggggccgttttgacctataacggaaaacgactagaacccaattgggcgtctgtgaagaaagacctgatttcctacggcggcgggtggcgcctcagcgcccagtggcaaaagggagaggaagtccaggtgatcgcagtagagcctggtaaaaacccaaagaatttccagacgatgcccggcacattccagactaccacaggggaaataggagctatcgccctggattttaagcctggcacctcgggttcaccgattatcaaccgggaggggaaagtcgtgggactttatggcaatggcgttgtgactaagaacgggggatacgtctctggtattgctcaaaccaatgcagagccagacggccccacacctgaattagaggaagagatgttcaaaaagagaaacctgacgatcatggatctccatccagggagtggaaaaactaggaagtatttgcccgccatagtgcgtgaagccattaagcgccggctgagaaccctcatcctggctcctacaagggttgtggcggcagagatggaggaagcccttaaaggcctgccgatccgataccagaccactgctacaaagtccgagcacaccggtcgggaaattgtcgacttgatgtgccatgccacgtttactatgcgcctactgagccccgtgagagtaccaaattataacctcatcataatggatgaggcacacttcacagaccctgcctctattgctgcgagggggtacatcagcacccgggtgggaatgggcgaagccgcagctatttttatgaccgccactcccccaggcacagcagatgccttccctcagtccaatgctcccatccaggacgaggagcgagacataccagaaagatcatggaacagtgggaatgagtggattaccgattttgccggaaaaacagtttggttcgtcccgagcatcaaggcgggtaacgacatcgcaaactgtttacgcaaaaatggcaagaaggtgattcaactgtctaggaaaacttttgatacggaataccagaagaccaaacttaacgactgggatttcgtggtcacaactgacatctccgagatgggggccaattttaaggctgatcgtgtaattgaccctcggagatgcctgaaacccgtgatactcaccgatggaccagagagggttatcttggccggccccatgcctgtgacagctgcatcagccgctcagcgccgaggtagagtcgggcggaacccacagaaggaaaatgaccaatatattttcaccggccagcccctgaacaatgatgaggaccatgcccactggactgaagcaaagatgctcctggacaacatcaatacgcctgagggaatcattccggcgcttttcgaaccagagagggagaaaagtgccgctatagatggcgaataccgcctaaagggggagagccgtaaaacctttgtggaactgatgagacggggagacttgcccgtttggttagcccacaaggtggcatccgagggtatcaaatatacagataggaagtggtgcttcgacggccagcgcaacaatcagattctggaagagaacatggatgtcgagatctggactaaagaaggggagaagaagaaactccgacctagatggctggacgctcggacctactctgatccccttgccctgaaggaatttaaagacttcgcagccggaaggaagtcgattgctctcgatttggtgacagagatcggccgcgtaccaagccatctggcgcacagaaccaggaatgccctagacaacctggtgatgctccatacttcagaacacggtgggcgggcatatcgtcacgctgttgaggagcttcctgaaacaatggagacgctgttattgctgggcctcatgatactgcttaccggaggcgccatgctgtttctcatctccgggaaaggaattggtaagactagtatcggcttgatttgtgtcatcgcctctagcgggatgctgtggatggcagaaatacccttacaatggattgcttccgccatcgtgctagagttctttatgatggtgctgctcattccagagcctgaaaagcagcgcacaccgcaggataatcaacttgcgtacgtcgttatcggaatactgaccttggctgccatcattgcagccaacgagatgggcctgctcgaaaccacaaaacgagacctgggtatgtcaaaggagcccggggtggtatctccaactagctatcttgatgtggacctccatcctgctagtgcatggacgctgtacgccgtcgcgaccacagtgatcactcccatgttgagacacaccattgaaaattccacagctaacgttagcctggccgcaatcgccaaccaggctgtggtcttaatgggcctagacaaaggatggccaatatctaagatggatctgggcgtacctctccttgccctggggtgctactcacaggtgaatcccttgaccctgactgcagctgttctcctgcttattacgcattatgccatcatcggaccgggcttacaggcgaaagccacaagggaggcacaaaagcggaccgctgccggtattatgaagaacccaactgtggacgggatcatgaccatagatctggaccctgtcatttacgattccaaattcgagaagcagctcggacaggtgatgttgctggtcctatgtgcagtgcagctgctccttatgcgcacaagttgggctctgtgcgaagccttgactctggccaccggccccatcacaacgctctgggagggtagcccaggcaaattttggaataccactattgcggtttcgatggctaacatcttcagagggtcttatctggcaggagccggcttagctttttccataatgaagagcgtggggacaggaaaaaggggcaccggttcacaaggggaaactcttggagagaagtggaagaaaaagctgaatcagctcagtcggaaagaattcgacctatacaagaaatctggcatcacagaggtagatcgaaccgaggccaaggaaggtctgaaaagaggcgagattacgcaccatgcagtgtcccgcgggagcgccaagttgcagtggtttgtcgaaaggaacatggttatccccgagggacgggtgattgacctgggctgtgggcgtggaggctggtcatattactgcgctggtctcaagaaagtcaccgaagtgagagggtatacaaagggaggccctggccacgaggagccggtacccatgagtacttacgggtggaatatcgtgaaacttatgagcggaaaggatgttttctacctgccacctgaaaaatgtgacaccttgctgtgcgatattggtgagtcctctcccagccctacagtggaagagtccaggactatccgcgtcctcaagatggtggagccatggttaaagaacaatcagttctgtataaaagtcctgaacccctatatgcctaccgtgattgaacaccttgagcggctgcaacgaaagcatggcgggatgctagttagaaatccactctcaaggaactctacacacgaaatgtactggatcagtaatggaaccggcaacatcgtagcgtcggtgaatatggtcagccgcctgttgctgaaccggtttactatgacgcatagacgtcccacaattgagaaagacgtggatctcggtgccgggaccaggcacgttaacgcagaaccggagactcctaatatggacgtgataggagagcggatcaagcgcattaaagaagagcacaactccacctggcattatgacgatgaaaatccatacaagacatgggcttatcacggctcttacgaggtcaaggccacgggctcagcaagctccatgatcaacggggtggtaaaacttctgaccaagccctgggacgtggttcctatggtcactcagatggccatgacagataccactccattcggacagcaacgagtgtttaaagaaaaggtggacacaagaacccccaggagtatgccgggtacacggcgcgtcatgggcattactgctgagtggttatggagaaccctggggaggaataaaaagcctcgattgtgcacgcgggaggaattcaccaagaaagttcgtacaaacgccgcgatgggagcagtgtttactgaggaaaatcagtgggattctgccaaggctgccgtagaggacgaagatttctggaaactcgtggacagagagcgcgagctgcataagctaggcaaatgtggtagctgcgtctataacatgatggggaagagggaaaaaaagcttggagagtttggcaaggcaaaaggctcacgggctatctggtacatgtggctgggggccagatacctcgaattcgaggctctgggatttttgaatgaggatcactggttctcccgcgaaaacagttatagcggtgtggagggcgaagggctgcataagctcggatacatacttagggacatctctaaaattcccggcggtgccatgtatgcagatgacaccgcggggtgggacacacgaatcactgaggatgacctgcacaatgaagagaagattacccagcagatggatccagagcaccggcaattagccaacgctatctttaaactgacgtaccagaataaggttgtgaaggtccagagacctacacccaccggaactgtgatggacataatttccaggaaagatcagcgcggctcaggccaagtagggacatatggattgaacaccttcactaatatggaagcccagctcatccgtcagatggagggtgaaggcgttctgagcaaggcagacctagagtcgcatcaccttccagaaaaaaagatcacccagtggctggagacaaaaggggtggagcggctcaagagaatggctatttctggagatgactgcgtcgtgaagcccatagatgacaggtttgccaacgcactgttggccttaaacgatatgggcaaagtgcgcaaggacatccctcaatggcagccaagtaaaggttggcatgattggcagcaggtcccgttctgttcccaccacttccatgaactgattatgaaggacgggcgaaaactcgttgtgccctgccggcctcaagacgagcttatcggaagagcgaggattagccagggcgctggctggtcactgcgcgaaacggcctgtctagggaaggcatacgcccagatgtggtccctgatgtattttcacagacgggatctcaggttggcttctaatgccatctgcagcgcagtaccagtgcattgggtccccaccagtcgtactacatggtccatacacgctcatcaccaatggatgaccactgaggacatgctgacagtgtggaaccgagtttggatcgaagataatccttggatggaggacaagaccccagtgacgacatgggagaacgtcccctaccttggaaaacgcgaagatcagtggtgtggtagcctgattggcctcacctctagagccacttgggcgcagaatatccctaccgctattcagcaagtgcggtcattaatcgggaacgaggaattcctggactacatgccgagtatgaagaggtttcgcaaagaggaggaatccgagggagccatttggtga

SEQ ID NO: 15405 - RNA, 9873 nt, synthetic construct
  misc_feature 1..9873: note = derived and/or modified CDS sequence (opt3) from DENV-3__EU529705__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcattgggaacagagactttgtagaaggattgtcaggtgccacctgggttgatgtggtcctggagcacggcgggtgcgtgacgactatggcgaagaataaacccacactagacatcgagctccagaagaccgaagcaactcaactggccacacttaggaaactgtgtattgagggaaagatcaccaacataacgaccgatagccggtgccctacacagggcgaagctgtgttgccagaggaacaggaccagaattatgtctgtaaacacacttacgttgatcgcggttgggggaacggatgcggcctcttcggcaaggggagtctggtgacctgcgccaagtttcaatgtttagagcccattgagggaaaagtagtgcagtatgaaaatctgaagtacacagtcatcattactgtgcataccggtgaccagcaccaggttggcaacgagacacaaggggtgaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacagaattcagggggaacaagtatcttcgcaggtcatctgaagtgtcggttaaaaatggacaagctgggcctaaaagggatgagctacgccatgtgcactaacacctttgtcctcaagaaagaggtgtctgagacgcagcacggaaccattctgatcaaggtcgaatacaagggcgaggatgtgccctgtaaagttcctttctccacagaagacggtcaagggaaggctcattcaggccgtcttataactgcgaacccagtggtaaccaaaaaggaggagcccgtcaatattgaagcagagccgcctttcggagaaagcaacatcgtgatcggcattggggataatgccttgaaaatcaactggtataagaagggaagttctattggtaaaatgtttgaggctacagcccgcggcgcaagaaggatggccatactgggggacactgcttgggatttcggatccgttggcggtgtgctcaatagcctggggaagatggtccaccagatctttggctcggcctacaccgcacttttctctggagtgtcctgggtaatgaaaattggcatcgggatcctgttgacgtggattggactcaactcaaagaatacaagtatgagcttttcctgcatagtgatcggcattatcaccctgtatttaggtgcggttgtccaggctgacatggggtgtgtgattaactggaaaggaaaggaactgaagtgcggctctggtatcttcgtgactaatgaggtccatacatggaccgagcagtacaaatttcaagccgatagccccaagcggctagcaactgccatagctggcgcctgggaaaacggggtttgtggaatccgatcaaccacacgcatggagaatctcctgtggaaacagattgcaaacgaacttaattatatcttgtgggagaacaatattaagctgacggtggtggtaggcgacatcataggggtcctcgaacagggaaaaagaaccctgactccacagcctatggagttaaagtacagttggaaagcttggggcaaggccaagattgtgacagcggagacccaaaactccagcttcatcattgatggtcccaacacaccagaatgcccctctgcctcaagggcttggaatgtttgggaggtggaagactatgggtttggagtcttcactaccaacatctggctgaaacttcgggaggtgtacacgcagttgtgtgaccaccgcctcatgagtgcagccgttaaggatgaaagagctgtgcacgccgacatgggctactggatagagagccagaaaaatggttcctggaagctggagaaagcatctctaatcgaagtaaagacatgcacctggcctaagtcgcatactctgtggagcaacggcgtcctcgagtccgatatgattatcccaaaatcactggcggggccgattagtcagcacaattataggcccggataccatacccaaacagccggcccttggcaccttgggaagttggaactggactttaactattgcgagggaactaccgtggtgatcacagagaattgtggcacgcgtggtccatctttacggaccactacagtcagcgggaaactcatacacgaatggtgctgtcgatcctgcaccctgccccctcttagatacatgggagaggatggctgttggtatggtatggaaattaggccaatctcagagaaggaagagaacatggttaaaagcctggtgtctgctggctccgggaaggtagacaatttcactatgggagtgttgtgcctcgccatcctgtttgaggaagtcatgcgcggcaagttcgggaaaaagcatatgattgcaggagtgttctttacattcgttctactgctcagtggccagatcacctggcgggatatggctcacacgctgattatgataggtagcaacgcctctgacagaatggggatgggagtgacttaccttgcattgatcgccacctttaaaattcagcccttcctggctttaggctttttcctcaggaagctgacatcccgcgagaatcttctgctaggcgtcgggctcgcgatggccaccactctgcaattgccggaagatatcgagcagatggcaaacggaattgctctgggtttaatggccctcaaactgatcacacagtttgaaacctatcagctttggacagccctgatatcattgacttgtagtaataccatcttcacgctcacagtggcttggcgaaccgcaactctgattctagccggcgttagcctgcttcctgtgtgccaatcgtcctctatgcggaagaccgactggctcccaatgacagtcgcggctatgggggtaccccctctgcccttgtttatcttcagcctgaaggatactttaaaacgtagatcatggccactcaacgagggagtgatggccgttggcctggtgagtattcttgcatcctctctgttgaggaatgacgtccctatggccggtcccctcgtggctgggggactgctaatcgcatgttacgtaataaccggcacgagcgccgatctgacagtggagaaggcggctgacgtcacctgggaagaggaagccgagcagactggcgtttcccataaccttatgattacagtggacgatgacgggaccatgcgcatcaaagatgacgaaactgagaacatcctcacagtgctgttgaagaccgcattactgattgtctcaggaatatttccatacagcatcccggccacgctcctggtgtggcacacttggcagaaacagacccaacggagtggtgttctttgggatgtaccttctcccccagagacacagaaggctgaactggaggaaggcgtgtatagaattaaacagcaggggatcttcggaaagacccaagtcggcgtgggtgttcagaaggagggggtgtttcatacaatgtggcacgtcactaggggagccgtgttgacctacaatggcaaacgactagagcccaactgggcatccgtaaagaaagacctgattagctatggcgggggatggcgcctctcggctcagtggcaaaagggtgaagaggtccaggtgatcgccgttgaacctggcaaaaatccaaagaacttccagacgatgcccgggacattccagactaccacaggagagataggcgcgatcgccctggattttaagcctggtacctcagggtctccgattatcaatcgggaaggaaaagtggtcggcctttacggcaacggggtggttactaagaatggaggttatgtgagtggcattgcacaaaccaacgctgagccagacgggcccacacctgagttagaagaggaaatgttcaaaaagagaaatctgacgatcatggatctccacccaggatccggcaaaactaggaagtacttgcccgccatagtccgtgaggctattaagcgccggctgagaaccctcatcctggcacctacaagggtggtagccgccgaaatggaggaggctcttaaaggtctgccgatccgatatcagaccactgcgacaaagagcgaacataccgggcgggagattgtggacttgatgtgccacgcaacgtttactatgcgcctactgtctcccgttagagtcccaaactacaatctcatcataatggatgaagcccatttcacagaccctgctagcattgccgcaaggggatacatctccacccgggtgggcatgggcgaggccgctgcgatttttatgaccgccactcccccagggacagcagatgctttccctcagtcaaacgcccccatccaggacgaagagcgagacataccagagagaagttggaatagcggaaacgaatggattaccgattttgcaggtaaaacagtgtggttcgtcccgtctatcaaggccggcaatgacatcgctaactgtttacgcaaaaacgggaagaaggtaattcaactgtccaggaaaacttttgatacggagtatcagaagaccaaacttaatgactgggatttcgtggttacaactgacatctcagaaatgggagccaactttaaggcggatcgtgtgattgaccctcggagatgcctgaaacccgtcatactcaccgatggcccagagagggtgatcttggcaggtcccatgcctgttacagccgctagtgccgctcagcgccgagggagagtgggccggaatccacagaaggagaacgaccaatacattttcaccggacagcccctgaataacgatgaagaccacgcacattggactgaggccaagatgctcctggacaatatcaacacgcctgaaggcatcattccggctcttttcgagccagaaagggagaaaagcgccgcaatagatggggagtatcgcctaaagggagaatcccgtaaaacctttgtcgagctgatgagacggggtgacttgcccgtgtggttagcgcacaaggtagcctctgaaggcatcaaatacacagataggaagtggtgcttcgacgggcagcgcaataaccagattctggaggaaaatatggatgtggagatctggactaaagagggagaaaagaagaaactccgacctagatggctggacgctcggacctattcggatccccttgccctgaaggagtttaaagacttcgcagctggcaggaagagcattgccctcgatttggttacagaaatcggtcgcgtcccatcacacctggcacatagaaccaggaacgccctagacaatctggtgatgctccacacttccgagcatgggggccgggcttaccgtcacgcggtggaagagcttcctgagacaatggaaacgctgttattgctgggactcatgatactgcttaccggcggggccatgctgtttctcatcagtggaaaaggtattggcaagacttctatcgggttgatttgtgtcatcgcaagctccggaatgctgtggatggctgagatacccttacaatggattgcctcagccatcgttctagaattctttatgatggtgctgctcattccagagcctgagaagcagcgcacaccgcaggataaccaacttgcatatgtagtgatcggcatactgaccttggctgccatcattgcggctaatgaaatgggtctgctcgagaccacaaaacgagacctggggatgtctaaggaacccggcgtcgtgagcccaactagttaccttgatgttgacctccaccctgcctccgcatggacgctgtacgccgtggctaccacagtcatcactcccatgttgagacataccattgagaacagcacagcaaatgtatctctggccgcgatcgctaaccaggccgtggttttaatgggactagacaaaggctggccaatatcaaagatggatctgggggtgcctctccttgcactgggatgctattcccaggtcaaccccttgaccctgactgccgctgtgctcctgcttattacgcactacgccatcatcggcccgggtttacaggcaaaagctacaagggaagcccaaaagcggaccgcggccgggattatgaagaatccaactgtcgacggaatcatgaccatagatctggaccctgtgatttatgatagtaaattcgagaagcagctcggccaggttatgttgctggtgctatgtgcagtacagctgctccttatgcgcacaagctgggctctgtgcgaggccttgactctggcaaccggtcccatcacaacgctctgggaaggctcgccagggaaattttggaacaccactattgctgtgtctatggccaatatcttcagaggatcctacctggccggcgcggggttagcttttagcataatgaagtcagtcggaacaggcaaaaggggtaccgggagtcaaggagagactcttggcgaaaagtggaagaaaaagctgaaccagctctctcggaaagagttcgacctatataagaaatccggtatcacagaagttgatcgaaccgaggcaaaggagggcctgaaaagaggggaaattacgcatcacgccgtgagccgcggatcagctaagttgcagtggtttgtcgagaggaatatggtgatccccgaaggccgggtaattgacctggggtgtggacgtggcggttggagttactattgcgccgggctcaagaaagtgaccgaggttagaggatacacaaagggcggccctgggcatgaagagccggtgcccatgagcacttacggatggaacatcgtcaaacttatgtccggtaaggatgtgttctatctgccacctgagaaatgtgacaccttgctgtgcgatattggcgaatctagcccctcccctacagtcgaggaatcaaggactatccgcgtgctcaagatggttgagccatggttaaagaataaccagttctgtataaaagtactgaatccctacatgcctaccgtgattgagcaccttgaacggctgcaacgaaagcacgggggaatgctagtcagaaacccactctctaggaatagtacacatgagatgtattggatctcgaacggcaccggtaatatcgtggcaagcgttaacatggtgtcccgcctgttgctgaatcggtttactatgacgcacagacgtcccacaattgaaaaagacgtcgatctcggggccggaaccaggcatgtgaacgctgagccggaaactcctaacatggacgtaataggcgagcggatcaagcgcattaaagaggaacacaattctacctggcactacgacgatgagaacccatataagacatgggcgtaccatggctcatatgaagtgaaggccacggggagcgcatccagtatgatcaatggagttgtcaaacttctgaccaagccctgggacgtggtgcctatggtcactcagatggctatgacagataccactccattcggtcagcaacgagtttttaaagagaaggtggacacaagaacccccaggtctatgccgggcacacggcgcgtaatggggattactgccgaatggttatggagaaccctgggaaggaacaaaaagcctcgattgtgcacgcgggaggagttcaccaagaaagtgcgtacaaatgcagccatgggcgctgtctttactgaagagaaccagtgggatagcgccaaggcggcagtggaagacgaggatttctggatcctcgttgacagagaacgcgagctgcacaaactaggtaagtgtgggtcatgcgtgtacaatatgatgggaaaaagggagaagaaacttggcgaatttggcaaggccaaggggtcccgggctatatggtacatgtggctgggagccagatatctcgagttcgaagcactgggttttttgaacgaggatcattggttcagtcgcgagaatagctactctggcgtcgaaggggagggactgcacaaactcggctatatccttagggacatttccaagatccccggtggggctatgtacgccgatgacaccgctggatgggacacacgaattactgaagatgacctgcataacgaggaaaaaatcacccagcagatggatccagagcaccggcaattagcctcagcaatatttaagctgacgtatcagaataaagtggtaaaggttcagagacctacacccaccggcactgtgatggacattatcagcaggaaggatcagcgcggctcggggcaagtcggaacatacggtttgaacaccttcactaatatggaggcgcagctcatccgtcagatggaaggcgagggggtgctgtctaaagccgacctagaaaacccacaccttcccgagaagaaaattacccagtggctggaaacaaagggagtggagcggctcaaaagaatggctataagtggcgatgactgcgtcgttaagcctatcgatgacaggtttgccaatgcactgttggctttaaacgatatgggtaaggtgcgcaaagacattccacaatggcagccgtccaaggggtggcatgattggcagcaggtacccttctgtagccaccatttccacgagctgatcatgaaagacggacgaaagctcgtggtcccttgccggccacaagacgaacttattggcagagccaggatctcacagggcgcagggtggtccctgcgcgagacggcctgtctaggaaaagcgtatgctcagatgtggtctctgatgtactttcacagacgggatctcaggttggccagcaacgcaatatgcagtgccgtgcccgttcattgggtgcctacctcccgtactacatggagcatccacgctcatcaccaatggatgaccactgaagacatgctgacagtctggaatcgagtgtggattgaggataacccatggatggaagacaagacccccgtaacgacatgggagaatgttccttaccttggtaagcgcgaggatcagtggtgtggctctctgatcgggctcacctcaagagccacttgggcacagaacattccgaccgctatccagcaagtgcggagtttaattggaaatgaagagttcctggactatatgccatccatgaaaaggtttcgcaaggaagaggagagcgaaggcgccatatggtga

SEQ ID NO: 15406 - RNA, 9873 nt, synthetic construct
  misc_feature 1..9873: note = derived and/or modified CDS sequence (opt3) from DENV-3__EU596492__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcgtcttactgatgcttgtgactccatcgatgaccatgcgctgtgtaggcgttgggaacagagactttgtggaaggattgtcaggtgcgacatgggtcgatgtggtgctggagcacggcgggtgcgtcaccacgatggcaaagaataaacccactctagacatcgagctccagaagacagaagccacccaactggctactcttaggaaactgtgtattgagggaaagatcacaaacattaccacggatagccggtgccctacccagggcgaagccgcattgccagaggaacaggaccagaattatgtttgtaaacacacatacgtggatcgcggttgggggaacggatgcggcctcttcggcaaggggagtctggtaacttgcgctaagtttcaatgtttagagcccatcgagggaaaagtggtccagtatgaaaatctgaagtacaccgtgataattacagttcatactggtgaccagcaccaggtgggcaacgagacccaaggggtcacagccgaaatcacccctcaggcgtccactacggaggccattctcccagaatatggaacacttggcctggagtgctctccgcgaaccggtttggacttcaatgagatgatcctactgactatgaaaaacaaggcatggatggtgcatagacagtggtttttcgatctccccctgccttggaccagcggggctacaaccgaaactccaacatggaataggaaagagcttctggtaacgtttaagaacgcccacgctaaaaagcaagaagttgtggtcttgggctcccaggagggagccatgcacaccgcactcactggcgccacagaaatccagaattcagggggaaccagtattttcgctggtcatctgaagtgtcggttaaaaatggacaagctggagctaaaaggcatgagctacgcgatgtgcacaaacacttttgtgctcaagaaagaggtctctgaaacccagcacgggacgatactgatcaaggtggagtacaagggagaagatgcaccctgtaaaattcctttctccaccgaggacggccaaggtaaggcccataacgggcgtcttatcacagctaatccagttgtgactaaaaaggaggaacccgtaaacatagaggccgaaccgcctttcggcgagtcaaatattgtcatcggaatcggcgataacgcattgaaaattaattggtataagaaggggagcagtatcggaaaaatgtttgaagccaccgctcgcggtgccagaaggatggcaattctgggcgacacagcgtgggatttcgggtctgtgggaggcgttctcaactccctgggtaagatggtgcaccagatatttgggagcgcttacactgcccttttctcgggcgtctcttgggtgatgaaaatcggaattggcgtactgttgacctggatcgggctcaattccaagaacacgtcaatgagttttagctgcatcgcaattggaataatcacactgtatttaggcgccgtggttcaggctgacaccggttgtgtcgtgaattggaaagggaaggagctgaagtgcggatccggcattttcgtgactaacgaggtccatacatggaccgaacagtacaaatttcaagccgattctcccaagcggctagcaactgctatcgccggtgcgtgggagaatggcgtttgtgggattcgaagcaccacacgcatggaaaacctcctgtggaaacaggtggccaatgagcttaactatatcttgtgggaaaataacataaagctgacggtggtagtcggagacatcattggcgtgctcgagcaggggaaaagaaccctgactccacagcctatggagttaaagtactcatggaaaacatggggaaaggctaagatcgttaccgcagaaacacaaaacagttccttcattatcgatggccccaatactccagagtgccccagcgcctctagggcttggaacgtgtgggaagtcgaggactatggttttggggtgttcaccacgaatatatggctgaaacttcgggaagtttacacacagttgtgtgaccaccgcctcatgtcagccgcagtgaaggatgagagagcggtacacgccgacatgggatactggattgagagtcagaaaaacggcagctggaagctggaaaaagcttccctaatcgaggtcaagacctgcacttggcctaagtctcataccctgtggtcgaatggtgtgctcgaaagcgatatgattatcccaaaatccctggccggcccgatatcacagcacaactataggcccgggtaccatacacaaactgcaggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatttccgaaaaggaggagaatatggtgaaatcactggtaagcgctggttctggcaaggtggacaacttcacaatgggggtcttgtgcctcgccatcctgtttgaagaggtgatgcgcggaaagttcggcaaaaagcatatgatagcaggggttttctttaccttcgtgctactgctctccggacagattacgtggcgggatatggcccacactctgatcatgatcggcagtaatgctagcgacagaatgggtatgggggtcacctaccttgcgttgattgccacatttaaaatccagcccttcctggcattaggatttttcctcaggaagctgacctctcgcgaaaaccttctgctaggcgtgggcctcgctatggccactacactgcaattgccggaggatattgaacagatggccaatgggatagctctgggattaatggcactcaaactgatcacccagtttgagacatatcagctttggactgccctgatttccttgacctgttcaaacacgatcttcacactcaccgttgcgtggcgaactgctaccctgattctagccggtgtgagtctgcttcctgtctgccaaagctcgtccatgcggaagtctgactggctcccaatgacagtagcagccatgggcgtgccccctctgcccttgtttatcttcagcctgaaggatactttaaaacgtagatcatggccactcaatgagggggttatggctgtgggactggtcagtatacttgcatcctctctgttgaggaacgacgtgcctatggccggccccctcgtagcgggtgggctgctaatcgcttgttacgtgattaccggaacgagcgccgatctgacagtcgaaaaggcagccgacgttacctgggaggaagaggctgaacagactggcgtgtcccataaccttatgatcacagtggacgatgacggcaccatgcgcattaaagatgacgagactgagaatatcctcacagtcctgttgaagaccgccttactgatagtgtcagggatttttccatacagcatcccggcaacgctcctggtttggcacacttggcagaaacagacccggagaagtggagtactttgggatgtgccttctcccccagaaacacaaaaggctgagctggaagagggtgtctataggatcaaacagcagggcattttcgggaagacccaggtgggagttggcgtgcaaaaggagggtgtctttcatacaatgtggcacgtgactcgaggggccgtattgacctacaacggaaaacgcctagaacccaattgggcgtccgtcaagaaagacctgataagctatggcggcgggtggcggctctcggcccagtggcagaagggagaggaagtgcaagttatcgcagtggagcctggtaaaaacccaaagaatttccagacgatgcccggcacattccagactaccacaggggaaattggagctatcgccctggattttaagcctggcacctcaggttctccgattatcaacagagaggggaaagtcgtgggactttacggcaatggcgttgtgactaagaacgggggatatgtcagtggtatagctcagaccaatgcagagccagacggccccacacctgaattagaggaagagatgttcaaaaagaggaacctgacgatcatggatctccacccagggtccggaaaaactcgtaagtacttgcccgccattgtgcgcgaagccatcaagcggagactgaggaccctcattctggctcctacacgagtagtggcggcagagatggaggaagcccttaaaggcctgccgatccggtatcaaaccactgctacaaagagcgagcataccggtcgcgaaatagttgacttgatgtgccacgccacgtttactatgagactactgtctcccgtcagggtgccaaattacaacctcattatcatggatgaggcacatttcacagaccctgccagcatcgctgcgcgggggtacatttccacccgagtgggaatgggcgaagccgcagctatctttatgaccgccactcccccaggcacagcagatgccttccctcagtcaaatgctcccatacaggacgaggagagagacattccagaacgcagttggaacagcgggaatgagtggatcaccgattttgccggaaaaacagtctggttcgtaccgtctattaaggcgggtaacgacatcgcaaactgtttaaggaaaaatggcaagaaggtgatacagctgtcccgtaaaacttttgatacggaatatcaaaagaccaaacttaacgactgggatttcgttgtgacaactgacatttcagagatgggggccaattttaaggctgatcgggtcatcgaccctagaaggtgcctgaaacccgtgatcctcaccgatggaccagagcgcgttattttggccggccccatgcctgtgacagctgcaagtgccgctcagcgaagaggtcgggtcgggaggaacccacagaaggaaaatgaccagtacatcttcaccggccaacccctgaacaatgatgaggaccacgcccattggactgaagcaaagatgctcctggacaacattaatacgcctgagggaataatcccggcgcttttcgaaccagagcgcgagaaaagcgccgctattgatggcgaatatcgtctaaagggggagtccagaaaaacctttgtggaactgatgcggaggggagacttgcccgtatggttagcccacaaggtggcatctgagggtatcaaatacacagatcgcaagtggtgcttcgacggccagcgaaacaatcagatcctggaagagaacatggatgttgagatttggactaaagaaggggagaagaagaaactcagacctcggtggctggacgctaggacctattcggatccccttgccctgaaggaatttaaagacttcgcagccggacgcaagagcatagctctcgatttggtcacagagatcggcagagtgccatcacacctggcgcataggacccggaatgccctagacaacctggtgatgctccacacttccgaacatggtgggaaagcataccgtcacgctgtcgaggagcttcctgaaacaatggagacgctgttattgctgggcctcatgattctgcttaccggaggcgccatgctgtttctcatcagtgggaagggaattggtaagacttctatcggcttgatatgtgttatcgccagctccgggatgctgtggatggcagaaattcccttacagtggatcgcttcagccattgtgctagagttctttatgatggtactgctcatcccagagcctgaaaaacaacgcacaccgcaggataatcagcttgcgtatgtggtcataggaattctgaccttggctgccatcattgcagccaacgagatgggcctgctcgaaaccacaaagcgagacctgggtatgtctaaagagcccggggtggttagcccaactagttaccttgatgtggacctccaccctgcttccgcatggacgctgtacgccgtcgcgaccacagtaatcactcccatgttgagacataccatagaaaatagcacagctaacgtgtctctggccgcaatcgccaaccaagctgttgtgttaatgggcctaaataagggatggccaatttcaaaaatggacctgggcgtccctctccttgccctggggtgctattcccaggtgaaccccttgaccctgactgcagctgtcctcctgcttatcacgcactacgccattatcggaccgggcttacaggcgaaggccacaagggaggcacagaagcggaccgctgccggtataatgaaaaatccaactgtggatgggattatgaccatcgacctggatcctgttatctatgacagtaagttcgagaaacaactcggacaggtgatgttgctggtactatgtgcagtgcagctgctccttatgcgcacaagctgggctctgtgcgaagccttgactctggccaccggccccattacaacgctctgggagggttcgccaggcaagttttggaacaccactatcgcggtctctatggctaatatattcagagggtcctacctggcaggagccggcttagcttttagcattatgaaatcagttgggacaggaaagaggggcaccggtagtcagggggaaactcttggagagaagtggaaaaagaaactgaaccaactctctcggaaggaattcgatctatataaaaagtccggcatcacagaggtggaccgaaccgaggccaaagaaggtctgaagagaggcgagattacgcatcacgcagtcagccgcgggtcagccaagttgcagtggtttgtggaaaggaatatggtaatccccgagggacgggtgatagatctgggctgtgggcgtggaggctggagttactattgcgctggtctcaaaaaggttaccgaagtgagagggtacacaaaaggaggccctggccatgaggagccggtccccatgagcacttacgggtggaacatcgtgaagcttatgtccggaaaagacgtcttctatctgccacctgaaaagtgtgataccttgctgtgcgacattggtgagtctagcccctcccctacagtggaagagtcaaggactatccgcgttctcaagatggtagagccatggttaaaaaataaccagttctgtattaaggtgctgaatccctacatgcctaccgtcatcgaacaccttgagcggctgcagcgaaaacacggcgggatgctagtgagaaacccactctctaggaatagtacacatgaaatgtattggatttcgaacggaaccggcaatatcgttgcgagcgtgaacatggtctcccgcctgttgctgaaccggtttactatgacgcacagacgtcccacaatagagaaggatgtggacctcggtgccgggaccaggcatgtaaatgcagaaccggagactcctaacatggatgtgattggagagcggatcaaacgcatcaaggaagagcacaattctacctggcactacgacgacgaaaacccatataagacatgggcttaccatggctcatatgaggttaaagccacgggcagcgcatccagtatgattaatggggtcgtgaagcttctgaccaaaccctgggatgtggtccctatggttactcaaatggccatgacagacaccactccattcggacagcagcgagtgtttaaggaaaaagtagatacaagaacccccaggtctatgccgggtacacggcgcgtgatgggcataactgctgagtggttatggagaaccctggggaggaacaagaagcctcgattgtgcacgcgggaggaattcaccaaaaaggtccgtacaaatgccgcgatgggagcagtgtttactgaggaaaaccaatgggacagcgccaaagctgccgttgaggatgaagacttctggaagctcgtggatagagagcgcgagctgcacaaactaggcaagtgtggttcatgcgtctacaatatgatggggaaaagggaaaagaagcttggagagtttggcaaagcaaagggctcccgggctatctggtacatgtggctgggggccagatatctcgaattcgaggctctgggatttttgaacgaggaccattggttcagtcgcgaaaatagctactctggtgtggagggcgaagggctgcacaaactcggatatattcttagggatatctccaagattcccggcggtgccatgtacgcagacgataccgcggggtgggacacacgaatcactgaggacgatctgcataacgaagagaaaataacccagcagatggacccagagcaccggcagttagccaatgctatctttaagctgacgtatcaaaacaaggtagttaaagtgcagagacctacacccaccggaactgtcatggatattatctcaaggaaggaccagcgcggcagcggccaggtggggacatacggattgaataccttcactaacatggaagcccaactcattcgtcagatggagggtgaaggcgtgctgaccaaagcagatctagagaacccacacctttcggaaaagaaaatcacacagtggctggagacgaagggggtcgagcggctcaagagaatggctatatctggagacgattgcgttgtgaaacccattgacgataggtttgccaatgcactgttggccttaaacgacatgggcaaggtacgcaaagatatgcctcagtggcaaccaagtaagggttggcatgactggcagcaggtgccgttctgttcccaccatttccacgaactgatcatgaaagatgggcgaaagctcgtcgtgccctgccggcctcaggacgagcttatcggaagagcgaggattagccaaggcgctggctggtcactgcgcgaaaccgcctgtctagggaaggcatatgcccagatgtggtccctgatgtactttcacagacgggacctcaggttggcttctaatgccatatgcagcgcagttccagtgcattgggtccccactagtcgtacaacctggtccatccacgctcatcaccagtggatgactacagaggatatgctgaccgtgtggaaccgagtatggattgaagacaatccttggatggaggataaaacgccagttacaacctgggagaacgtgccctaccttggaaagcgcgaagaccaatggtgtggtagcctgatcggcctcacttctagagccacctgggcgcagaatattcctacagctatccagcaggtccggtcattaatagggaacgaggaattcctggattatatgccgagtatgaaaaggtttcgcaaggaggaggaatccgagggagccatctggtga

SEQ ID NO: 15407 - RNA, 9873 nt, synthetic construct
  misc_feature 1..9873: note = derived and/or modified CDS sequence (opt3) from DENV-3__EU596493__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcgtcttactgatgcttgtgactccatcgatgaccatgcgctgtgtaggcgttgggaacagagactttgtggaaggattgtcaggtgcgacatgggtcgatgtggtgctggagcacggcgggtgcgtcaccacgatggcaaagaataaacccactctagacatcgagctccagaagacagaagccacccaactggctactcttaggaaactgtgtattgagggaaagatcacaaacattaccacggatagccggtgccctacccagggcgaagccgttttgccagaggaacaggaccagaattatgtgtgtaaacacacatacgtagatcgcggttgggggaacggatgcggcctcttcggcaaggggagtctggtgacttgcgcaaagtttcaatgtttagagcccatcgagggaaaagtcgtgcagtatgaaaatctgaagtacaccgttataattacagtgcatactggtgaccagcaccaggtcggcaacgagacccaaggggtgacagctgaaatcacccctcaggcctccactacggaggcgattctcccagaatatggaacacttggcctggagtgctctccgcgaaccggtttggacttcaatgagatgatcctactgactatgaaaaacaaggcctggatggtacatagacagtggtttttcgatctccccctgccttggaccagcggggcaacaaccgaaactccaacatggaataggaaagagcttctggttacgtttaagaacgctcacgccaaaaagcaagaagtggtcgtgttgggctcccaggagggagctatgcacaccgccctcactggcgcaacagaaatccagaattcagggggaaccagtattttcgccggtcatctgaagtgtcggttaaaaatggacaagctggagctaaaaggcatgagctacgctatgtgcacaaacacttttgtcctcaagaaagaggtgtctgaaacccagcacgggacgatactgatcaaggttgagtacaagggagaagatgcgccctgtaaaattcctttctccaccgaggacggccaaggtaaggcacataacgggcgtcttatcacagccaatccagtggtaactaaaaaggaggaacccgtcaacatagaggctgaaccgcctttcggcgagtcaaatattgtgatcggaatcggcgataacgccttgaaaattaattggtataagaaggggagcagtatcggaaaaatgtttgaagcaaccgcccgcggtgctagaaggatggccattctgggcgacacagcatgggatttcgggtctgttggaggcgtgctcaactccctgggtaagatggtccaccagatatttgggagcgcgtacactgctcttttctcgggcgtgtcttgggtaatgaaaatcggaattggcgtgctgttgacctggatcgggctcaattccaagaacacgtcaatgagttttagctgcatcgccattggaataatcacactgtatttaggcgcagttgtccaggccgacaccggttgtgtgattaattggaaagggaaggagctgaagtgcggatccggcatcttcgtgactaacgaggtccatacatggaccgaacagtacaaatttcaagctgattctcccaagcggctagccactgcaattgctggtgcctgggagaatggcgtttgtgggatccgaagcaccacacgcatggaaaacctcctgtggaaacaggtggcgaatgagcttaactatatattgtgggaaaataacatcaagctgacggtggtagtcggagacattatcggcgtgctcgagcaggggaaaagaaccctgactccacagcctatggagttaaagtactcatggaaaacatggggaaaggccaagattgttaccgctgaaacacaaaacagttccttcatcatagatggccccaatactccagagtgccccagcgcatctagggcctggaacgtgtgggaagtcgaggactatggttttggggtgttcaccacgaatatttggctgaaacttcgggaagtttacacacagttgtgtgaccaccgcctcatgtcagctgccgtgaaggatgagagagcagtacacgcggacatgggatactggatcgagagtcagaaaaacggcagctggaagctggaaaaagcctccctaattgaggtcaagacctgcacttggcctaagtctcataccctgtggtcgaatggtgtgctcgaaagcgatatgatcataccaaaatccctggctggcccgatctcacagcacaactataggcccgggtaccatacacaaactgccggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagattaggccaatctccgaaaaggaggagaatatggtgaaatcactggtaagcgcaggttctggcaaggtggacaacttcacaatgggggtcttgtgcctcgctatactgtttgaagaggtgatgcgcggaaagttcggcaaaaagcatatgattgccggggttttctttaccttcgtgctactgctctccggacagatcacgtggcgggatatggcacacactctgatcatgattggcagtaatgccagcgacagaatgggtatgggggtcacctaccttgctttgatcgcgacatttaaaattcagcccttcctggccttaggatttttcctcaggaagctgacctctcgcgaaaaccttctgctaggcgtgggcctcgcaatggctactacactgcaattgccggaggatatagaacagatggccaatgggatcgccctgggattaatggctctcaaactgattacccagtttgagacatatcagctttggactgcactgatctccttgacctgttcaaacacgattttcacactcaccgttgcctggcgaactgcgaccctgatcctagctggtgtgagtctgcttcctgtctgccaaagctcgtccatgcggaagtctgactggctcccaatgacagtagccgcaatgggcgtgccccctctgcccttgtttatattcagcctgaaggatactttaaaacgtagatcatggccactcaatgagggggttatggccgtgggactggtcagtatccttgcttcctctctgttgaggaacgacgtgcctatggcaggccccctcgtagccggtgggctgctaattgcgtgttacgtgatcaccggaacgagcgctgatctgacagtcgaaaaggccgcagacgttacctgggaggaagaggccgaacagactggcgtgtcccataaccttatgattacagtggacgatgacggcaccatgcgcatcaaagatgacgagactgagaatatactcacagtcctgttgaagaccgctttactgattgtgtcagggatctttccatacagcatcccggccacgctcctggtttggcacacttggcagaaacagacccggagaagtggagtactttgggatgtgccttctcccccagaaacacaaaaggcagagctggaagagggtgtctataggattaaacagcagggcatattcgggaagacccaggtgggagttggcgtgcaaaaggagggtgtctttcatacaatgtggcacgtgactcgaggggctgtattgacctacaacggaaaacgcctagaacccaattgggcctccgtcaagaaagacctgatcagctatggcggcgggtggcggctcaacgcgcagtggcagaagggagaggaagtgcaagttattgccgtggagcctggtaaaaatccaaagaacttccagacgatgcccggcacattccagactaccacaggggaaatcggagcaattgctctggattttaagcctggcacctcgggttcaccgatcataaatagagaggggaaagtcgtgggactttacggcaacggcgttgtgactaagaatgggggatatgtctctggtatcgcccagaccaacgctgagccagacggccccacacctgaattagaggaagagatgttcaaaaagaggaatctgacgattatggatctccacccagggagtggaaaaactcgtaagtacttgcccgcaatcgtgcgcgaagccattaagcggagactgaggaccctcatcctggcccctacacgagtagtggctgcggagatggaggaagcacttaaaggcctgccgatacggtatcaaaccactgccacaaagtccgagcataccggtcgcgaaattgttgacttgatgtgccacgctacgtttactatgagactactgagccccgtcagggtgccaaactacaatctcatcatcatggatgaggcccatttcacagaccctgcatctattgccgctcgggggtacatcagcacccgagtgggaatgggcgaagcggccgcaatatttatgaccgctactcccccaggcacagccgatgcattccctcagtccaacgcccccattcaggacgaggagagagacatcccagaacgctcatggaatagtgggaacgagtggattaccgattttgctggaaaaacagtctggttcgtaccgagcatcaaggccggtaacgacatagcgaattgtttaaggaaaaacggcaagaaggtgattcagctgtctcgtaaaacttttgatacggaatatcaaaagaccaaacttaatgactgggatttcgttgtgacaactgacatctccgagatgggggcaaactttaaggccgatcgggtcatcgaccctagaaggtgcctgaaacccgtgattctcaccgatggaccagagcgcgttatcttggctggccccatgcctgtgacagccgcttcagcagcccagcgaagaggtcgggtcgggaggaatccacagaaggaaaacgaccagtacattttcaccggccaacccctgaataacgatgaggaccacgctcattggactgaagccaagatgctcctggacaatataaacacgcctgagggaatcattccggcacttttcgaaccagagcgcgagaaaagtgcggccatcgatggcgaatatcgtctaaagggggagagcagaaaaacctttgtggaactgatgcggaggggagacttgcccgtatggttagctcacaaggtggcctccgagggtatcaaatacacagatcgcaagtggtgcttcgacggccagcgaaataaccagattctggaagagaatatggatgttgagatatggactaaagaaggggagaagaagaaactcagacctcggtggctggacgcaaggacctattctgatccccttgctctgaaggaatttaaagacttcgccgcaggacgcaagtcgatcgccctcgatttggtcacagagattggcagagtgccaagccacctggctcataggacccggaacgcgctagacaatctggtgatgctccacacttcagaacatggtgggaaagcctaccgtcacgcagtcgaggagcttcctgaaacaatggagacgctgttattgctgggcctcatgatcctgcttaccggaggcgctatgctgtttctcatttccgggaagggaatcggtaagactagtataggcttgatctgtgttattgcctctagcgggatgctgtggatggccgaaatccccttacagtggattgcatccgctatcgtgctagagttctttatgatggtactgctcataccagagcctgaaaaacaacgcacaccgcaggataaccagcttgcctatgtggtcattggaatcctgaccttggcggctattatcgccgcaaatgagatgggcctgctcgaaaccacaaagcgagacctgggtatgtcaaaagagcccggggtggtttctccaactagctaccttgatgtggacctccaccctgccagtgcttggacgctgtacgcagtcgccaccacagtaataactcccatgttgagacataccatcgaaaactccacagcgaacgtgagcctggctgccattgcaaatcaagccgttgtgttaatgggcctagacaagggatggccaatctctaaaatggatctgggcgtccctctccttgctctggggtgctattcacaggtgaaccccttgaccctgactgccgcagtcctcctgcttattacgcactacgctatcataggaccgggcttacaggccaaggcgacaagggaggcccagaagcggaccgcagctggtattatgaaaaatccaactgtggacgggatcatgaccatcgatctggaccctgttatttatgattccaagttcgagaaacaactcggacaggtgatgttgctggtactatgtgccgtgcagctgctccttatgcgcacaagttgggcactgtgcgaagctttgactctggccaccggccccatcacaacgctctgggagggtagcccaggcaagttttggaacaccactatagccgtctcgatggcgaatattttcagagggtcttacctggctggagcaggcttagccttttccatcatgaaaagcgttgggacaggaaagaggggcaccggttcacagggggaaactcttggagagaagtggaaaaagaaactgaaccaactcagtcggaaggaattcgacctatataaaaagtctggcattacagaggtggatcgaaccgaggctaaagaaggtctgaagagaggcgagatcacgcatcacgccgtctcccgcgggagcgcaaagttgcagtggtttgtggaaaggaatatggtaatacccgagggacgggtgatcgacctgggctgtgggcgtggaggctggtcatactattgcgccggtctcaaaaaggttaccgaagtgagagggtacacaaaaggaggccctggccatgaggagccggtccccatgagtacttacgggtggaacattgtgaagcttatgagcggaaaagatgtcttctatctgccacctgaaaagtgtgacaccttgctgtgcgatatcggtgagtcctctcccagccctacagtggaagagtccaggactattcgcgttctcaagatggtagagccatggttaaaaaataaccagttctgtatcaaggtgctgaatccctacatgcctaccgtcattgaacaccttgagcggctgcagcgaaaatatggcgggatgctagtgagaaacccactctcaaggaattctacacacgaaatgtactggatcagtaacggaaccggcaatatagttgcttcggtgaacatggtcagccgcctgttgctgaaccggtttactatgacgcatagacgtcccacaattgagaaggacgtggatctcggtgcggggaccaggcacgtaaatgccgaaccggagactcctaacatggacgtgatcggagagcggatcaaacgcattaaggaagagcataattccacctggcactatgacgatgaaaacccatacaagacatgggcatatcacggctcttacgaggttaaagctacgggctcagccagctccatgataaatggggtcgtgaagcttctgaccaaaccctgggacgtggtccctatggttactcaaatggcaatgacagataccactccattcggacagcagcgagtgtttaaggaaaaagtagacacaagaacccccaggagtatgccgggtacacggcgcgtgatgggcatcactgccgagtggttatggagaaccctggggaggaacaagaagcctcgattgtgcacgcgggaggaattcaccaaaaaggtccgtacaaatgctgccatgggagcggtgtttactgaggaaaaccaatgggattctgcaaaagccgctgttgaggacgaagatttctggaagctcgtggacagagagcgcgagctgcataaactaggcaagtgtggtagctgcgtctacaatatgatggggaaaagggaaaagaagcttggagagtttggcaaagccaagggctcacgggcaatttggtatatgtggctgggggctagatacctcgaattcgaggccctgggatttttgaacgaggatcactggttctcccgcgaaaatagttatagcggtgtggagggcgaagggctgcataaactcggatacatccttagggacatttctaagatccccggcggtgctatgtatgccgatgacaccgcagggtgggacacacgaataactgaggatgacctgcacaacgaagagaaaatcacccagcagatggatccagagcatcggcagttagcgaatgccatttttaagctgacgtaccaaaacaaggtagttaaagtgcagagacctacacccaccggaactgtcatggacatcatttccaggaaggatcagcgcggctcaggccaggtggggacatatggattgaataccttcactaacatggaagctcaactcatccgtcagatggagggtgaaggcgtgctgaccaaagccgacctagagaacccacaccttagcgaaaagaaaataacacagtggctggagacgaagggggtcgagcggctcaagagaatggcaatttcgggagatgactgcgttgtgaaacccatcgatgacaggtttgctaatgccctgttggcattaaacgatatgggcaaggtacgcaaagacatccctcagtggcaaccatctaagggttggcacgattggcagcaggtgccgttctgtagtcatcacttccatgaactgattatgaaagacgggcgaaagctcgtcgtgccctgccggcctcaggacgagcttataggaagagccaggatctcccaaggcgcgggctggagcctgcgcgaaaccgcttgtctagggaaggcctacgcacagatgtggtcactgatgtactttcacagacgggatctcaggttggcctccaatgctatttgctctgccgttccagtgcactgggtccccactagccgtacaacctggagtatccatgcacaccatcagtggatgactacagaggacatgctgaccgtgtggaaccgagtatggattgaagataatccttggatggaggacaaaacgccagttacaacctgggagaacgtgccctatcttggaaagcgcgaagatcaatggtgtggttccctgatcggcctcactagcagagctacctgggcccagaatatacctacagcgatccagcaggtccggtctttaattgggaacgaggaattcctggactacatgccgtcaatgaaaaggtttcgcaaggaggaggaaagtgagggagctatctggtga

SEQ ID NO: 15408 - RNA, 9873 nt, synthetic construct
  misc_feature 1..9873: note = derived and/or modified CDS sequence (opt3) from DENV-3__EU596494__SS-prME
  source 1..9873: mol_type = other RNA
acctccctgtgcctcatgatgatccttcccgcagctctggcattccacttgacttccagagacggcgaacctaggatgattgtggggaagaacgaacggggaaaatctttactgtttaagactgcctcaggtataaatatgtgtacgctaatcgcgatggatctcggcgaaatgtgcgacgataccgtcacttacaaatgtccacatattgctgaagttgaaccggaagacatcgattgctggtgtaacctgacaagtacctgggtgacctatgggacctgcaatcaggccggagaacaccgccgagacaagcgtagcgtagcacttgcaccccatgtgggcatgggtctggatactagaacacaaacctggatgtccgctgaaggggcatggaggcaggtcgaaaaagtggagacgtgggccttgcggcaccctggattcactattctcgctctgtttctggcccattacatcggcacctctctcacacagaaggttgtgatattcgtcttactgatgcttgtgactccatcgatgaccatgcgctgtgtaggcgttgggaacagagactttgtggaaggattgtcaggtgcgacatgggtcgatgtggtgctggagcacggcgggtgcgtcaccacgatggcaaagaataaacccactctagacatcgagctccagaagacagaagccacccaactggctactcttaggaaactgtgtattgagggaaagatcacaaacattaccacggatagccggtgccctacccagggcgaagccgttttgccagaggaacaggaccagaattatgtgtgtaaacacacatacgtagatcgcggttgggggaacggatgcggcctcttcggcaaggggagtctggtgacttgcgcaaagtttcaatgtttagagcccatcgagggaaaagtcgtgcagtatgaaaatctgaagtacaccgttataattacagtgcatactggtgaccagcaccaggtcggcaacgagacccaaggggtgacagctgaaatcacccctcaggcctccactacggaggcgattctcccagaatatggaacacttggcctggagtgctctccgcgaaccggtttggacttcaatgagatgatcctactgactatgaaaaacaaggcctggatggtacatagacagtggtttttcgatctccccctgccttggaccagcggggcaacaaccgaaactccaacatggaataggaaagagcttctggttacgtttaagaacgctcacgccaaaaagcaagaagtggtcgtgttgggctcccaggagggagctatgcacaccgccctcactggctcaacagaaatccagaatagtgggggaaccagcattttcgcaggtcatctgaagtgtcggttaaaaatggacaagctggagctaaaaggcatgtcttacgccatgtgcacaaacacttttgtcctcaagaaagaggtgtccgaaacccagcacgggacgatactgatcaaggttgagtacaagggagaagatgctccctgtaaaattcctttctcaaccgaggacggccaaggtaaggcgcataacgggcgtcttatcacagcaaatccagtggtaactaaaaaggaggaacccgtcaacatagaggccgaaccgcctttcggcgagagcaatattgtgatcggaatcggcgataacgctttgaaaattaattggtataagaaggggagttctatcggaaaaatgtttgaagccaccgcacgcggtgccagaaggatggctattctgggcgacacagcctgggatttcgggtccgttggaggcgtgctcaacagcctgggtaagatggtccaccagatatttgggtcggcatacactgcgcttttctctggcgtgtcctgggtaatgaaaatcggaattggcgtgctgttgacctggatcgggctcaattcaaagaacacgagtatgagcttttcctgcatcgctattggaataatcacactgtatttaggcgccgttgtccaggcagacaccggttgtgtgattaattggaaagggaaggagctgaagtgcggatctggcatcttcgtgactaacgaggtccatacatggaccgaacagtacaaatttcaagccgatagccccaagcggctagctactgccattgccggtgcttgggagaatggcgtttgtgggatccgatcaaccacacgcatggaaaacctcctgtggaaacaggtggccaatgagcttaactatatattgtgggaaaataacatcaagctgacggtggtagtcggagacattatcggcgtgctcgagcaggggaaaagaaccctgactccacagcctatggagttaaagtacagttggaaaacatggggaaaggcgaagattgttaccgccgaaacacaaaactccagcttcatcatagatggccccaatactccagagtgcccctctgcttcaagggcatggaacgtgtgggaagtcgaggactatggttttggggtgttcaccacgaatatttggctgaaacttcgggaagtttacacacagttgtgtgaccaccgcctcatgagtgccgctgtgaaggatgagagagccgtacacgcagacatgggatactggatcgagagccagaaaaacggctcctggaagctggaaaaagcgtctctaattgaggtcaagacctgcacttggcctaagtcgcataccctgtggagcaatggtgtgctcgaatccgatatgatcataccaaaatcactggccggcccgatcagtcagcacaactataggcccgggtaccatacacaaactgctggaccttggcaccttggcaagttggagctggactttaattattgcgaggggaccacagtggtcattacggaaaactgtggaacccgtggcccatctttacggactacaaccgttagcggtaaactcatccacgagtggtgctgtcgatcctgcactctgccccctcttagatacatgggggaagatggatgttggtatggcatggagattaggccaatctcagaaaaggaggagaatatggtgaaaagcctggtatctgccggttccggcaaggtggacaacttcacaatgggggtcttgtgcctcgcaatactgtttgaagaggtgatgcgcggaaagttcggcaaaaagcatatgattgctggggttttctttaccttcgtgctactgctcagtggacagatcacgtggcgggatatggcccacactctgatcatgattggcagcaatgcatctgacagaatgggtatgggggtcacctaccttgccttgatcgctacatttaaaattcagcccttcctggcgttaggatttttcctcaggaagctgacctcccgcgaaaaccttctgctaggcgtgggcctcgccatggcaactacactgcaattgccggaggatatagaacagatggctaatgggatcgccctgggattaatggccctcaaactgattacccagtttgagacatatcagctttggactgctctgatctcattgacctgtagtaacacgattttcacactcaccgttgcatggcgaactgccaccctgatcctagcgggtgtgagcctgcttcctgtctgccaatcgtcctctatgcgtaagagcgactggctcccaatgacagtagctgccatgggcgtgccccctctgcccttgtttatattctcactgaaggatactttaaaacggagaagttggccactcaatgagggggttatggcagtgggactggtctccatccttgcctctagcctgttgaggaacgacgtgcctatggctggccccctcgtagccggtgggctgctaattgcctgttacgtgatcaccggaacgtccgcggatctgacagtcgaaaaggctgccgacgttacctgggaggaagaggcagaacagactggcgtgtcacataaccttatgattacagtggacgatgacggcaccatgcgcatcaaagatgacgagactgagaatatactcacagtcctgttgaagaccgccttactgattgtgagcgggatctttccatacagtatcccggctacgctcctggtttggcacacttggcagaaacagacccggagatctggagtactttgggatgtgccttcgcccccagaaacacaaaaggccgagctggaagagggtgtctataggattaaacagcagggcatattcgggaagacccaggtgggagttggcgtgcaaaaggagggtgtctttcatacaatgtggcacgtgactcgaggggcagtattgacctacaacggaaaacgcctagaacccaattgggctagcgtcaagaaagacctgatcagctatggcggcgggtggcggctctcagcccagtggcagaagggagaggaagtgcaagttattgcggtggagcctggtaaaaacccaaagaatttccagacgatgcccggcacattccagactaccacaggggaaatcggagccattgcactggattttaagcctggcacctctggtagtccgatcataaacagagaggggaaagtcgtgggactttacggcaatggcgttgtgactaagaacgggggatatgtctccggtatcgctcagaccaatgccgagccagacggccccacacctgaattagaggaagagatgttcaaaaagaggaacctgacgattatggatctccacccagggagcggaaaaactcgtaagtacttgcccgctatcgtgcgcgaagcaattaagcggagactgaggaccctcatcctggcccctacacgagtagtggccgctgagatggaggaagcgcttaaaggcctgccgatacggtatcaaaccactgcaacacgctctgagcataccggtagagaaattgttgacttgatgtgccacgccacgtttactatgaggctactgagccccgtccgggtgccaaattacaacctcatcatcatggatgaggctcatttcacagaccctgcctccattgcagcccgagggtacatctcaaccagagtgggaatgggcgaagctgcggccatatttatgaccgcaactcccccaggcacagctgatgccttccctcagagtaatgcacccattcaggacgaggagcgcgacatcccagaaaggagctggaactctgggaatgagtggattaccgattttgccggaaagacagtctggttcgtaccgtccatcaaagctggtaacgacatagccaactgtttacgtaagaatggcaaaaaggtgattcagctgtcacggaagacttttgatacggaatatcagaagaccaaacttaacgactgggatttcgttgtgacaactgacatcagtgagatgggggcgaattttaaagcagatagagtcatcgaccctaggcgctgcctgaagcccgtgattctcaccgatggaccagagcgagttatcttggccggccccatgcctgtgacagctgccagcgctgcacagagacggggtagggtcgggcgcaacccacagaaagaaaatgaccagtacattttcaccggccaacccctgaacaatgatgaggaccacgcccattggactgaagctaagatgctcctggacaacataaatacgcctgagggaatcattccggcccttttcgaaccagagcgtgagaagtccgcagcgatcgatggcgaatatagactaaaaggggagtctcggaagacctttgtggaactgatgaggcgcggagacttgcccgtatggttagcccacaaagtggcttcggagggtatcaagtacacagatcgaaaatggtgcttcgacggccagagaaacaatcagattctggaagagaacatggatgttgagatatggactaaggaaggggagaaaaagaagctccggcctaggtggctggacgcccgcacctatagcgatccccttgcactgaaagaatttaaggacttcgctgccggaagaaaatcaatcgcactcgatttggtcacagagattggcagggtgccatcccacctggcccatcggacccgtaatgctctagacaacctggtgatgctccacacaagtgaacatggtgggaaggcgtaccgccacgccgtcgaggagcttcctgaaacaatggagacgctgttattgctgggcctcatgatcctgcttaccggaggcgcaatgctgtttctcatttctgggaaaggaatcggtaagactagcataggcttgatctgtgttattgcttcctcagggatgctgtggatggccgaaatccccttacagtggattgcctctgcaatcgtgctagagttctttatgatggtactgctcataccagagcctgaaaagcaacgaacaccgcaggataatcagcttgcttatgtggtcattggaatcctgaccttggccgcgattatcgctgccaacgagatgggcctgctcgaaaccacaaaaagagacctgggtatgagcaaggagcccggggtggttagtccaacttcctaccttgatgtggacctccaccctgcaagcgcctggacgctgtacgctgtcgcaaccacagtaataactcccatgttgaggcataccatcgaaaattctacagccaacgtgtcactggcggctattgccaaccaagcagttgtgttaatgggcctagacaaaggatggccaatctccaagatggatctgggcgtccctctccttgccctggggtgctatagtcaggtgaatcccttgaccctgactgctgccgtcctcctgcttattacgcactacgcaatcataggaccgggcttacaggctaaagccacacgggaggcgcagaagcgcaccgccgcaggtattatgaagaacccaactgtggacgggatcatgaccatcgatctggaccctgttatttatgatagcaaattcgagaagcaactcggacaggtgatgttgctggtactatgtgctgtgcagctgctccttatgagaacatcgtgggccctgtgcgaagcattgactctggctaccggccccatcacaacgctctgggagggttctccaggcaaattttggaataccactatagccgtctccatggccaacattttcagggggagctacctggcgggagctggcttagcattttcaatcatgaagagtgttgggacaggaaaacggggcaccggttctcagggggaaactcttggagagaagtggaagaaaaagctgaatcaactctcccgaaaagagttcgacctatataagaaaagcggcattacagaggtggatagaaccgaggccaaggaaggtctgaaacgcggcgagatcacgcatcacgctgtctcaagggggagtgccaagttgcagtggtttgtggaacggaacatggtaatacccgagggacgtgtgatcgacctgggctgtgggagaggaggctggagctactattgcgcaggtctcaagaaagttaccgaagtgagggggtacacaaagggaggccctggccatgaggagccggtccccatgtccacttacgggtggaatattgtgaaacttatgtctggaaaggatgtcttctatctgccacctgaaaaatgtgacaccttgctgtgcgatatcggtgagagctccccctcacctacagtggaagagtctcgcactattcgggttctcaagatggtagagccatggttaaagaacaatcagttctgtatcaaagtgctgaacccctacatgcctaccgtcattgaacaccttgagcgactgcagagaaagcacggcgggatgctagtgaggaatccactcagtcgcaactcgacacatgaaatgtattggatcagcaatggaaccggcaacatagttgcctccgtgaatatggtctctcggctgttgctgaacagatttactatgacgcaccgtaggcccacaattgagaaagacgtggatctcggtgctgggacccggcatgtaaacgcggaaccggagactcctaatatggacgtgatcggagagcgcatcaagcgaattaaagaagaacacaactcaacctggcactacgacgatgaaaatccatataagacatgggcctaccatggcagctatgaggttaaggcaacgggctccgctagttctatgataaacggggtcgtgaaacttctgaccaagccctgggacgtggtccctatggttactcaaatggccatgacagataccactccattcggacagcagagagtgtttaaagaaaaggtagacacaaggacaccccggagcatgccgggtacacgcagagtgatgggcatcactgcagagtggttatggaggaccctggggcgaaataaaaagcctcggttgtgcacgcgtgaggagttcaccaagaaagtcagaacaaacgccgctatgggagccgtgtttactgaggaaaatcaatgggattcagcgaaggcagccgttgaggacgaagatttctggaaactcgtggaccgcgagagggagctgcacaagctaggcaaatgtggttcctgcgtctacaacatgatggggaagcgggagaagaaacttggagagtttggcaaggctaaaggcagtagagccatttggtacatgtggctgggggcacgctatctcgagttcgaggctctgggatttttgaatgaggatcattggttcagcagggaaaactcttactccggtgtggagggcgaagggctgcacaagctcggatatatccttcgagacatttcaaaaatccccggcggtgccatgtacgctgatgacaccgccgggtgggacacacggataactgaggatgacctgcataatgaagagaagatcacccagcagatggatccagagcacagacagttagcaaacgcgatttttaaactgacgtatcaaaataaggtagttaaggtgcagaggcctacacccaccggaactgtcatggacatcattagccgcaaagatcagcgtggctcgggccaggtggggacatacggattgaacaccttcactaatatggaagcccaactcatccggcagatggagggtgaaggcgtgctgaccaaggctgacctagagaacccacacctttctgagaaaaagataacacagtggctggagacgaaaggggtcgagagactcaagaggatggccattagtggagatgactgcgttgtgaagcccatcgatgaccgctttgcaaacgctctgttggccttaaatgatatgggcaaagtacgaaaggacatccctcagtggcaaccatccaaaggttggcatgattggcaacaggtgccgttctgtagccaccatttccacgaactgattatgaaggacgggcggaaactcgtcgtgccctgcagacctcaggacgagcttataggaagggcacgcatctcacaaggcgccggctggtccctgagagaaaccgcgtgtctagggaaggcttatgcccagatgtggtctctgatgtactttcaccggagggatctccgtttggcaagcaacgccatttgcagtgctgttccagtgcattgggtccccacttcccgaacaacctggagcatccacgcccatcaccagtggatgactacagaggacatgctgaccgtgtggaatcgcgtatggattgaagataacccttggatggaggacaagacgccagttacaacctgggagaatgtgccctaccttggaaaaagagaagatcaatggtgtggttctctgatcggcctcacttcacgggcaacctgggctcagaacatacctacagccatccagcaggtcaggagtttaattgggaatgaggagttcctggactatatgccgtccatgaagcgctttagaaaagaggaggaaagcgagggagcgatctggtga

SEQ ID NO: 15409 - RNA, 9873 nt, synthetic construct
  misc_feature 1..9873: note = derived and/or modified CDS sequence (opt3) from DENV-3__EU687218__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaaaaatacaagtttcaggcagattctcccaaacggctagccactgctatcgccggtgcatgggagaatggcgtttgtgggatacgaagcaccacacgcatggaaaacctcctgtggaagcaaatcgctaatgagcttaactatattttgtgggaaaataacatcaaactgacggtggtggtaggagacattatcggcgtcctcgagcaggggaagagaaccctgactccacagcctatggagttaaaatactcatggaagacatggggaaaggccaaaatagtgaccgcggaaacacagaacagttccttcattatcgatggccccaatactccagagtgccccagcgcctctagggcttggaacgtttgggaagtggaggactatggttttggggtcttcaccacgaatatttggctgaagcttcgggaagtgtacacacaattgtgtgaccaccgcctcatgtcagcagccgttaaagatgagagagctgtgcacgccgacatgggatactggatcgagagtcagaagaacggcagctggaaactggaaaaggcatccctaatagaggtaaagacctgcacttggcctaaatctcataccctgtggtcgaatggtgtcctcgaaagcgatatgatcattccaaagtccctggcgggcccgatctcacagcacaactataggcccgggtaccatacacagactgccggaccttggcaccttggcaaattggagctggactttaattattgcgaggggaccacagtggtgattacggaaaactgtggaacccgtggcccaagtttacggactacaaccgtctctggtaagctcatccacgagtggtgctgtcgaagctgcactctgccccctcttagatacatgggggaagatggatgttggtatggcatggagataaggccaatttccgaaaaagaggagaatatggttaagtcactggtgagcgctggttctggcaaggtagacaacttcacaatgggggtgttgtgcctcgccatcctgtttgaagaggtcatgcgcggaaaattcggcaagaaacatatgatcgcaggggtgttctttaccttcgttctactgctctccggacaaattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgaaaaccttctgctaggcgtcggcctcgcgatggccactacactgcagttgccggaggatattgaacaaatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccagagctcgtccatgcggaagacagactggctcccaatgactgtcgcggctatgggcgtaccccctctgcccttgtttattttctctctgaaagataccttaaagcgtagaagctggccactcaatgagggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggaaaaagcggctgacgtcacttgggaggaagaggccgaacaaacaggcgttagccataaccttatgataaccgtggacgatgacggcactatgcgcattaaggatgacgagacagagaatatcctcaccgtgctgttgaaaacggcattactgatcgtctccgggatttttccatactcaataccggccactctcctggtgtggcacacctggcagaagcagacacagcggagcggagttctttgggatgtacctagtcccccagaaacccaaaaagctgagctggaagagggtgtgtatagaatcaagcagcagggcattttcgggaagacacaggtcggagtgggcgttcaaaaagagggtgtgtttcatactatgtggcacgtcaccaggggggccgtgttgacgtacaacggaaagcgactagaacccaattgggcatctgtaaaaaaggacctgatctcctatggcggcgggtggcgcctcagcgctcagtggcagaaaggagaggaagtccaagtgattgccgttgagcctggtaagaacccaaagaatttccagacaatgcccggcactttccagaccacaaccggggaaatcggagcgatagccctggattttaaacctggcacttcgggttcaccgatcattaaccgggaggggaaggtggtcggactttacggcaatggcgtggttaccaaaaacgggggatatgtgtctggtatcgcacagacaaatgctgagccagacggccccacgcctgaattagaggaagagatgttcaagaaaagaaacctgactattatggatctccacccagggagtggaaagaccaggaagtacttgcccgccatcgtccgtgaagctataaaacgccggctgagaacactcattctggcacctaccagggtggtagccgccgagatggaggaagctcttaagggcctgccgatccgatatcaaactacagcgaccaaatccgagcatacgggtcgggaaatcgtggacttgatgtgccacgcaacttttacaatgcgcctactgagccccgttagagtcccaaattacaacctcattatcatggatgaggcccatttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaagactgtgtggttcgtcccgagcattaaagccggtaacgacatcgctaactgtttacgcaagaatggcaagaaagtaatccagctgtctaggaagacgtttgataccgaatatcaaaaaacaaagcttaacgactgggatttcgtggttactaccgacatttccgagatgggggccaattttaaagcggatcgtgtgatcgaccctcggagatgcctgaagcccgtcattctcacagatggaccagagagggtgatattggcaggccccatgcctgttaccgccgcttcagccgctcagcgccgaggtagagtggggcggaacccacagaaggaaaatgaccagtacatcttcactggccaacccctgaacaatgatgaggaccacgcacattggacggaagccaaaatgctcctggacaacattaatacccctgagggaatcatcccggctcttttcgaaccagagagggagaagagtgccgcaattgatggcgaatatcgcctaaaaggggagagccgtaagacatttgtcgaactgatgagacggggagacttgcccgtgtggttagcgcacaaagtagcctccgagggtataaagtacactgataggaaatggtgcttcgacggccagcgcaacaatcagatcctggaagagaacatggatgtggagatttggaccaaggaaggggagaagaaaaagctccgacctagatggctggacgctcggacatattctgatccccttgccctgaaagaatttaaggacttcgcagctggaaggaaatcgatcgccctcgatttggttaccgagattggccgcgtcccaagccacctggcacatagaactaggaatgccctagacaacctggtgatgctccacacatcagaacatggtgggaaggcttaccggcacgcggtggaggagcttcctgaaacgatggagaccctgttattgctgggcctcatgatcctgcttactggaggcgccatgctgtttctcatatccgggaagggaatcggtaaaacaagtattggcttgatctgtgtcattgcatctagcgggatgctgtggatggctgaaatccccttacagtggatagcctccgccattgttctagagttctttatgatggtgctgctcatcccagagcctgaaaagcaacgtaccccgcaggataatcagcttgcatatgtagtgattggaatcctgaccttggctgccataatcgcggctaacgagatgggcctgctcgaaacaactaaacgcgacctgggtatgtcaaaggagcccggggtcgtgtctccaacgagctaccttgatgttgacctccaccctgccagtgcatggaccctgtacgccgtggctacaactgtcattacccccatgttgcgacatacaatcgaaaattccaccgcaaacgtaagcctggccgcgattgctaaccaagccgtggttttaatgggcctagacaaaggatggccaatctctaagatggatctgggcgtgcctctccttgcactggggtgctattcacaggtcaatcccttgactctgacggccgctgtgctcctgcttataacacactacgccattatcggaccgggcttacaggcaaaggctaccagagaggcccagaaaaggactgcggccggtatcatgaagaacccaaccgtcgacgggattatgacaatcgatctggaccctgtgatatatgattccaaattcgagaagcaactcggacaggttatgttgctggtgctatgtgcagtacagctgctccttatgcggactagttgggctctgtgcgaagccttgaccctggcaacaggccccattacgaccctctgggagggtagcccaggcaaattttggaatactacaatcgctgtgtcgatggccaacattttccgcgggtcttacctggccggagcgggcttagctttttccatcatgaagagcgtcgggaccggaaagagaggcactggttcacagggggaaacacttggagagaaatggaagaaaaagctgaatcaactcagtaggaaagaattcgacctatataagaaatctggcataaccgaggttgatcggacggaggcaaaggaaggtctgaagcgaggcgagatcacccatcacgccgtgtccagagggagcgctaaattgcagtggtttgtcgaacgcaacatggtgattcccgagggaagggtaatcgacctgggctgtgggcggggaggctggtcatactattgcgccggtctcaagaaagtgacagaagttcgtgggtacactaagggaggccctggccatgaggagccggtgcccatgagtacctacgggtggaatattgtcaaacttatgagcggaaaggatgtgttctatctgccacctgaaaagtgtgacacattgctgtgcgatatcggtgagtcctctcccagccctactgtcgaagagtccagaaccattagggtgctcaaaatggttgagccatggttaaagaacaatcagttctgtatcaaagtactgaacccctacatgcctacagtgatagaacaccttgagcgcctgcagcggaagcacggcgggatgctagtccgaaatccactctcaagaaactctacccatgaaatgtattggattagtaatggaactggcaacatcgtggcatcggttaatatggtgagcaggctgttgctgaaccgctttacgatgacacaccggagacccaccatcgagaaagacgtcgatctcggtgccgggactcgtcatgtgaacgctgaaccggagacccctaatatggacgtaattggagagaggataaagcggatcaaggaagagcacaactccacatggcactacgacgatgaaaatccatataaaacgtgggcgtaccatggctcttatgaggtgaaggccaccggctcagcaagctccatgattaacggggttgtcaaacttctgactaagccctgggacgtggtgcctatggtcacacaaatggctatgaccgatactacaccattcggacagcagcgcgtttttaaagaaaaggtggacacccgaacacccagaagtatgccgggtactaggcgggtaatgggcatcaccgccgagtggttatggcgcacgctggggagaaataagaaacctaggttgtgcacccgagaggaattcacaaagaaagtgcggactaacgcagccatgggagctgtctttaccgaggaaaatcaatgggattctgccaaggcggcagtggaggacgaagatttctggaaactcgttgaccgtgagagagagctgcacaagctaggcaaatgtggtagctgcgtgtacaacatgatggggaagcgcgaaaagaaacttggagagtttggcaaggccaaaggctcaagggctatttggtacatgtggctgggggcccggtatctcgaattcgaggcactgggatttttgaatgaggatcattggttctccagagaaaacagttacagcggtgtcgagggcgaagggctgcacaagctcggatatatccttcgcgacatatctaaaatccccggcggtgctatgtacgccgatgacacagctgggtgggacactaggattaccgaggatgacctgcataatgaagagaagatcacgcagcagatggatccagagcaccgacagttagccaacgcaatttttaagctgacatatcaaaataaagtggtaaaggttcagcggcctacccccactggaacagtgatggacatcatatccagaaaagatcagaggggctcaggccaggtcgggacctacggattgaacactttcaccaatatggaagcgcaactcattcgccagatggagggtgaaggcgtgctgagcaaggccgacctagagaacccacaccttcccgaaaaaaagatcacacagtggctggagacgaagggggtggagcgtctcaaacggatggctatctcgggagatgactgcgtcgttaagcctattgatgacagatttgccaacgcactgttggctttaaatgatatgggcaaagtgaggaaggacataccacagtggcaaccgtctaaaggttggcatgattggcagcaggtacccttctgtagtcaccatttccacgaactgatcatgaaggacgggcgcaagctcgtggtcccttgccgaccacaggacgagcttattggacgggccagaatctcccaaggcgcaggctggagcctgagggaaaccgcctgtctagggaaagcgtatgctcagatgtggtcactgatgtactttcaccgcagagatctccggttggcctccaacgcaatttgctctgccgtgcccgttcattgggtgcctactagcaggacaacctggagtatccacgctcatcaccagtggatgactacagaggacatgctgaccgtctggaatcgtgtgtggatagaagataacccatggatggaggacaagacgcccgtaacaacctgggagaatgttccttaccttggaaaacgagaagatcaatggtgtggttccctgatcggcctcactagccgcgccacctgggcacagaacattccgacagctatccagcaggtgagatctttaattgggaatgaggaattcctggactatatgccatcaatgaagcggtttaggaaagaggaggaaagtgagggagccatctggtga

SEQ ID NO: 15410 - RNA, 9873 nt, synthetic construct
  misc_feature 1..9873: note = derived and/or modified CDS sequence (opt3) from DENV-3__EU726772__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatgactgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggaaaaggcggctgacgtcacttgggaggaagaggccgaacagacaggcgttagccataaccttatgataaccgtggacgatgacggcactatgcgcattaaagatgacgagacagagaatatcctcaccgtgctgttgaagacggcattactgatcgtctccgggatttttccatactcaataccggccactctcctggtgtggcacacctggcagaaacagacacaacggagcggagttctttgggatgtacctagtcccccagaaacccagaaggctgagctggaagagggtgtgtatagaatcaaacagcagggcattttcgggaagacacaagtcggagtgggcgttcagaaggagggtgtgtttcatactatgtggcacgtcaccaggggggccgtgttgacgtacaacggaaaacgactagaacccaattgggcatctgtaaagaaagacctgatctcctatggcggcgggtggcgcctcagcgctcagtggcaaaagggagaggaagtccaggtgattgccgttgagcctggtaaaaacccaaagaatttccagacaatgcccggcactttccagaccacaaccggggaaatcggagcgatagccctggattttaagcctggcacttcgggttcaccgatcattaaccgggaggggaaagtggtcggactttacggcaatggcgtggttaccaagaacgggggatatgtgtctggtatcgcacaaacaaatgctgagccagacggccccacgcctgaattagaggaagagatgttcaaaaagagaaacctgactattatggatctccacccagggagtggaaaaaccaggaagtacttgcccgccatcgtccgtgaagctataaagcgccggctgagaacactcattctggcacctaccagggtggtagccgccgagatggaggaagctcttaaaggcctgccgatccgatatcagactacagcgaccaagtccgagcatacgggtcgggaaatcgtggacttgatgtgccacgcaacttttacaatgcgcctactgagccccgttagagtcccaaattacaacctcattatcatggatgaggcccatttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaaaactgtgtggttcgtcccgagcattaaggccggtaacgacatcgctaactgtttacgcaaaaatggcaagaaggtaatccaactgtctaggaaaacgtttgataccgaatatcagaagacaaaacttaacgactgggatttcgtggttactaccgacatttccgagatgggggccaattttaaggcggatcgtgtgatcgaccctcggagatgcctgaaacccgtcattctcacagatggaccagagagggtgatattggcaggccccatgcctgttaccgccgcttcagccgctcagcgccgaggtagagtggggcggaacccacagaaggaaaatgaccaatacatcttcactggccagcccctgaacaatgatgaggaccacgcacattggacggaagccaagatgctcctggacaacattaatacccctgagggaatcatcccggctcttttcgaaccagagagggagaaaagtgccgcaattgatggcgaatatcgcctaaagggggagagccgtaaaacatttgtcgaactgatgagacggggagacttgcccgtgtggttagcgcacaaggtagcctccgagggtataaaatacactgataggaagtggtgcttcgacggccagcgcaacaatcagatcctggaagagaacatggatgtggagatttggaccaaagaaggggagaagaagaaactccgacctagatggctggacgctcggacatattctgatccccttgccctgaaggaatttaaagacttcgcagctggaaggaagtcgatcgccctcgatttggttaccgagattggccgcgtcccaagccacctggcacatagaactaggaatgccctagacaacctggtgatgctccacacatcagaacatggtgggaaagcttaccggcacgcggtggaggagcttcctgaaacgatggagaccctgttattgctgggcctcatgatcctgcttactggaggcgccatgctgtttctcatatccgggaagggaatcggtaagacaagtattggcttgatctgtgtcattgcatctagcgggatgctgtggatggctgaaatccccttacaatggatagcctccgccattgttctagagttctttatgatggtgctgctcatcccagagcctgaaaaacagcgtaccccgcaggataatcaacttgcatatgtagtgattggaatcctgaccttggctgccataatcgcggctaacgagatgggcctgctcgaaacaactaagcgcgacctgggtatgtcaaaagagcccggggtcgtgtctccaacgagctaccttgatgttgacctccaccctgccagtgcatggaccctgtacgccgtggctacaactgtcattacccccatgttgcgacatacaatcgaaaattccaccgcaaacgtaagcctggccgcgattgctaaccaggccgtggttttaatgggcctagacaagggatggccaatctctaaaatggatctgggcgtgcctctccttgcactggggtgctattcacaggtcaatcccttgactctgacggccgctgtgctcctgcttataacacactacgccattatcggaccgggcttacaggcaaaggctaccagagaggcccaaaagaggactgcggccggtatcatgaaaaacccaaccgtcgacgggattatgacaatcgatctggaccctgtgatatatgattccaagttcgagaaacagctcggacaggttatgttgctggtgctatgtgcagtacagctgctccttatgcggactagttgggctctgtgcgaagccttgaccctggcaacaggccccattacgaccctctgggagggtagcccaggcaagttttggaatactacaatcgctgtgtcgatggccaacattttccgcgggtcttacctggccggagcgggcttagctttttccatcatgaaaagcgtcgggaccggaaagagaggcactggttcacaaggggaaacacttggagagaagtggaaaaagaaactgaatcagctcagtaggaaggaattcgacctatataaaaagtctggcataaccgaggttgatcggacggaggcaaaagaaggtctgaagcgaggcgagatcacccatcacgccgtgtccagagggagcgctaagttgcagtggtttgtcgaacgcaacatggtgattcccgagggaagggtaatcgacctgggctgtgggcggggaggctggtcatactattgcgccggtctcaaaaaggtgacagaagttcgtgggtacactaaaggaggccctggccatgaggagccggtgcccatgagtacctacgggtggaatattgtcaagcttatgagcggaaaagatgtgttctatctgccacctgaaaagtgtgacacattgctgtgcgatatcggtgagtcctctcccagccctactgtcgaagagtccagaaccattagggtgctcaagatggttgagccatggttaaaaaacaatcagttctgtatcaaggtactgaacccctacatgcctacagtgatagaacaccttgagcgcctgcaacggaaacacggcgggatgctagtccgaaatccactctcaagaaactctacccatgaaatgtattggattagtaatggaactggcaacatcgtggcatcggttaatatggtgagcaggctgttgctgaaccgctttacgatgacacaccggagacccaccatcgagaaggacgtcgatctcggtgccgggactcgtcatgtgaacgctgaaccggagacccctaatatggacgtaattggagagaggataaaacggatcaaggaagagcacaactccacatggcactacgacgatgaaaatccatataagacgtgggcgtaccatggctcttatgaggtgaaagccaccggctcagcaagctccatgattaacggggttgtcaagcttctgactaaaccctgggacgtggtgcctatggtcacacagatggctatgaccgatactacaccattcggacagcaacgcgtttttaaggaaaaagtggacacccgaacacccagaagtatgccgggtactaggcgggtaatgggcatcaccgccgagtggttatggcgcacgctggggagaaataagaagcctaggttgtgcacccgagaggaattcacaaaaaaggtgcggactaacgcagccatgggagctgtctttaccgaggaaaatcagtgggattctgccaaagcggcagtggaggacgaagatttctggaagctcgttgaccgtgagagagagctgcacaaactaggcaagtgtggtagctgcgtgtacaacatgatggggaaacgcgaaaagaagcttggagagtttggcaaagccaagggctcaagggctatttggtacatgtggctgggggcccggtatctcgaattcgaggcactgggatttttgaatgaggatcattggttctccagagaaaacagttacagcggtgtcgagggcgaagggctgcacaaactcggatatatccttcgcgacatatctaagatccccggcggtgctatgtacgccgatgacacagctgggtgggacactaggattaccgaggatgacctgcataatgaagagaaaatcacgcagcagatggatccagagcaccgacaattagccaacgcaatttttaagctgacatatcagaataaggtggtaaaagttcagcggcctacccccactggaacagtgatggacatcatatccagaaaggatcagaggggctcaggccaagtcgggacctacggattgaacactttcaccaatatggaagcgcagctcattcgccagatggagggtgaaggcgtgctgagcaaagccgacctagagaacccacaccttcccgaaaagaaaatcacacagtggctggagacgaagggggtggagcgtctcaagcggatggctatctcgggagatgactgcgtcgttaaacctattgatgacagatttgccaacgcactgttggctttaaatgatatgggcaagggtaggaaagacataccacaatggcagccgtctaaggggtggcatgattggcagcaggtgcccttctgtagtcaccatttccacgaactgatcatgaaagacggacgcaagctcgtagtgccttgccgaccacaagacgagcttattggccgggccagaatctcccagggcgcagggtggagcctgagggaaaccgcctgtctaggaaaggcgtatgctcagatgtggtcactgatgtactttcaccgcagagatctccggttggcctccaacgcaatttgctctgccgtccccgtgcattgggttcctactagcaggacaacctggagtatccacgctcatcaccaatggatgactacagaggacatgctgaccgtgtggaatcgtgtctggatagaagataacccatggatggaggacaaaacgcccgtgacaacctgggagaatgtaccttaccttggtaagcgagaagatcagtggtgtggctccctgatcgggctcactagccgcgccacctgggcacagaacattccgacagctatccagcaagttagatctttaattggaaatgaggaattcctggactatatgccatcaatgaaacggtttaggaaggaggaggaaagtgagggcgccatctggtga

SEQ ID NO: 15411 - RNA, 9873 nt, synthetic construct
  misc_feature 1..9873: note = derived and/or modified CDS sequence (opt3) from DENV-3__FJ182013__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacgttggcacatctctcactcagaaggtggtcatcttcatattactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatcgagctccagaagaccgaagcaactcaactggccacacttaggaaactgtgtattgagggaaagatcaccaacattacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaaattcctttctccacagaggacggccaaggtaaggctcataacgggcgtcttatcactgcgaatccagtagtcaccaaaaaggaggaacccgtgaacatagaggcagaaccgcctttcggcgagtcaaatattgttatcggaatcggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattccaagaacacatcaatgagttttagctgcatcgcgattggaataatcaccctgtatttaggcgctgtcgtgcaggccgacatgggttgtgtgattaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcaaggtggacaacttcacaatgggggtcttgtgcctcgccattctgtttgaagaggtgatgcgcggaaagttcggcaaaaagcatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaaaatacagcccttcctggctttaggatttttcctcaggaagctgacctctcgcgaaaaccttctgctaggcgtgggcctcgcgatggccactacactgcaattgccggaggatatcgaacagatggcaaatgggattgctctgggattaatggccctcaaactgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaagacagactggctcccaatggcggtagctgccatgggcgtgccccctctgcccttgtttatcttctctctgaaggatactttaaaacgtagaagctggccactcaatgagggggttatggcagtgggactggtctcaattcttgccagttccctgttgaggaacgacgtgcctatggctggccccctcgtagcaggtgggctgctaatcgcctgttacgtgattaccggaacgtctgcggatctgacagtcgaaaaggctgccgacgttacctgggaggaagaggcagaacagactggcgtgagccataaccttatgatcacagtggacgatgacggcaccatgcgcataaaagatgacgagactgagaatattctcacagtcctgttgaagaccgccttactgatcgtgtccgggatctttccatactcaattccggctacgctcctggtttggcacacttggcagaaacagacccaacggagcggagtactttgggatgtgcctagtcccccagaaacacagaaggccgagctggaagagggtgtctatagaataaaacagcagggcatcttcgggaagacccaagtgggagttggcgtgcagaaggagggtgtctttcatacaatgtggcacgtgactaggggggcagtattgacctacaacggaaaacgactagaacccaattgggcttctgtcaagaaagacctgatttcctatggcggcgggtggcgcctcagcgcccagtggcaaaagggagaggaagtgcaggttatcgcggtggagcctggtaaaaacccaaagaatttccagacgatgcccggcacattccagactaccacaggggaaattggagccatcgcactggattttaagcctggcacctcgggttcaccgataatcaaccgggaggggaaagtcgtgggactttacggcaatggcgttgtgactaagaacgggggatatgtctctggtattgctcaaaccaatgccgagccagacggccccacacctgaattagaggaagagatgttcaaaaagagaaacctgacgatcatggatctccacccagggagtggaaaaactaggaagtacttgcccgctattgtgcgtgaagcaatcaagcgccggctgagaaccctcatactggcccctacaagggtagtggccgctgagatggaggaagcgcttaaaggcctgccgattcgatatcagaccactgcaacaaagtccgagcataccggtcgggaaatcgttgacttgatgtgccacgccacgtttactatgcgcctactgagccccgtcagagtgccaaattacaacctcatcattatggatgaggctcatttcacagaccctgcctctatcgcagccagggggtacataagcacccgggtgggaatgggcgaagctgcggccatttttatgaccgcaactcccccaggcacagctgatgccttccctcagtccaatgcacccatccaggacgaggagcgagacattccagaaagatcatggaacagtgggaatgagtggatcaccgattttgccggaaaaacagtctggttcgtaccgagcataaaggctggtaacgacattgccaactgtttacgcaaaaatggcaagaaggtgatccaactgtctaggaaaacttttgatacggaatatcagaagaccaaacttaacgactgggatttcgttgtgacaactgacatctccgagatgggggcgaattttaaggcagatcgtgtcattgaccctcggagatgcctgaaacccgtgatcctcaccgatggaccagagagggttattttggccggccccatgcctgtgacagctgcctcagctgcacagcgccgaggtagagtcgggcggaacccacagaaggaaaatgaccaatacatattcaccggccagcccctgaacaatgatgaggaccacgcccattggactgaagctaagatgctcctggacaacatcaatacgcctgagggaattatcccggcccttttcgaaccagagagggagaaaagtgcagcgatcgatggcgaatatcgcctaaagggggagagccgtaaaacctttgtggaactgatgagacggggagacttgcccgtatggttagcccacaaggtggcttccgagggtattaaatacacagataggaagtggtgcttcgacggccagcgcaacaatcagatactggaagagaacatggatgttgagatctggactaaagaaggggagaagaagaaactccgacctagatggctggacgcccggacctattctgatccccttgcactgaaggaatttaaagacttcgctgccggaaggaagtcgattgcactcgatttggtcacagagatcggccgcgtgccaagccacctggcccatagaaccaggaatgctctagacaacctggtgatgctccacacttcagaacatggtgggaaagcgtaccggcacgccgtcgaggagcttcctgaaacaatggagacgctgttattgctgggcctcatgattctgcttaccggaggcgcaatgctgtttctcatctccgggaagggaataggtaagactagtatcggcttgatttgtgttatcgcttctagcgggatgctgtggatggccgaaattcccttacaatggatcgcctccgcaatagtgctagagttctttatgatggtactgctcattccagagcctgaaaaacagcgtacaccgcaggataatcaacttgcttatgtggtcatcggaattctgaccttggccgcgatcatagctgccaacgagatgggcctgctcgaaaccacaaagcgcgacctgggtatgtcaaaagagcccggggtggtttctccaactagctaccttgatgtggacctccaccctgcaagtgcctggacgctgtacgctgtcgcaaccacagtaatcactcccatgttgcgacataccattgaaaattccacagccaacgtgagcctggcggctatcgccaaccaggcagttgtgttaatgggcctagacaagggatggccaatttctaaaatggatctgggcgtccctctccttgccctggggtgctattcacaggtgaatcccttgaccctgactgctgccgtcctcctgcttatcacgcactacgcaataattggaccgggcttacaggctaaggccacaagagaggcgcaaaagaggaccgccgcaggtatcatgaaaaacccaactgtggacgggatcatgaccattgatctggaccctgttatctatgattccaagttcgagaaacagctcggacaggtgatgttgctggtactatgtgctgtgcagctgctccttatgcggacaagttgggccctgtgcgaagcattgactctggctaccggccccataacaacgctctgggagggtagcccaggcaagttttggaataccactattgccgtctcgatggccaacatcttccgcgggtcttacctggcgggagctggcttagcattttccattatgaaaagcgttgggacaggaaagagaggcaccggttcacaaggggaaactcttggagagaagtggaaaaagaaactgaatcagctcagtaggaaggaattcgacctatataaaaagtctggcatcacagaggtggatcggaccgaggccaaagaaggtctgaagcgaggcgagataacgcatcacgctgtctccagagggagcgccaagttgcagtggtttgtggaacgcaacatggtaatccccgagggaagggtgattgacctgggctgtgggcggggaggctggtcatactattgcgcaggtctcaaaaaggttaccgaagtgcgtgggtacacaaaaggaggccctggccatgaggagccggtccccatgagtacttacgggtggaatatcgtgaagcttatgagcggaaaagatgtcttctatctgccacctgaaaagtgtgacaccttgctgtgcgatattggtgagtcctctcccagccctacagtggaagagtccagaactatcagggttctcaagatggtagagccatggttaaaaaacaatcagttctgtattaaggtgctgaacccctacatgcctaccgtcatcgaacaccttgagcgcctgcaacggaaacacggcgggatgctagtgcgaaatccactctcaagaaactctacacatgaaatgtattggataagtaatggaaccggcaacattgttgcctcggtgaatatggtcagcaggctgttgctgaaccgctttactatgacgcaccggagacccacaatcgagaaggacgtggatctcggtgctgggacccgtcatgtaaacgcggaaccggagactcctaatatggacgtgatcggagagaggattaaacggataaaggaagagcacaactccacctggcactacgacgatgaaaatccatataagacatgggcctaccatggctcttatgaggttaaagcaacgggctcagctagctccatgatcaacggggtcgtgaagcttctgaccaaaccctgggacgtggtccctatggttactcagatggccatgacagataccactccattcggacagcaacgcgtgtttaaggaaaaagtagacacacgaacccccagaagtatgccgggtacaaggcgggtgatgggcattactgcagagtggttatggcgcaccctggggagaaataagaagcctaggttgtgcacgcgagaggaattcaccaaaaaggtccggacaaacgccgctatgggagccgtgtttactgaggaaaatcagtgggattctgcgaaagcagccgttgaggacgaagatttctggaagctcgtggaccgtgagagagagctgcacaaactaggcaagtgtggtagctgcgtctacaacatgatggggaaacgcgaaaagaagcttggagagtttggcaaagctaagggctcaagggccatctggtacatgtggctgggggcacggtatctcgaattcgaggctctgggatttttgaatgaggatcattggttctccagagaaaacagttacagcggtgtggagggcgaagggctgcacaaactcggatatattcttcgcgacatctctaagatacccggcggtgccatgtacgctgatgacaccgccgggtgggacacaaggatcactgaggatgacctgcataatgaagagaaaattacccagcagatggatccagagcaccgacaattagcaaacgcgatctttaagctgacgtatcagaataaggtagttaaagtgcagcggcctacacccaccggaactgtcatggacattatctccagaaaggatcagaggggctcaggccaagtggggacatacggattgaacaccttcactaatatggaagcccagctcatacgccagatggagggtgaaggcgtgctgagcaaagctgacctagagaacccacaccttcccgaaaagaaaattacccagtggctggagacaaagggggtcgagcgtctcaagcggatggccatctcgggagatgactgcgttgtgaaacctatcgatgacagatttgcaaacgctctgttggccttaaatgatatgggcaaggtaaggaaagacattccacaatggcagccgtctaagggttggcatgattggcagcaggtgcccttctgtagtcaccatttccacgaactgataatgaaagacgggcgcaagctcgtcgtgccttgccgaccacaagacgagcttatcggacgggcaagaatttcccagggcgccggctggagcctgagggaaacggcgtgtctagggaaggcttatgcccagatgtggtcactgatgtactttcaccgcagagatctccggttggcatccaacgccatctgctctgctgttcccgtgcattgggtccctaccagcaggactacatggagtattcacgcccatcaccaatggatgaccactgaggacatgctgacagtgtggaatcgtgtatggatcgaagataacccatggatggaggacaaaacccccgttacgacatgggagaatgtgccttaccttggaaagcgagaagatcagtggtgtggttccctgataggcctcaccagccgcgcaacttgggctcagaacatcccgaccgccattcagcaagtcagatctttaatcgggaatgaggaattcctggactatatgccatcaatgaaacggtttaggaaggaggaggaaagtgagggagcgatttggtga

SEQ ID NO: 15412 - RNA, 9873 nt, synthetic construct
  misc_feature 1..9873: note = derived and/or modified CDS sequence (opt3) from DENV-3__EU781136__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtggtgaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcaaggtggacaacttcacaatgggggtcttgtgcctcgccattctgtttgaagaggtgatgcgcggaaagttcggcaaaaagcatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaaaatacagcccttcctggctttaggatttttcctcaggaagctgacctctcgcgaaaaccttctgctaggcgtgggcctcgcgatggccactacactgcaattgccggaggatatcgaacagatggcaaatgggattgctctgggattaatggccctcaaactgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaagacagactggctcccaatgactgtagcggctatgggcgtgccccctctgcccttgtttatcttctctctgaaggataccttaaaacgtagaagctggccactcaatgagggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgaaaaggcggctgacgttacttgggaggaagaggccgaacagacaggcgtgagccataaccttatgatcaccgtggacgatgacggcactatgcgcataaaagatgacgagacagagaatattctcaccgtcctgttgaagacggcattactgatcgtgtccgggatctttccatactcaattccggccactctcctggtttggcacacctggcagaaacagacacaacggagcggagtactttgggatgtgcctagtcccccagaaacccagaaggctgagctggaagagggtgtctatagaataaaacagcagggcatcttcgggaagacacaagtgggagttggcgtgcagaaggagggtgtctttcatactatgtggcacgtgaccaggggggccgtattgacgtacaacggaaaacgactagaacccaattgggcatctgtcaagaaagacctgatttcctatggcggcgggtggcgcctcagcgctcagtggcaaaagggagaggaagtgcaggttatcgccgtggagcctggtaaaaacccaaagaatttccagacaatgcccggcactttccagaccacaaccggggaaattggagcgatcgccctggattttaagcctggcacttcgggttcaccgataatcaaccgggaggggaaagtcgtgggactttacggcaatggcgttgtgaccaagaacgggggatatgtctctggtattgcacaaacaaatgctgagccagacggccccacgcctgaattagaggaagagatgttcaaaaagagaaacctgactatcatggatctccacccagggagtggaaaaaccaggaagtacttgcccgccattgtgcgtgaagctatcaagcgccggctgagaacactcatactggcacctaccagggtagtggccgccgagatggaggaagctcttaaaggcctgccgattcgatatcagactacagcgaccaagtccgagcatacgggtcgggaaatcgttgacttgatgtgccacgcaacttttacaatgcgcctactgagccccgtcagagtgccaaattacaacctcatcattatggatgaggcccatttcaccgaccctgcttctatcgccgcaagggggtacataagcacccgggtgggaatgggcgaagccgctgcgatttttatgactgccacacccccaggcaccgcagatgctttccctcagtccaatgcccccatccaggacgaggagcgagacattccagaaagatcatggaacagtgggaatgagtggatcacagattttgcaggaaaaactgtctggttcgtaccgagcataaaggccggtaacgacattgctaactgtttacgcaaaaatggcaagaaggtgatccaactgtctaggaaaacgtttgataccgaatatcagaagacaaaacttaacgactgggatttcgttgtgactaccgacatctccgagatgggggccaattttaaggcggatcgtgtcattgaccctcggagatgcctgaaacccgtgatcctcacagatggaccagagagggttattttggcaggccccatgcctgtgaccgccgcttcagccgctcagcgccgaggtagagtcgggcggaacccacagaaggaaaatgaccaatacatattcactggccagcccctgaacaatgatgaggaccacgcacattggacggaagccaagatgctcctggacaacatcaatacccctgagggaattatcccggctcttttcgaaccagagagggagaaaagtgccgcaatcgatggcgaatatcgcctaaagggggagagccgtaaaacatttgtggaactgatgagacggggagacttgcccgtatggttagcgcacaaggtggcctccgagggtattaaatacactgataggaagtggtgcttcgacggccagcgcaacaatcagatactggaagagaacatggatgttgagatctggaccaaagaaggggagaagaagaaactccgacctagatggctggacgctcggacatattctgatccccttgccctgaaggaatttaaagacttcgcagctggaaggaagtcgattgccctcgatttggtcaccgagatcggccgcgtgccaagccacctggcacatagaactaggaatgccctagacaacctggtgatgctccacacatcagaacatggtgggaaagcttaccggcacgcggtcgaggagcttcctgaaacgatggagaccctgttattgctgggcctcatgattctgcttactggaggcgccatgctgtttctcatctccgggaagggaataggtaagacaagtatcggcttgatttgtgttatcgcatctagcgggatgctgtggatggctgaaattcccttacaatggatcgcctccgccatagtgctagagttctttatgatggtactgctcattccagagcctgaaaaacagcgtaccccgcaggataatcaacttgcatatgtggtcatcggaattctgaccttggctgccatcatagcggctaacgagatgggcctgctcgaaacaactaagcgcgacctgggtatgtcaaaagagcccggggtggtttctccaacgagctaccttgatgtggacctccaccctgccagtgcatggaccctgtacgccgtcgctacaactgtaatcacccccatgttgcgacatacaattgaaaattccaccgcaaacgtgagcctggccgcgatcgctaaccaggccgttgtgttaatgggcctagacaagggatggccaatttctaaaatggatctgggcgtccctctccttgcactggggtgctattcacaggtgaatcccttgactctgacggccgctgtcctcctgcttatcacacactacgccataattggaccgggcttacaggcaaaggctaccagagaggcccaaaagaggactgcggccggtatcatgaaaaacccaaccgtggacgggatcatgacaattgatctggaccctgttatctatgattccaagttcgagaaacagctcggacaggtgatgttgctggtactatgtgcagtgcagctgctccttatgcggactagttgggctctgtgcgaagccttgaccctggcaacaggccccataacgaccctctgggagggtagcccaggcaagttttggaatactacaattgctgtctcgatggccaacatcttccgcgggtcttacctggccggagcgggcttagctttttccattatgaaaagcgttgggaccggaaagagaggcactggttcacaaggggaaacacttggagagaagtggaaaaagaaactgaatcagctcagtaggaaggaattcgacctatataaaaagtctggcatcaccgaggtggatcggacggaggcaaaagaaggtctgaagcgaggcgagataacccatcacgccgtctccagagggagcgctaagttgcagtggtttgtggaacgcaacatggtaatccccgagggaagggtgattgacctgggctgtgggcggggaggctggtcatactattgcgccggtctcaaaaaggttacagaagtgcgtgggtacactaaaggaggccctggccatgaggagccggtccccatgagtacctacgggtggaatatcgtgaagcttatgagcggaaaagatgtcttctatctgccacctgaaaagtgtgacacattgctgtgcgatattggtgagtcctctcccagccctactgtggaagagtccagaaccatcagggttctcaagatggtagagccatggttaaaaaacaatcagttctgtattaaggtgctgaacccctacatgcctacagtcatcgaacaccttgagcgcctgcaacggaaacacggcgggatgctagtgcgaaatccactctcaagaaactctacccatgaaatgtattggataagtaatggaactggcaacattgttgcatcggtgaatatggtcagcaggctgttgctgaaccgctttacgatgacacaccggagacccaccatcgagaaggacgtggatctcggtgccgggactcgtcatgtaaacgctgaaccggagacccctaatatggacgtgatcggagagaggattaaacggataaaggaagagcacaactccacatggcactacgacgatgaaaatccatataagacgtgggcgtaccatggctcttatgaggttaaagccaccggctcagcaagctccatgatcaacggggtcgtgaagcttctgactaaaccctgggacgtggtccctatggttacacagatggctatgaccgatactacaccattcggacagcaacgcgtgtttaaggaaaaagtagacacccgaacacccagaagtatgccgggtactaggcgggtgatgggcattaccgccgagtggttatggcgcacgctggggagaaataagaagcctaggttgtgcacccgagaggaattcacaaaaaaggtccggactaacgcagccatgggagctgtgtttaccgaggaaaatcagtgggattctgccaaagcggcagttgaggacgaagatttctggaagctcgtggaccgtgagagagagctgcacaaactaggcaagtgtggtagctgcgtctacaacatgatggggaaacgcgaaaagaagcttggagagtttggcaaagccaagggctcaagggctatctggtacatgtggctgggggcccggtatctcgaattcgaggcactgggatttttgaatgaggatcattggttctccagagaaaacagttacagcggtgtggagggcgaagggctgcacaaactcggatatattcttcgcgacatctctaagatacccggcggtgctatgtacgccgatgacacagctgggtgggacactaggatcaccgaggatgacctgcataatgaagagaaaattacgcagcagatggatccagagcaccgacaattagccaacgcaatctttaagctgacatatcagaataaggtagttaaagtgcagcggcctacccccactggaacagtcatggacattatctccagaaaggatcagaggggctcaggccaagtggggacctacggattgaacactttcaccaatatggaagcgcagctcatacgccagatggagggtgaaggcgtgctgagcaaagccgacctagagaacccacaccttcccgaaaagaaaattacacagtggctggagacgaagggggtcgagcgtctcaagcggatggctatctcgggagatgactgcgttgtgaaacctatcgatgacagatttgccaacgcactgttggctttaaatgatatgggcaaggtaaggaaagacattccacaatggcagccgtctaagggttggcatgattggcagcaggtgcccttctgtagtcaccatttccacgaactgataatgaaagacgggcgcaagctcgtcgtgccttgccgaccacaagacgagcttatcggacgggccagaatttcccagggcgcaggctggagcctgagggaaaccgcctgtctagggaaggcgtatgctcagatgtggtcactgatgtactttcaccgcagagatctccggttggcctccaacgcaatctgctctgccgttcccgtgcattgggtccctactagcaggacaacctggagtattcacgctcatcaccaatggatgactacagaggacatgctgaccgtgtggaatcgtgtatggatcgaagataacccatggatggaggacaaaacgcccgttacaacctgggagaatgtgccttaccttggaaagcgagaagatcagtggtgtggttccctgataggcctcactagccgcgccacctgggcacagaacatcccgacagctattcagcaagtcagatctttaatcgggaatgaggaattcctggactatatgccatcaatgaaacggtttaggaaggaggaggaaagtgagggagccatttggtga

SEQ ID NO: 15413 - RNA, 9873 nt, synthetic construct
  misc_feature 1..9873: note = derived and/or modified CDS sequence (opt3) from DENV-3__EU781137__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcaccttactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccaccagatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcaaggtagacaacttcaccatgggggtgttgtgcctcgccattctgtttgaagaggtcatgcgcggaaagttcggcaaaaagcatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaaaatacagcccttcctggctttaggatttttcctcaggaagctgacttctcgcgaaaaccttctgctaggcgtcggcctcgcgatggccacaaccctgcaattgccggaggatatcgaacagatggcaaatgggattgctctgggattaatggccctcaaactgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaagactgactggctcccaatgaccgtcgcggctatgggcgtaccccctctgcccttgtttatcttctctctgaaggatacgttaaaacgtagaagctggccactcaatgagggggtgatggccgttggactggtgtcaattcttgcaagttccctgttgaggaacgacgtccctatggccggccccctcgtggctggtgggctgctaatcgcatgttacgtaattacaggaacctctgccgatctgactgtggaaaaggcggctgacgtcacatgggaggaagaggccgaacagaccggcgttagccataaccttatgatcactgtggacgatgacggcacaatgcgcataaaagatgacgagaccgagaatattctcacggtgctgttgaagactgcattactgatcgtctccgggatctttccatactcaattccggccaccctcctggtgtggcacacatggcagaaacagacccaacggagcggagttctttgggatgtacctagtcccccagaaacacagaaggctgagctggaagagggtgtgtatagaataaaacagcagggcatcttcgggaagactcaagtcggagtgggcgttcagaaggagggtgtgtttcataccatgtggcacgtcacgaggggggccgtgttgacatacaacggaaaacgactagaacccaattgggcatctgtaaagaaagacctgatttcctatggcggcgggtggcgcctcagcgctcagtggcaaaagggagaggaagtccaggtgatcgccgttgagcctggtaaaaacccaaagaatttccagactatgcccggcaccttccagacaaccactggggaaattggagcgatcgccctggattttaagcctggcacctcgggttcaccgataatcaaccgggaggggaaagtggtcggactttacggcaatggcgtggttacaaagaacgggggatatgtgtctggtattgcacaaacgaatgctgagccagacggccccactcctgaattagaggaagagatgttcaaaaagagaaacctgaccatcatggatctccacccagggagtggaaaaacaaggaagtacttgcccgccattgtccgtgaagctatcaagcgccggctgagaaccctcatactggcacctactagggtggtagccgccgagatggaggaagctcttaaaggcctgccgattcgatatcagacaaccgcgacgaagtccgagcatactggtcgggaaatcgtggacttgatgtgccacgcaacatttaccatgcgcctactgagccccgttagagtcccaaattacaacctcatcattatggatgaggcccatttcaccgaccctgcttctatcgccgcaagggggtacataagcactcgggtgggaatgggcgaagccgctgcgatttttatgacagccacccccccaggcacagcagatgctttccctcagtccaatgcccccatccaggacgaggagcgagacattccagaaagatcatggaacagtgggaatgagtggatcactgattttgcaggaaaaacggtgtggttcgtcccgagcataaaggccggtaacgacattgctaactgtttacgcaaaaatggcaagaaggtaatccaactgtctaggaaaacctttgatacagaatatcagaagactaaacttaacgactgggatttcgtggttaccacagacatctccgagatgggggccaattttaaggcggatcgtgtgattgaccctcggagatgcctgaaacccgtcatcctcaccgatggaccagagagggtgattttggcaggccccatgcctgttactgccgcttcagccgctcagcgccgaggtagagtggggcggaacccacagaaggaaaatgaccaatacatattcacgggccagcccctgaacaatgatgaggaccacgcacattggaccgaagccaagatgctcctggacaacatcaatacacctgagggaattatcccggctcttttcgaaccagagagggagaaaagtgccgcaatcgatggcgaatatcgcctaaagggggagagccgtaaaacttttgtcgaactgatgagacggggagacttgcccgtgtggttagcgcacaaggtagcctccgagggtattaaatacaccgataggaagtggtgcttcgacggccagcgcaacaatcagatactggaagagaacatggatgtggagatctggacaaaagaaggggagaagaagaaactccgacctagatggctggacgctcggacctattctgatccccttgccctgaaggaatttaaagacttcgcagctggaaggaagtcgattgccctcgatttggttactgagatcggccgcgtcccaagccacctggcacatagaacaaggaatgccctagacaacctggtgatgctccacacgtcagaacatggtgggaaagcttaccggcacgcggtggaggagcttcctgaaaccatggagactctgttattgctgggcctcatgattctgcttacaggaggcgccatgctgtttctcatctccgggaagggaataggtaagaccagtatcggcttgatttgtgtcatcgcatctagcgggatgctgtggatggctgaaattcccttacaatggatcgcctccgccatagttctagagttctttatgatggtgctgctcattccagagcctgaaaaacagcgtaccccgcaggataatcaacttgcatatgtagtgatcggaattctgacattggctgccatcatagcggctaacgagatgggcctgctcgaaactacgaagcgcgacctgggtatgtcaaaagagcccggggtcgtgtctccaaccagctaccttgatgttgacctccaccctgccagtgcatggacactgtacgccgtggctactaccgtcatcacacccatgttgcgacataccattgaaaattccactgcaaacgtaagcctggccgcgatcgctaaccaggccgtggttttaatgggcctagacaagggatggccaatttctaaaatggatctgggcgtgcctctccttgcactggggtgctattcacaggtcaatcccttgacgctgacagccgctgtgctcctgcttatcacccactacgccataattggaccgggcttacaggcaaaggctactagagaggcccaaaagaggaccgcggccggtatcatgaaaaacccaacagtcgacgggatcatgactattgatctggaccctgtgatctatgattccaagttcgagaaacagctcggacaggttatgttgctggtgctatgtgcagtacagctgctccttatgcggaccagttgggctctgtgcgaagccttgacactggcaacgggccccataaccactctctgggagggtagcccaggcaagttttggaatacaaccattgctgtgtcgatggccaacatcttccgcgggtcttacctggccggagcgggcttagctttttccattatgaaaagcgtcgggactggaaagagaggcacaggttcacaaggggaaacccttggagagaagtggaaaaagaaactgaatcagctcagtaggaaggaattcgacctatataaaaagtctggcatcacggaggttgatcggaccgaggcaaaagaaggtctgaagcgaggcgagataacacatcacgccgtgtccagagggagcgctaagttgcagtggtttgtcgaacgcaacatggtgatccccgagggaagggtaattgacctgggctgtgggcggggaggctggtcatactattgcgccggtctcaaaaaggtgactgaagttcgtgggtacaccaaaggaggccctggccatgaggagccggtgcccatgagtacatacgggtggaatatcgtcaagcttatgagcggaaaagatgtgttctatctgccacctgaaaagtgtgacactttgctgtgcgatattggtgagtcctctcccagccctaccgtcgaagagtccagaacaatcagggtgctcaagatggttgagccatggttaaaaaacaatcagttctgtattaaggtactgaacccctacatgcctaccgtgatcgaacaccttgagcgcctgcaacggaaacacggcgggatgctagtccgaaatccactctcaagaaactctactcatgaaatgtattggataagtaatggaacgggcaacattgtggcatcggttaatatggtgagcaggctgttgctgaaccgctttacaatgacccaccggagacccactatcgagaaggacgtcgatctcggtgccgggacccgtcatgtgaacgctgaaccggagacacctaatatggacgtaatcggagagaggattaaacggataaaggaagagcacaactccacgtggcactacgacgatgaaaatccatataagacctgggcgtaccatggctcttatgaggtgaaagccactggctcagcaagctccatgatcaacggggttgtcaagcttctgacaaaaccctgggacgtggtgcctatggtcacccagatggctatgactgatacaaccccattcggacagcaacgcgtttttaaggaaaaagtggacacacgaactcccagaagtatgccgggtaccaggcgggtaatgggcattacggccgagtggttatggcgcaccctggggagaaataagaagcctaggttgtgcacacgagaggaattcactaaaaaggtgcggaccaacgcagccatgggagctgtctttacagaggaaaatcagtgggattctgccaaagcggcagtggaggacgaagatttctggaagctcgttgaccgtgagagagagctgcacaaactaggcaagtgtggtagctgcgtgtacaacatgatggggaaacgcgaaaagaagcttggagagtttggcaaagccaagggctcaagggctatctggtacatgtggctgggggcccggtatctcgaattcgaggcactgggatttttgaatgaggatcattggttctccagagaaaacagttacagcggtgtcgagggcgaagggctgcacaaactcggatatattcttcgcgacatctctaagatacccggcggtgctatgtacgccgatgacactgctgggtgggacaccaggatcacggaggatgacctgcataatgaagagaaaattacacagcagatggatccagagcaccgacaattagccaacgcaatctttaagctgacctatcagaataaggtggtaaaagttcagcggcctactcccacaggaaccgtgatggacattatctccagaaaggatcagaggggctcaggccaagtcgggacttacggattgaacaccttcacaaatatggaagcgcagctcatacgccagatggagggtgaaggcgtgctgagcaaagccgacctagagaacccacaccttcccgaaaagaaaattacgcagtggctggagaccaagggggtggagcgtctcaagcggatggctatctcgggagatgactgcgtcgttaaacctatcgatgacagatttgccaacgcactgttggctttaaatgatatgggcaaggtgaggaaagacattccacaatggcagccgtctaagggttggcatgattggcagcaggtacccttctgtagtcaccatttccacgaactggtgatgaaagacgggcgcaagctcgtcgtgccttgccgaccacaagacgagcttataggacgggccagaatctcccagggcgcaggctggagcctgagggaaactgcctgtctagggaaggcgtatgctcagatgtggtcactgatgtactttcaccgcagagatctccggttggcctccaacgcaatttgctctgccgttcccgtgcattgggtccctacaagcaggaccacttggagtatccacgctcatcaccaatggatgacaaccgaggacatgctgacggtgtggaatcgtgtatggattgaagataacccatggatggaggacaaaacacccgttaccacttgggagaatgtgccttaccttggaaagcgagaagatcagtggtgtggttccctgatcggcctcaccagccgcgccacatgggcacagaacataccgactgctatccagcaagtcagatctttaattgggaatgaggaattcctggactatatgccatcaatgaaacggtttaggaaggaggaggaaagtgagggagccatctggtga

SEQ ID NO: 15414 - RNA, 9873 nt, synthetic construct
  misc_feature 1..9873: note = derived and/or modified CDS sequence (opt3) from DENV-3__EU726773__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttacgtgatcacgggaacatctgcagatctgaccgtcgaaaaggccgcggacgttacttgggaggaagaggctgaacagacaggcgtgagccataaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcacacctggcagaaacagacacaacggagcggagtactttgggatgtgcctagtcccccagaaacccagaaggccgagctggaagagggtgtctatagaatcaaacagcagggcattttcgggaagacacaagtgggagttggcgtgcagaaggagggtgtctttcatactatgtggcacgtgaccaggggggctgtattgacgtacaacggaaaacgactagaacccaattgggcctctgtcaagaaagacctgatctcctatggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttacggcaatggcgttgtgaccaagaacgggggatatgtctctggtatcgcccaaacaaatgcagagccagacggccccacgcctgaattagaggaagagatgttcaaaaagagaaacctgactattatggatctccacccagggagtggaaaaaccaggaagtacttgcccgctatcgtgcgtgaagccataaagcgccggctgagaacactcattctggctcctaccagggtagtggcagccgagatggaggaagcccttaaaggcctgccgatccgatatcagactacagctaccaagtccgagcatacgggtcgggaaatcgttgacttgatgtgccacgcgacttttacaatgcgcctactgagccccgtcagagtgccaaattacaacctcattatcatggatgaggcacatttcaccgaccctgcctctatagctgccagggggtacattagcacccgggtgggaatgggcgaagcagccgctatctttatgactgcgacacccccaggcaccgccgatgcattccctcagtccaatgctcccattcaggacgaggagaaagacatcccagaacgatcatggaacagtgggaatgagtggataacagattttgccggaaagactgtctggttcgtaccgagcattaaagcaggtaacgacatcgccaactgtttaagaaagaatggcaagaaagtgatccaactgtctcgcaagacgtttgataccgaatatcagaaaacaaagcttaacgactgggatttcgttgtgactaccgacatttccgagatgggggctaattttaaagccgatagggtcatcgaccctcgtcggtgcctgaagcccgtgattctcacagatggaccagagagagttatattggcgggccccatgcctgtgaccgcagcctcagctgcccagaggcgcggtcgagtcgggagaaacccacagaaggaaaatgaccaatacatcttcactggccagcccctgaacaatgatgaggaccacgctcattggacggaagcaaaaatgctcctggacaacattaatacccctgagggaatcatcccggcccttttcgaaccagagcgggagaagagtgctgccattgatggcgaatataggctaaaaggggagagccgcaagacatttgtggaactgatgcgtagaggagacttgcccgtatggttagcacacaaagtggcgtccgagggtataaagtacactgatcggaaatggtgcttcgacggccagaggaacaatcagatcctggaagagaacatggatgttgagatttggaccaaggaaggggagaagaaaaagctccgccctcgatggctggacgccagaacatattctgatccccttgctctgaaagaatttaaggacttcgccgcaggacggaaatcgatcgctctcgatttggtcaccgagattggcagggtgccaagccacctggcccatcgcactagaaatgcactagacaacctggtgatgctccacacatcagaacatggtgggaaggcctacaggcacgctgtcgaggagcttcctgaaacgatggagaccctgttattgctgggcctcatgatcctgcttactggaggcgcgatgctgtttctcatatccgggaagggaatcggtaaaacaagtattggcttgatctgtgttattgcctctagcgggatgctgtggatggcagaaatccccttacaatggatagcttccgccattgtgctagagttctttatgatggtactgctcatcccagagcctgaaaagcagcggaccccgcaggataatcaacttgcctatgtggtcattggaatcctgaccttggcagctataatcgccgcgaacgagatgggcctgctcgaaacaactaaacgtgacctgggtatgtcaaaggagcccggggtggtttctccaacgagctaccttgatgtggacctccaccctgctagtgcctggaccctgtacgcagtcgccacaactgtaattacccccatgttgcgccatacaatcgaaaattccaccgctaacgtgagcctggcagccattgcgaaccaggctgttgtgttaatgggcctagacaaaggatggccaatctctaagatggatctgggcgtccctctccttgccctggggtgctattcacaggtgaatcccttgactctgacggcagccgtcctcctgcttataacacactacgctattatcggaccgggcttacaggccaaggcaacccgagaggctcaaaaaagaactgccgcgggtatcatgaagaacccaaccgtggacgggattatgacaatcgatctggaccctgttatatatgattccaaattcgagaagcagctcggacaggtgatgttgctggtactatgtgccgtgcagctgctccttatgaggactagttgggcactgtgcgaagctttgaccctggccacaggccccattacgaccctctgggagggtagcccaggcaaattttggaatactacaatcgcagtctcgatggctaacattttccgggggtcttacctggccggagccggcttagcgttttccatcatgaagagcgttgggaccggaaagcgcggcactggttcacaaggggaaacacttggagagaaatggaagaaaaagctgaatcagctcagtagaaaagaattcgacctatataagaaatctggcataaccgaggtggataggacggaggctaaggaaggtctgaagcggggcgagatcacccatcacgcagtctcccgagggagcgccaaattgcagtggtttgtggaaagaaacatggtaattcccgagggacgcgtgatcgacctgggctgtgggaggggaggctggtcatactattgcgctggtctcaagaaagttacagaagtgcgggggtacactaagggaggccctggccatgaggagccggtccccatgagtacctacgggtggaatattgtgaaacttatgagcggaaaggatgtcttctatctgccacctgaaaagtgtgacacattgctgtgcgatatcggtgagtcctctcccagccctactgtggaagagtcccgtaccattagagttctcaaaatggtagagccatggttaaagaacaatcagttctgtatcaaagtgctgaacccctacatgcctacagtcatagaacaccttgagaggctgcaacgcaagcacggcgggatgctagtgcggaatccactctcacgaaactctacccatgaaatgtattggattagtaatggaactggcaacatcgttgcctcggtgaatatggtcagcagactgttgctgaacaggtttacgatgacacaccgccggcccaccatcgagaaagacgtggatctcggtgcagggactagacatgtaaacgccgaaccggagacccctaatatggacgtgattggagagcgtataaagaggatcaaggaagagcacaactccacatggcactacgacgatgaaaatccatataaaacgtgggcttaccatggctcttatgaggttaaggcgaccggctcagccagctccatgattaacggggtcgtgaaacttctgactaagccctgggacgtggtccctatggttacacagatggcaatgaccgatactacaccattcggacagcaacgggtgtttaaagaaaaggtagacacccgcacaccccgaagtatgccgggtactagaagggtgatgggcatcaccgctgagtggttatggcggacgctggggcgcaataagaaacctagattgtgcaccagggaggaattcacaaagaaagtccgaactaacgccgcaatgggagccgtgtttaccgaggaaaatcagtgggattctgctaaggccgcggttgaggacgaagatttctggattctcgtggaccgggagcgtgagctgcacaaactaggcaagtgtggtagctgcgtctacaacatgatggggaaaagagaaaagaagcttggagagtttggcaaagcaaagggctcacgcgccatctggtacatgtggctgggggctaggtatctcgaattcgaggccctgggatttttgaatgaggatcattggttctcccgggaaaacagttacagcggtgtggagggcgaagggctgcacaaactcggatatatacttagagacatctctaagattcccggcggtgcaatgtacgctgatgacacagccgggtgggacactcgcatcaccgaggatgacctgcataatgaagagaaaattacgcagcagatggatccagagcacaggcaattagctaacgccatctttaagctgacatatcagaataaggtagttaaagtgcagcgacctacccccactggaacagtcatggacataatttcccggaaggatcagagaggctcaggccaagtggggacctacggattgaacactttcaccaatatggaagcacagctcatcaggcagatggagggtgaaggcgtgctgagcaaagcggacctagagaacccacaccttcccgaaaagaaaatcacacagtggctggagacgaagggggtcgagcgcctcaagcgtatggccatttcgggagatgactgcgttgtgaaacctatagatgaccggtttgctaacgccctgttggcattaaatgatatgggcaaggtaagaaaagacatcccacaatggcagccgtctaagggttggcatgattggcagcaggtgcccttctgtagtcaccatttccacgaactgattatgaaagacgggaggaagctcgtcgtgccttgccgcccacaagacgagcttatcggacgagctcggatttcccagggcgccggctggagcctgagagaaaccgcatgtctagggaaggcctatgcgcagatgtggtcactgatgtactttcacaggcgcgatctcagattggcttccaacgccatctgctctgcagttcccgtgcattgggtccctactagccggacaacctggagtatacacgcccatcaccaatggatgactacagaggacatgctgaccgtgtggaatagggtatggatcgaagataacccatggatggaggacaaaacgcccgttacaacctgggagaatgtgccttaccttggaaagcgtgaagatcagtggtgtggttccctgattggcctcactagccgagctacctgggcccagaacatcccgacagcaattcagcaagtccgctctttaatcgggaatgaggaattcctggactatatgccatcaatgaaaagatttcggaaggaggaggaaagtgagggagctatttggtga

SEQ ID NO: 15415 - RNA, 9873 nt, synthetic construct
  misc_feature 1..9873: note = derived and/or modified CDS sequence (opt3) from DENV-3__EU726774__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcaaggtagacaacttcaccatgggggtgttgtgcctcgccattctgtttgaagaggtcatgcgcggaaagttcggcaaaaagcatatgatcgcaggggtgttctttacgttcgttctactgctctccggacagatcacttggcgggatatggctcacaccctgattatggtgggcagtaatgccagcgacagaatgggtatgggggtcacataccttgcattgatcgccacctttaaaattcagcccttcctggctttaggatttttcctcaggaagctgacttctcgcgaaaaccttctgctaggcgtgggcctcgcgatggccacaaccctgcaattgccggaggatatagaacagatggcaaatgggatcgctctgggattaatggccctcaaactgacaactcagtttgagacctatcagctttggacggccctgatttccttgacatgttcaaacaccatcttcactctcaccgttgcttggcgaacagcaactctgattctagccggtgtgagtctgcttcctgtctgccaaagctcgtccatgcggaagaccgactggctcccaatgacggtagcggctatgggcgtgccccctctgcccttgtttatcttctctctgaaggatacattaaaacgtagaagctggccactcaatgagggggttatggccgtgggactggtctcaatacttgcaagttccctgttgaggaacgacgtgcctatggccggccccctcgtagctggtgggctgctaatcgcatgttacgtgattaccggaacttctgccgatctgacagtcgaaaaggcggctgacgttacctgggaggaagaggccgaacagactggcgtgagccataaccttatgatcacagtggacgatgacggcaccatgcgcattaaagatgacgagacggagaatatcctcactgtcctgttgaagaccgcattactgatagtgtccgggatttttccatactcaatcccggccacactcctggtttggcacacctggcagaaacagacacaacggagcggagtactttgggatgtgcctagtcccccagaaactcagaaggctgagctggaagagggtgtctatagaatcaaacagcagggcattttcgggaagacccaagtgggagttggcgtgcagaaggagggtgtctttcatacgatgtggcacgtgacaaggggggccgtattgacttacaacggaaaacgactagaacccaattgggcatctgtcaagaaagacctgatatcctatggcggcgggtggcgcctcagcgctcagtggcaaaagggagaggaagtgcaggttatcgccgtggagcctggtaaaaacccaaagaatttccagaccatgcccggcacattccagaccactaccggggaaattggagcgatcgccctggattttaagcctggcacatcgggttcaccgattatcaaccgggaggggaaagtcgtgggactttacggcaatggcgttgtgacgaagaacgggggatatgtctctggtatagcacaaactaatgctgagccagacggccccacccctgaattagaggaagagatgttcaaaaagagaaacctgacaatcatggatctccacccagggagtggaaaaaccaggaagtacttgcccgccattgtgcgtgaagctatcaagcgccggctgagaactctcattctggcacctacaagggtagtggccgccgagatggaggaagctcttaaaggcctgccgatccgatatcagaccacggcgactaagtccgagcatacaggtcgggaaatagttgacttgatgtgccacgcaacctttaccatgcgcctactgagccccgtcagagtgccaaattacaacctcattatcatggatgaggcccatttcactgaccctgcttctatcgccgcaagggggtacattagcacacgggtgggaatgggcgaagccgctgcgatctttatgaccgccacacccccaggcactgcagatgctttccctcagtccaatgcccccatacaggacgaggagcgagacattccagaaagatcatggaacagtgggaatgagtggatcacggattttgcaggaaaaaccgtctggttcgtaccgagcattaaggccggtaacgacatcgctaactgtttacgcaaaaatggcaagaaggtgatacaactgtctaggaaaacatttgatactgaatatcagaagaccaaacttaacgactgggatttcgttgtgacaaccgacatttccgagatgggggccaattttaaggcggatcgtgtcatcgaccctcggagatgcctgaaacccgtgatcctcactgatggaccagagagggttattttggcaggccccatgcctgtgacggccgcttcagccgctcagcgccgaggtagagtcgggcggaacccacagaaggaaaatgaccaatacatcttcaccggccagcccctgaacaatgatgaggaccacgcacattggacagaagccaagatgctcctggacaacattaatactcctgagggaataatcccggctcttttcgaaccagagagggagaaaagtgccgcaattgatggcgaatatcgcctaaagggggagagccgtaaaacctttgtggaactgatgagacggggagacttgcccgtatggttagcgcacaaggtggcctccgagggtatcaaatacacagataggaagtggtgcttcgacggccagcgcaacaatcagatcctggaagagaacatggatgttgagatttggaccaaagaaggggagaagaagaaactccgacctagatggctggacgctcggacttattctgatccccttgccctgaaggaatttaaagacttcgcagctggaaggaagtcgatagccctcgatttggtcacagagatcggccgcgtgccaagccacctggcacatagaacgaggaatgccctagacaacctggtgatgctccacacctcagaacatggtgggaaagcttaccggcacgcggtcgaggagcttcctgaaactatggagacactgttattgctgggcctcatgattctgcttaccggaggcgccatgctgtttctcatctccgggaagggaattggtaagaccagtatcggcttgatatgtgttatcgcatctagcgggatgctgtggatggctgaaattcccttacaatggatcgcctccgccattgtgctagagttctttatgatggtactgctcatcccagagcctgaaaaacagcgtacaccgcaggataatcaacttgcatatgtggtcataggaattctgactttggctgccatcattgcggctaacgagatgggcctgctcgaaacgaccaagcgcgacctgggtatgtcaaaagagcccggggtggtttctccaacaagctaccttgatgtggacctccaccctgccagtgcatggactctgtacgccgtcgctaccacagtaatcacccccatgttgcgacatactatagaaaattccacggcaaacgtgagcctggccgcgatcgctaaccaggccgttgtgttaatgggcctagacaagggatggccaatttctaaaatggatctgggcgtccctctccttgcactggggtgctattcacaggtgaatcccttgacactgaccgccgctgtcctcctgcttatcactcactacgccattatcggaccgggcttacaggcaaaggctaccagagaggcccaaaagaggacagcggccggtataatgaaaaacccaactgtggacgggattatgaccatcgatctggaccctgttatctatgattccaagttcgagaaacagctcggacaggtgatgttgctggtactatgtgcagtgcagctgctccttatgcggacaagttgggctctgtgcgaagccttgacgctggcaaccggccccattactacactctgggagggtagcccaggcaagttttggaataccactatcgctgtctcgatggccaacatattccgcgggtcttacctggccggagcgggcttagctttttccattatgaaaagcgttgggacaggaaagagaggcaccggttcacaaggggaaacgcttggagagaagtggaaaaagaaactgaatcagctcagtaggaaggaattcgacctatataaaaagtctggcatcaccgaggtggatcggacagaggcaaaagaaggtctgaagcgaggcgagattactcatcacgccgtctccagagggagcgctaagttgcagtggtttgtggaacgcaacatggtaatccccgagggaagggtgatagacctgggctgtgggcggggaggctggtcatactattgcgccggtctcaaaaaggttaccgaagtgcgtgggtacacaaaaggaggccctggccatgaggagccggtccccatgagtacttacgggtggaatatcgtgaagcttatgagcggaaaagatgtcttctatctgccacctgaaaagtgtgacaccttgctgtgcgatattggtgagtcctctcccagccctacagtggaagagtccagaaccatcagggttctcaagatggtagagccatggttaaaaaacaatcagttctgtattaaggtgctgaacccctacatgcctactgtcatcgaacaccttgagcgcctgcaacggaaacacggcgggatgctagtgcgaaatccactctcaagaaactctacgcatgaaatgtattggattagtaatggaacaggcaacatcgttgcatcggtgaatatggtcagcaggctgttgctgaaccgctttaccatgactcaccggagacccaccatagagaaggacgtggatctcggtgccgggacacgtcatgtaaacgctgaaccggagacgcctaatatggacgtgattggagagaggatcaaacggatcaaggaagagcacaactccacctggcactacgacgatgaaaatccatataagacttgggcgtaccatggctcttatgaggttaaagccacaggctcagcaagctccatgattaacggggtcgtgaagcttctgaccaaaccctgggacgtggtccctatggttactcagatggctatgacagataccacaccattcggacagcaacgcgtgtttaaggaaaaagtagacactcgaacccccagaagtatgccgggtacgaggcgggtgatgggcataaccgccgagtggttatggcgcacactggggagaaataagaagcctaggttgtgcactcgagaggaattcaccaaaaaggtccggacaaacgcagccatgggagctgtgtttactgaggaaaatcagtgggattctgccaaagcggcagttgaggacgaagatttctggaagctcgtggaccgtgagagagagctgcacaaactaggcaagtgtggtagctgcgtctacaacatgatggggaaacgcgaaaagaagcttggagagtttggcaaagccaagggctcaagggctatctggtacatgtggctgggggcccggtatctcgaattcgaggcactgggatttttgaatgaggatcattggttctccagagaaaacagttacagcggtgtggagggcgaagggctgcacaaactcggatatattcttcgcgacatctctaagattcccggcggtgctatgtacgccgatgacaccgctgggtgggacacgaggatcacagaggatgacctgcataatgaagagaaaataacccagcagatggatccagagcaccgacaattagccaacgcaatctttaagctgacttatcagaataaggtagttaaagtgcagcggcctacacccaccggaactgtcatggacattatctccagaaaggatcagaggggctcaggccaagtggggacctacggattgaacacattcacgaatatggaagcgcagctcattcgccagatggagggtgaaggcgtgctgagcaaagccgacctagagaacccacaccttcccgaaaagaaaatcacccagtggctggagactaagggggtcgagcgtctcaagcggatggctatatcgggagatgactgcgttgtgaaacctattgatgacagatttgccaacgcactgttggctttaaatgatatgggcaaggtaaggaaagacatcccacaatggcagccgtctaagggttggcatgattggcagcaggtgcccttctgtagtcaccatttccacgaactgatcatgaaagacgggcgcaagctcgtcgtgccttgccgaccacaagacgagcttattggacgggccagaatatcccagggcgcaggctggagcctgagggaaacagcctgtctagggaaggcgtatgctcagatgtggtcactgatgtactttcaccgcagagatctccggttggcctccaacgcaatctgctctgccgttcccgtgcattgggtccctaccagcaggactacatggagtattcacgctcatcaccaatggatgaccacggaggacatgctgacagtgtggaatcgtgtatggatcgaagataacccatggatggaggacaaaacccccgttactacctgggagaatgtgccttaccttggaaagcgagaagatcagtggtgtggttccctgattggcctcacaagccgcgccacttgggcacagaacatcccgaccgctatacagcaagtcagatctttaatcgggaatgaggaattcctggactatatgccatcaatgaaacggtttaggaaggaggaggaaagtgagggagccatttggtga

SEQ ID NO: 15416 - RNA, 9873 nt, synthetic construct
  misc_feature 1..9873: note = derived and/or modified CDS sequence (opt3) from DENV-3__EU687219__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacatgggttgtgtgatcaattggaaagggaaggagctgaagtgcggatccggcattttcgtgaccaacgaggtccatacttggacagaacagtacaaatttcaagccgattctcccaagcggctagctaccgccatcgcaggtgcttgggagaatggcgtttgtgggatacgaagcactacccgcatggaaaacctcctgtggaaacagatcgccaatgagcttaactatattttgtgggaaaataacatcaagctgacagtggtggtaggagacattatcggcgtcctcgagcaggggaaaagaacgctgaccccacagcctatggagttaaagtactcatggaaaacttggggaaaggcgaagatagtgacagccgaaacccaaaacagttccttcattatcgatggccccaatacaccagagtgccccagcgtttctagggcttggaacgtgtgggaagtcgaggactatggttttggggtgttcactaccaatatttggctgaaacttcgggaagtttacacgcagttgtgtgaccaccgcctcatgtcagcagccgtgaaggatgagagagctgtacacgccgacatgggatactggatcgagagtcagaaaaacggcagctggaagctggaaaaagcatccctaatagaggtcaagacatgcacctggcctaagtctcatactctgtggtcgaatggtgtgctcgaaagcgatatgatcattccaaaatccctggcgggcccgatctcacagcacaactataggcccgggtaccatacccaaacagccggaccttggcaccttggcaagttggagctggactttaattattgcgaggggactaccgtggtcattacagaaaactgtggaacgcgtggcccaagtttacggaccactacagtttctggtaaactcatccacgagtggtgctgtcgaagctgcaccctgccccctcttagatacatgggggaagatggatgttggtatggcatggagataaggccaatttccgaaaaggaggagaatatggtgaaatcactggtaagcgctggttctggcaaggtggacaacttcactatgggggtcttgtgcctcgccatcctgtttgaagaggtgatgcgcggaaagttcggcaaaaagcatatgatcgcaggggttttctttacattcgtgctactgctctccggacagattacctggcgggatatggctcacacgctgatcatgattggcagtaatgccagcgacagaatgggtatgggggtcacttaccttgcattgatagccacctttaaaatccagcccttcctggctttaggatttttcctcaggaagctgacatctcgcgaaaaccttctgctaggcgtgggcctcgcgatggccaccactctgcaattgccggaggatattgaacagatggcaaatgggatcgctctgggattaatggccctcaaactgattacacagtttgagacctatcagctttggacagccctgatctccttgacttgttcaaacaccatattcacgctcacagttgcttggcgaaccgcaactctgatcctagccggtgtgagtctgcttcctgtctgccaaagctcgtccatgcggaagaccgactggctcccaatgacagtagcggctatgggcgtgccccctctgcccttgtttattttctctctgaaggatactttaaaacgtagaagctggccactcaatgagggggttatggccgtgggactggtctcaatccttgcaagttccctgttgaggaacgacgtgcctatggccggccccctcgtagctggtgggctgctaattgcatgttacgtgatcaccggaacgtctgccgatctgacagtcgaaaaggcggctgacgttacctgggaggaagaggccgaacagactggcgtgagccataaccttatgataacagtggacgatgacggcaccatgcgcattaaagatgacgagactgagaatatcctcacagtcctgttgaagaccgcattactgatcgtgtccgggatttttccatactcaataccggccacgctcctggtttggcacacttggcagaaacagacccaacggagcggagtactttgggatgtgcctagtcccccagaaacacagaaggctgagctggaagagggtgtctatagaatcaaacagcagggcattttcgggaagacccaagtgggagttggcgtgcagaaggagggtgtctttcatacaatgtggcacgtgactaggggggccgtattgacctacaacggaaaacgactagaacccaattgggcatctgtcaagaaagacctgatctcctatggcggcgggtggcgcctcagcgctcagtggcaaaagggagaggaagtgcaggttattgccgtggagcctggtaaaaacccaaagaatttccagacgatgcccggcacattccagactaccacaggggaaatcggagcgatagccctggattttaagcctggcacctcgggttcaccgatcattaaccgggaggggaaagtcgtgggactttacggcaatggcgttatcactaagaacgggggatatgtgtctggtattgcacaaaccaatgctgagccagacggccccacacctgaattagaggaagagatgttcaaaaagagaaacctgacgatcatggatctccacccagggagtggaaaaactaggaagtacttgcccgccatagtccgtgaagctattaagcgccggctgagaaccctcatcctggcacctacaagggtggtagccgccgagatggaggaagctcttaaaggcctgccgatccgatatcagaccactgcgacaaagtccgagcataccggtcgggaaattgtggacttgatgtgccacgcaacgtttactatgcgcctactgagccccgttagagtcccaaattacaacctcatcataatggatgaggcccatttcacagaccctgcttctattgccgcaagggggtacatcagcacccgggtgggaatgggcgaagccgctgcgatttttatgaccgccactcccccaggcacagcagatgctttccctcagtccaatgcccccatccaggacgaggagcgagacataccagaaagatcatggaacagtgggaatgagtggattaccgattttgcaggaaaaacagtgtggttcgtcccgagcatcaaggccggtaacgacatcgctaactgtttacgcaaaaatggcaagaaggtaattcaactgtctaggaaaacttttgatacggaatatcagaagaccaaacttaacgactgggatttcgtggttacaactgacatctccgagatgggggccaattttaaggcggatcgtgtgattgaccctcggagatgcctgaaacccgtcatactcaccgatggaccagagagggtgatcttggcaggccccatgcctgttacagccgcttcagccgctcagcgccgaggtagagtggggcggaacccacagaaggaaaatgaccaatacattttcaccggccagcccctgaacaatgatgaggaccacgcacattggactgaagccaagatgctcctggacaacatcaatacgcctgagggaatcattccggctcttttcgaaccagagagggagaaaagtgccgcaatagatggcgaatatcgcctaaagggggagagccgtaaaacctttgtcgaactgatgagacggggagacttgcccgtgtggttagcgcacaaggtagcctccgagggtatcaaatacacagataggaagtggtgcttcgacggccagcgcaacaatcagattctggaagagaacatggatgtggagatctggactaaagaaggggagaagaagaaactccgacctagatggctggacgctcggacctattctgatccccttgccctgaaggaatttaaagacttcgcagctggaaggaagtcgattgccctcgatttggttacagagatcggccgcgtcccaagccacctggcacatagaaccaggaatgccctagacaacctggtgatgctccacacttcagaacatggtgggaaagcttaccggcacgcggtggaggagcttcctgaaacaatggagacgctgttattgctgggcctcatgatactgcttaccggaggcgccatgctgtttctcatctccgggaagggaattggtaagactagtatcggcttgatttgtgtcatcgcatctagcgggatgctgtggatggctgaaatacccttacaatggattgcctccgccatcgttctagagttctttatgatggtgctgctcattccagagcctgaaaaacagcgtacaccgcaggataatcaacttgcatatgtagtgatcggaatactgaccttggctgccatcattgcggctaacgagatgggcctgctcgaaaccacaaagcgcgacctgggtatgtcaaaagagcccggggtcgtgtctccaactagctaccttgatgttgacctccaccctgccagtgcatggacgctgtacgccgtggctaccacagtcatcactcccatgttgcgacataccattgaaaattccacagcaaacgtaagcctggccgcgatcgctaaccaggccgtggttttaatgggcctagacaagggatggccaatatctaaaatggatctgggcgtgcctctccttgcactggggtgctattcacaggtcaatcccttgaccctgactgccgctgtgctcctgcttattacgcactacgccatcatcggaccgggcttacaggcaaaggctacaagagaggcccaaaagaggaccgcggccggtattatgaaaaacccaactgtcgacgggatcatgaccatagatctggaccctgtgatttatgattccaagttcgagaaacagctcggacaggttatgttgctggtgctatgtgcagtacagctgctccttatgcggacaagttgggctctgtgcgaagccttgactctggcaaccggccccatcacaacgctctgggagggtagcccaggcaagttttggaataccactattgctgtgtcgatggccaacatcttccgcgggtcttacctggccggagcgggcttagctttttccataatgaaaagcgtcgggacaggaaagagaggcaccggttcacaaggggaaactcttggagagaagtggaaaaagaaactgaatcagctcagtaggaaggaattcgacctatataaaaagtctggcatcacagaggttgatcggaccgaggcaaaagaaggtctgaagcgaggcgagattacgcatcacgccgtgtccagagggagcgctaagttgcagtggtttgtcgaacgcaacatggtgatccccgagggaagggtaattgacctgggctgtgggcggggaggctggtcatactattgcgccggtctcaaaaaggtgaccgaagttcgtgggtacacaaaaggaggccctggccatgaggagccggtgcccatgagtacttacgggtggaatatcgtcaagcttatgagcggaaaagatgtgttctatctgccacctgaaaagtgtgacaccttgctgtgcgatattggtgagtcctctcccagccctacagtcgaagagtccagaactatcagggtgctcaagatggttgagccatggttaaaaaacaatcagttctgtataaaggtactgaacccctacatgcctaccgtgattgaacaccttgagcgcctgcaacggaaacacggcgggatgctagtccgaaatccactctcaagaaactctacacatgaaatgtattggatcagtaatggaaccggcaacatcgtggcatcggttaatatggtgagcaggctgttgctgaaccgctttactatgacgcaccggagacccacaattgagaaggacgtcgatctcggtgccgggacccgtcatgtgaacgctgaaccggagactcctaatatggacgtaataggagagaggatcaaacggattaaggaagagcacaactccacctggcactacgacgatgaaaatccatataagacatgggcgtaccatggctcttatgaggtgaaagccacgggctcagcaagctccatgatcaacggggttgtcaagcttctgaccaaaccctgggacgtggtgcctatggtcactcagatggctatgacagataccactccattcggacagcaacgcgtttttaaggaaaaagtggacacacgaacccccagaagtatgccgggtacaaggcgggtaatgggcattactgccgagtggttatggcgcaccctggggagaaataagaagcctaggttgtgcacgcgagaggaattcaccaaaaaggtgcggacaaacgcagccatgggagctgtctttactgaggaaaatcagtgggattctgccaaagcggcagtggaggacgaagatttctggaagctcgttgaccgtgagagagagctgcacaaactaggcaagtgtggtagctgcgtgtacaacatgatggggaaacgcgaaaagaagcttggagagtttggcaaagccaagggctcaagggctatctggtacatgtggctgggggcccggtatctcgaattcgaggcactgggatttttgaatgaggatcattggttctccagagaaaacagttacagcggtgtcgagggcgaagggctgcacaaactcggatatatacttcgcgacatctctaagattcccggcggtgctatgtacgccgatgacaccgctgggtgggacacaaggatcactgaggatgacctgcataatgaagagaaaattacccagcagatggatccagagcaccgacaattagccaacgcaatctttaagctgacgtatcagaataaggtggtaaaagttcagcggcctacacccaccggaactgtgatggacataatttccagaaaggatcagaggggctcaggccaagtcgggacatacggattgaacaccttcactaatatggaagcgcagctcatccgccagatggagggtgaaggcgtgctgagcaaagccgacctagagaacccacaccttcccgaaaagaaaatcacccagtggctggagacaaagggggtggagcgtctcaagcggatggctatttcgggagatgactgcgtcgttaaacctatagatgacagatttgccaacgcactgttggctttaaatgatatgggcaaggtgaggaaagacatcccacaatggcagccgtctaagggttggcatgattggcagcaggtacccttctgtagtcaccatttccacgaactgattatgaaagacgggcgcaagctcgtggtcccttgccgaccacaagacgagcttatcggacgggccagaatttcccagggcgcaggctggagcctgagggaaacggcctgtctagggaaggcgtatgctcagatgtggtcactgatgtactttcaccgcagagatctccggttggcctccaacgcaatctgctctgccgtgcccgttcattgggtgcctaccagcaggactacatggagtatacacgctcatcaccaatggatgaccactgaggacatgctgacagtctggaatcgtgtgtggatcgaagataacccatggatggaggacaaaacccccgtaacgacatgggagaatgttccttaccttggaaagcgagaagatcagtggtgtggttccctgattggcctcaccagccgcgccacttgggcacagaacatcccgaccgctattcagcaagtgagatctttaatcgggaatgaggaattcctggactatatgccatcaatgaaacggtttaggaaggaggaggaaagtgagggagccatttggtga

SEQ ID NO: 15417 - RNA, 9873 nt, synthetic construct
  misc_feature 1..9873: note = derived and/or modified CDS sequence (opt3) from DENV-3__EU726768__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttacgtgatcacgggaacatctgcagatctgaccgtcgaaaaggccgcggacgttacttgggaggaagaggctgaacagacaggcgtgagccataaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcacacctggcagaaacagacacaacggagcggagtactttgggatgtgcctagtcccccagaaacccagaaggccgagctggaagagggtgtctatagaatcaaacagcagggcattttcgggaagacacaagtgggagttggcgtgcagaaggagggtgtctttcatactatgtggcacgtgaccaggggggctgtattgacgtacaacggaaaacgactagaacccaattgggcctctgtcaagaaagacctgatctcctatggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttacggcaatggcgttgtgaccaagaacgggggatatgtctctggtatcgcccaaacaaatgcagagccagacggccccacgcctgaattagaggaagagatgttcaaaaagagaaacctgactattatggatctccacccagggagtggaaaaaccaggaagtacttgcccgctatcgtgcgtgaagccataaagcgccggctgagaacactcattctggctcctaccagggtagtggcagccgagatggaggaagcccttaaaggcctgccgatccgatatcagactacagctaccaagtccgagcatacgggtcgggaaatcgttgacttgatgtgccacgcgacttttacaatgcgcctactgagccccgtcagagtgccaaattacaacctcattatcatggatgaggcacatttcaccgaccctgcctctatagctgccagggggtacattagcacccgggtgggaatgggcgaagcagccgctatctttatgactgcgacacccccaggcaccgccgatgcattccctcagtccaatgctcccattcaggacgaggagcgagacatcccagaaagatcatggaacagtgggaatgagtggataacagattttgccggaaaaactgtctggttcgtaccgagcattaaggcaggtaacgacatcgccaactgtttacgcaaaaatggcaagaaggtgatccaactgtctaggaaaacgtttgataccgaatatcagaagacaaaacttaacgactgggatttcgttgtgactaccgacatttccgagatgggggctaattttaaggccgatcgtgtcatcgaccctcggagatgcctgaaacccgtgattctcacagatggaccagagagggttatattggcgggccccatgcctgtgaccgcagcctcagctgcccagcgccgaggtagagtcgggcggaacccacagaaggaaaatgaccaatacatcttcactggccagcccctgaacaatgatgaggaccacgctcattggacggaagcaaagatgctcctggacaacattaatacccctgagggaatcatcccggcccttttcgaaccagagagggagaaaagtgctgccattgatggcgaatatcgcctaaagggggagagccgtaaaacatttgtggaactgatgagacggggagacttgcccgtatggttagcacacaaggtggcgtccgagggtataaaatacactgataggaagtggtgcttcgacggccagcgcaacaatcagatcctggaagagaacatggatgttgagatttggaccaaagaaggggagaagaagaaactccgacctagatggctggacgcccggacatattctgatccccttgctctgaaggaatttaaagacttcgccgcaggaaggaagtcgatcgctctcgatttggtcaccgagattggccgcgtgccaagccacctggcccatagaactaggaatgcactagacaacctggtgatgctccacacatcagaacatggtgggaaagcctaccggcacgctgtcgaggagcttcctgaaacgatggagaccctgttattgctgggcctcatgatcctgcttactggaggcgcgatgctgtttctcatatccgggaagggaatcggtaagacaagtattggcttgatctgtgttattgcctctagcgggatgctgtggatggcagaaatccccttacaatggatagcttccgccattgtgctagagttctttatgatggtactgctcatcccagagcctgaaaaacagcgtaccccgcaggataatcaacttgcctatgtggtcattggaatcctgaccttggcagctataatcgccgcgaacgagatgggcctgctcgaaacaactaagcgcgacctgggtatgtcaaaagagcccggggtggtttctccaacgagctaccttgatgtggacctccaccctgctagtgcctggaccctgtacgcagtcgccacaactgtaattacccccatgttgcgacatacaatcgaaaattccaccgctaacgtgagcctggcagccattgcgaaccaggctgttgtgttaatgggcctagacaagggatggccaatctctaaaatggatctgggcgtccctctccttgccctggggtgctattcacaggtgaatcccttgactctgacggcagccgtcctcctgcttataacacactacgctattatcggaccgggcttacaggccaaggcaaccagagaggctcaaaagaggactgccgcgggtatcatgaaaaacccaaccgtggacgggattatgacaatcgatctggaccctgttatatatgattccaagttcgagaaacagctcggacaggtgatgttgctggtactatgtgccgtgcagctgctccttatgcggactagttgggcactgtgcgaagctttgaccctggccacaggccccattacgaccctctgggagggtagcccaggcaagttttggaatactacaatcgcagtctcgatggctaacattttccgcgggtcttacctggccggagccggcttagcgttttccatcatgaaaagcgttgggaccggaaagagaggcactggttcacaaggggaaacacttggagagaagtggaaaaagaaactgaatcagctcagtaggaaggaattcgacctatataaaaagtctggcataaccgaggtggatcggacggaggctaaagaaggtctgaagcgaggcgagatcacccatcacgcagtctccagagggagcgccaagttgcagtggtttgtggaacgcaacatggtaattcccgagggaagggtgatcgacctgggctgtgggcggggaggctggtcatactattgcgctggtctcaaaaaggttacagaagtgcgtgggtacactaaaggaggccctggccatgaggagccggtccccatgagtacctacgggtggaatattgtgaagcttatgagcggaaaagatgtcttctatctgccacctgaaaagtgtgacacattgctgtgcgatatcggtgagtcctctcccagccctactgtggaagagtccagaaccattagggttctcaagatggtagagccatggttaaaaaacaatcagttctgtatcaaggtgctgaacccctacatgcctacagtcatagaacaccttgagcgcctgcaacggaaacacggcgggatgctagtgcgaaatccactctcaagaaactctacccatgaaatgtattggattagtaatggaactggcaacatcgttgcctcggtgaatatggtcagcaggctgttgctgaaccgctttacgatgacacaccggagacccaccatcgagaaggacgtggatctcggtgcagggactcgtcatgtaaacgccgaaccggagacccctaatatggacgtgattggagagaggataaaacggatcaaggaagagcacaactccacatggcactacgacgatgaaaatccatataagacgtgggcttaccatggctcttatgaggttaaagcgaccggctcagccagctccatgattaacggggtcgtgaagcttctgactaaaccctgggacgtggtccctatggttacacagatggcaatgaccgatactacaccattcggacagcaacgcgtgtttaaggaaaaagtagacacccgaacacccagaagtatgccgggtactaggcgggtgatgggcatcaccgctgagtggttatggcgcacgctggggagaaataagaagcctaggttgtgcacccgagaggaattcacaaaaaaggtccggactaacgccgcaatgggagccgtgtttaccgaggaaaatcagtgggattctgctaaagccgcggttgaggacgaagatttctggattctcgtggaccgtgagagagagctgcacaagctaggcaaatgtggtagctgcgtctacaacatgatggggaagcgcgaaaaaaagcttggagagtttggcaaggcaaaaggctcaagggccatctggtacatgtggctgggggctcggtatctcgaattcgaggccctgggatttttgaatgaggatcattggttctccagagaaaacagttacagcggtgtggagggcgaagggctgcacaagctcggatatatacttcgcgacatctctaaaattcccggcggtgcaatgtacgctgatgacacagccgggtgggacactaggatcaccgaggatgacctgcataatgaagagaagattacgcagcagatggatccagagcaccgacaattagctaacgccatctttaaactgacatatcagaataaggtagttaaggtgcagcggcctacccccactggaacagtcatggacataatttccagaaaagatcagaggggctcaggccaagtggggacctacggattgaacactttcaccaatatggaagcacagctcatccgccagatggagggtgaaggcgtgctgagcaaggcggacctagagaacccacaccttcccgaaaaaaagatcacacagtggctggagacgaaaggggtcgagcgtctcaagcggatggccatttcgggagatgactgcgttgtgaagcctatagatgacagatttgctaacgccctgttggcattaaatgatatgggcaaagtaaggaaggacatcccacaatggcagccgtctaaaggttggcatgattggcagcaggtgcccttctgtagtcaccatttccacgaactgattatgaaggacgggcgcaaactcgtcgtgccttgccgaccacaagacgagcttatcggacgggctagaatttcccagggcgccggctggagcctgagggaaaccgcatgtctagggaaggcctatgcgcagatgtggtcactgatgtactttcaccgcagagatctccggttggcttccaacgccatctgctctgcagttcccgtgcattgggtccctactagcaggacaacctggagtatacacgcccatcaccaatggatgactacagaggacatgctgaccgtgtggaatcgtgtatggatcgaagataacccatggatggaggacaagacgcccgttacaacctgggagaatgtgccttaccttggaaaacgagaagatcagtggtgtggttccctgattggcctcactagccgcgctacctgggcccagaacatcccgacagcaattcagcaagtcagatctttaatcgggaatgaggaattcctggactatatgccatcaatgaagcggtttaggaaagaggaggaaagtgagggagctatttggtga

SEQ ID NO: 15418 - RNA, 9873 nt, synthetic construct
  misc_feature 1..9873: note = derived and/or modified CDS sequence (opt3) from DENV-3__EU687226__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccagtttccgaaaaggaggagaatatggtgaaatcactggtaagcgctggttctggcaaggtggacaacttcacaatgggggtcttgtgcctcgccattctgtttgaagaggtgatgcgcggaaagttcggcaaaaagcatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaaaatacagcccttcctggctttaggatttttcctcaggaagctgacctctcgcgaaaaccttctgctaggcgtgggcctcgcgatggccactacactgcaattgccggaggatatcgaacagatggcaaatgggattgctctgggattaatggccctcaaactgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaagacagactggctcccaatgactgtagcggctatgggcgtgccccctctgcccttgtttatcttctctctgaaggataccttaaaacgtagaagctggccactcaatgagggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgaaaaggcggctgacgttacttgggaggaagaggccgaacagacaggcgtgagccataaccttatgatcaccgtggacgatgacggcactatgcgcataaaagatgacgagacagagaatattctcaccgtcctgttgaagacggcattactgatcgtgtccgggatctttccatactcaattccggccactctcctggtttggcacacctggcataaacagacacagcggagcggagtaccttgggatgtgcccagtccacccgaaacccaaaaggctgagcttgaagagggtgtctatagaataaaacagcagggcatcttcgggaagacacaggtgggagttggcgtgcaaaaggagggtgtctttcactctatgtggcacgtgactaggggggccgtactgacctacaacggaaaacgattggaacctaattgggcatccgtcaagaaagacctaattagctatggcggcgggtggcgcctgtcggctcagtggcagaagggagaggaagtgcaagttatcgccgtggagccaggtaaaaaccccaagaatttccagacgatgcctggcacattccagactaccacaggggaaattggagcgatcgccctcgattttaagccgggcacctcaggttctccaataatcaaccgggaggggaaagtcgtgggactgtacggcaatggcgttgtgactaagaacgggggatatgtcagtggtattgcacagaccaatgctgagcccgacggccctacaccagaacttgaggaagagatgttcaaaaagagaaacttaacgatcatggatctgcatcccgggtccggaaaaactaggaagtacctccctgccattgtgcgtgaagctatcaagcgccggttgagaaccctgatactcgcaccgacaagggtagtggccgccgagatggaggaagctctgaaaggccttcccattcgatatcaaaccactgcgacaaagagcgagcacaccggtcgggaaatcgttgacctgatgtgccatgcaacgtttactatgcgcttgctatctccagtcagagtgcctaattacaacctgatcattatggatgaggcccacttcacagaccccgctagcatcgccgcaagggggtacatatccacccgggtgggaatgggcgaagccgctgcgatttttatgaccgccactccacctggcacagcagatgctttcccccagtcaaatgccccaatccaggacgaggagcgagacattccggaaagaagttggaacagcgggaatgagtggatcaccgattttgcaggaaaaacagtctggttcgtaccttctataaaggccggtaacgacattgctaactgtctccgcaaaaatggcaagaaggtgatccagttatccaggaaaacttttgatacggaatatcaaaagaccaaactgaacgactgggatttcgttgtgacaactgacatctcagagatgggggccaattttaaggcggatcgtgtcattgacccccggagatgccttaaaccagtgatcctgaccgatggacccgagagggttattctcgcaggccctatgccagtgacagccgctagtgccgctcagcgccgaggtagagtcgggcggaacccccagaaggaaaatgaccagtacatattcaccggccaacctttgaacaatgatgaggaccatgcacactggactgaagccaagatgctgctcgacaacatcaatacgccggagggaattatcccagctctgttcgaacccgagagggagaaaagcgccgcaatcgatggcgaatatcgccttaagggggagtcccgtaaaacctttgtggaactaatgagacggggagacctgcctgtatggttggcgcacaaggtggcctctgagggtattaaatacacagataggaagtggtgcttcgacggccagcgcaacaatcagatattagaagagaacatggatgttgagatctggactaaagaaggggagaagaagaaactgcgacccagatggctcgacgctcggacctattcggatccactggcccttaaggaatttaaagacttcgcagctggaaggaagagcattgccctggatctcgtcacagagatcggccgcgtgccttcacatttggcacacagaaccaggaatgccctggacaacctagtgatgctgcatacttccgaacacggtgggaaagcttaccggcacgcggtcgaggagctccccgaaacaatggagacgcttctgttattgggcctgatgattctcctgaccggaggcgccatgctttttctgatcagtgggaagggaataggtaagacttctatcggcctcatttgtgttatcgcaagctccgggatgttgtggatggctgaaattccactgcagtggatcgcctcagccatagtgttagagttctttatgatggtactactgattcctgagccggaaaaacaacgtacaccccaggataatcagctcgcatatgtggtcatcggaattcttaccctggctgccatcatagcggctaacgagatgggcttgctggaaaccacaaagcgcgacctcggtatgtctaaagagccaggggtggttagccctactagttacctggatgtggaccttcatcccgcctccgcatggacgctctacgccgtcgctaccacagtaatcactccaatgctgcgacacaccattgaaaatagcacagcaaacgtgtctttggccgcgatcgctaaccaagccgttgtgctgatgggcttagacaagggatggcctatttcaaaaatggatctaggcgtccccctgctcgcacttgggtgctattcccaggtgaatccgctgaccttgactgccgctgtcctgctcctgatcacgcattacgccataattggaccaggccttcaggcaaaggctacaagagaggcccagaagaggaccgcggccggtatcatgaaaaaccctactgtggacgggatcatgaccattgatttagaccccgttatctatgatagtaagttcgagaaacaactgggacaggtgatgctcttggtactgtgtgcagtgcagctactgctcatgcggacaagctgggctctttgcgaagccctgactttggcaaccggcccaataacaacgctgtgggagggttcgcccggcaagttttggaataccactattgctgtctctatggccaacatcttccgcgggtcctacctcgccggagcgggcctggcttttagcattatgaaatcagttgggacaggaaagagaggcaccggtagtcagggggaaactttaggagagaagtggaaaaagaaacttaatcaactgtctaggaaggaattcgacctctataaaaagtccggcatcacagaggtggatcggaccgaggcaaaagaaggtctaaagcgaggcgagataacgcaccatgccgtcagcagagggtcagctaagctgcagtggtttgtggaacgcaacatggtaatccctgagggaagggtgattgacttgggctgtgggcggggaggctggagttactattgcgccggtctgaaaaaggttaccgaagtgcgtgggtacacaaaaggaggcccgggccacgaggagcccgtcccaatgagcacttacgggtggaatatcgtgaagctcatgtccggaaaagatgtcttctatcttcctcccgaaaagtgtgacaccctgttgtgcgatattggtgagtctagcccttccccaacagtggaagagtcaagaactatcagggttctgaagatggtagagccctggctcaaaaacaatcagttctgtattaaggtgttaaacccttacatgccaaccgtcatcgaacacctggagcgccttcagcggaaacatggcgggatgctggtgcgaaatcccctatctagaaacagtacacacgaaatgtattggatatcgaatggaaccggcaacattgttgcaagcgtgaatatggtctccaggctcctgttgaaccgctttactatgacgcatcggagaccgacaatcgagaaggacgtggatctgggtgccgggacccgtcacgtaaacgctgaacctgagactccaaatatggacgtgatcggagagaggattaaacggataaaggaagagcacaactctacctggcattacgacgatgaaaatccctataagacatgggcgtaccacggctcatatgaggttaaagccacgggcagcgcatccagtatgatcaacggggtcgtgaagctccttaccaaaccttgggacgtggtcccaatggttactcaaatggctatgacagataccactcccttcggacagcagcgcgtgtttaaggaaaaagtagacacacgaaccccgagatctatgcctggtacaaggcgggtgatgggcattactgccgagtggctgtggcgcaccttagggagaaataagaagcccaggctgtgcacgcgagaggaattcaccaaaaaggtccggacaaacgcagccatgggagctgtgtttactgaggaaaatcaatgggatagcgccaaagcggcagttgaggacgaagatttctggaagttggtggaccgtgagagagagctccataaactgggcaagtgtggttcatgcgtctacaacatgatggggaaacgcgaaaagaagctaggagagtttggcaaagccaagggctccagggctatctggtacatgtggcttggggcccggtatctggaattcgaggcactcggatttctgaatgaggatcactggttcagtagagaaaacagctactctggtgtggagggcgaagggttgcataaactgggatatattctccgcgacatctccaagataccaggcggtgctatgtacgccgatgacaccgctgggtgggacacaaggatcactgaggatgaccttcacaatgaagagaaaattacccagcagatggatcctgagcaccgacagctggccaacgcaatctttaagttaacgtatcaaaataaggtagttaaagtgcagcggcccacaccaaccggaactgtcatggacattatctcaagaaaggatcagaggggcagcggccaggtggggacatacggactgaacaccttcactaatatggaagcgcaattgatacgccagatggagggtgaaggcgtgctctcgaaagccgacctggagaacccccatctacctgaaaagaaaattacccagtggcttgagacaaagggggtcgagcgtctgaagcggatggctatctctggagatgactgcgttgtgaaaccaatcgatgacagatttgccaacgcactcctggctttgaatgatatgggcaaggtaaggaaagacattccgcagtggcaacccagtaagggttggcacgattggcagcaggtgcctttctgttcccatcacttccacgaattaataatgaaagacgggcgcaagctggtcgtgccatgccgaccccaggacgagctcatcggacgggccagaattagccaaggcgcaggctggtcacttagggaaacggcctgtctggggaaggcgtatgctcagatgtggtccctaatgtactttcatcgcagagatctgcggctcgcctctaacgcaatctgcagcgccgttcctgtgcactgggtcccaaccagtaggactacatggtccattcatgctcaccatcagtggatgaccactgaggacatgttgacagtgtggaatcgtgtatggatcgaagataacccctggatggaggacaaaacccctgttacgacatgggagaatgtgccgtacctgggaaagcgagaagatcaatggtgtggtagccttataggcctgacctctcgcgccacttgggcacagaacatcccaaccgctattcagcaggtcagatcactcatcgggaatgaggaattcttagactatatgcccagtatgaaacggtttaggaaggaggaggaatccgagggagccatttggtga

SEQ ID NO: 15419 - RNA, 9876 nt, synthetic construct
  misc_feature 1..9876: note = derived and/or modified CDS sequence (opt3) from DENV-3__EU687233__SS-prME
  source 1..9876: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacaccggttgtgtgatcaattggaaagggaaggagctgaagtgcggatccggcattttcgtgactaacgaggtccatacatggaccgaacagtacaaatttcaagccgattctcccaagcggctagctactgccatcgcaggtgcttgggagaatggcgtttgtgggatacgaagcaccacacgcatggaaaacctcctgtggaaacagatcgccaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggcgaagatagtgaccgccgaaacacaaaacagttccttcattatcgatggccccaatactccagagtgccccagcgcttctagggcatggaacgtttgggaagtggaggactatggttttggggtcttcaccacgaatatttggctgaaacttcgggaagtgtacacacagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacctgcacttggcctaagtctcataccctgtggtcgaatggtgtcctcgaaagcgatatgatcattccaaaatccctggccggcccgatctcacagcacaactataggcccgggtaccatacacaaactgctggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgccggttctggcaaggtagacaacttcacaatgggggtgttgtgcctcgcaatcctgtttgaagaggtcatgcgcggaaagttcggcaaaaagcatatgatcgctggggtgttctttaccttcgttctactgctctccggacagattacgtggcgggatatggcccacactctgatcatgattggcagtaatgcaagcgacagaatgggtatgggggtgacctaccttgccttgatagctacatttaaaatccagcccttcctggcgttaggatttttcctcaggaagctgacctctcgcgaaaaccttctgctaggcgtcggcctcgccatggcaactacactgcaattgccggaggatattgaacagatggctaatgggatcgccctgggattaatggccctcaaactgattacccagtttgagacatatcagctttggactgctctgatctccttgacctgttcaaacacgatattcacactcaccgtggcatggcgaactgccaccctgatcctagcgggtgttagtctgcttcctgtgtgccaaagctcgtccatgcggaagtctgactggctcccaatgacagtcgctgccatgggcgtaccccctctgcccttgtttattttcagcctgaaggatactttaaaacgtagatcatggccactcaatgagggggtgatggcagttggactggtgagtatccttgcctcctctctgttgaggaacgacgtccctatggctggccccctcgtggcaggtgggctgctaattgcctgttacgtaatcaccggaacgagcgcggatctgacagtggaaaaggctgccgacgtcacctgggaggaagaggcagaacagactggcgtttcccataaccttatgataacagtggacgatgacggcaccatgcgcattaaagatgacgagactgagaatatcctcacagtgctgttgaagaccgccttactgatcgtctcagggatttttccatacagcataccggctacgctcctggtgtggcacacttggcagaaacagacccggagaagtggagttctttgggatgtaccttctcccccagaaacacaaaaggccgagctggaagagggtgtgtataggatcaaacagcagggcattttcgggaagacccaggtcggagtgggcgttcaaaaggagggtgtgtttcatacaatgtggcacgtcactcgaggggcagtgttgacctacaacggaaaacgcctagaacccaattgggcttccgtaaagaaagacctgatcagctatggcggcgggtggcggctctcggcccagtggcagaagggagaggaagtccaagtgattgcggttgagcctggtaaaaacccaaagaatttccagacgatgcccggcacattccagactaccacaggggaaatcggagccatagcactggattttaagcctggcacctcaggttctccgatcattaacagagaggggaaagtggtcggactttacggcaatggcgtggttactaagaacgggggatatgtgagtggtatcgctcagaccaatgccgagccagacggccccacacctgaattagaggaagagatgttcaaaaagaggaacctgacgattatggatctccacccagggtccggaaaaactcgtaagtacttgcccgctatcgtccgcgaagcaataaagcggagactgaggaccctcattctggcccctacacgagtggtagccgctgagatggaggaagcgcttaaaggcctgccgatccggtatcaaaccactgcaacaaagagcgagcataccggtcgcgaaatcgtggacttgatgtgccacgccacgtttactatgagactactgtctcccgttagggtcccaaattacaacctcattatcatggatgaggctcatttcacagaccctgccagcatagcagcccgggggtacatttccacccgagtgggaatgggcgaagctgcggccatctttatgaccgcaactcccccaggcacagctgatgccttccctcagtcaaatgcacccattcaggacgaggagagagacatcccagaacgcagttggaacagcgggaatgagtggataaccgattttgccggaaaaacagtgtggttcgtcccgtctattaaggctggtaacgacatcgccaactgtttaaggaaaaatggcaagaaggtaatccagctgtcccgtaaaacttttgatacggaatatcaaaagaccaaacttaacgactgggatttcgtggttacaactgacatttcagagatgggggcgaattttaaggcagatcgggtgatcgaccctagaaggtgcctgaaacccgtcattctcaccgatggaccagagcgcgtgatattggccggccccatgcctgttacagctgccagtgctgcacagcgaagaggtcgggtggggaggaacccacagaaggaaaatgaccagtacatcttcaccggccaacccctgaacaatgatgaggaccacgcccattggactgaagctaagatgctcctggacaacattaatacgcctgagggaatcatcccggcccttttcgaaccagagcgcgagaaaagcgcagcgattgatggcgaatatcgtctaaagggggagtccagaaaaacctttgtcgaactgatgcggaggggagacttgcccgtgtggttagcccacaaggtagcttctgagggtataaaatacacagatcgcaagtggtgcttcgacggccagcgaaacaatcagatcctggaagagaacatggatgtggagatttggactaaagaaggggagaagaagaaactcagacctcggtggctggacgccaggacctattcggatccccttgcactgaaggaatttaaagacttcgctgccggacgcaagagcatcgcactcgatttggttacagagattggcagagtcccatcacacctggcccataggacccggaatgctctagacaacctggtgatgctccacacttccgaacatggtgggaaagcgtaccgtcacgccgtggaggagcttcctgaaacaatggagacgctgttattgctgggcctcatgatcctgcttaccggaggcgcaatgctgtttctcataagtgggaagggaatcggtaagacttctattggcttgatctgtgtcattgctagctccgggatgctgtggatggccgaaatccccttacagtggatagcctcagcaattgttctagagttctttatgatggtgctgctcatcccagagcctgaaaaacaacgcacaccgcaggataatcagcttgcttatgtagtgattggaatcctgaccttggccgcgataatcgctgccaacgagatgggcctgctcgaaaccacaaagcgagacctgggtatgtctaaagagcccggggtcgtgagcccaactagttaccttgatgttgacctccaccctgcatccgcctggacgctgtacgctgtggcaaccacagtcattactcccatgttgagacataccatcgaaaatagcacagccaacgtatctctggcggctattgccaaccaagcagtggttttaatgggcctagacaagggatggccaatctcaaaaatggatctgggcgtgcctctccttgccctggggtgctattcccaggtcaatcccttgaccctgactgctgccgtgctcctgcttataacgcactacgcaattatcggaccgggcttacaggctaaggccacaagggaggcgcagaagcggaccgccgcaggtatcatgaaaaacccaactgtcgacgggattatgaccatcgatctggaccctgtgatatatgatagtaagttcgagaaacaactcggacaggttatgttgctggtgctatgtgctgtacagctgctccttatgcgcacaagctgggccctgtgcgaagcattgactctggctaccggccccattacaacgctctgggagggttcgccaggcaagttttggaataccactatcgccgtgtctatggccaacattttcagagggtcctacctggcgggagctggcttagcatttagcatcatgaaatcagtcgggacaggaaagaggggcaccggtagtcagggggaaactcttggagagaagtggaaaaagaaactgaatcaactctctcggaaggaattcgacctatataaaaagtccggcataacagaggttgatcgaaccgaggccaaagaaggtctgaagagaggcgagatcacgcatcacgctgtgagccgcgggtcagccaagttgcagtggtttgtcgaaaggaacatggtgattcccgagggacgggtaatcgacctgggctgtgggcgtggaggctggagttactattgcgcaggtctcaaaaaggtgaccgaagttagagggtacacaaaaggaggccctggccatgaggagccggtgcccatgagcacttacgggtggaatattgtcaagcttatgtccggaaaagatgtgttctatctgccacctgaaaagtgtgacaccttgctgtgcgatatcggtgagtctagcccctcccctacagtcgaagagtcaaggactattcgcgtgctcaagatggttgagccatggttaaaaaacaatcagttctgtatcaaggtactgaacccctacatgcctaccgtgatagaacaccttgagcggctgcagcgaaaacacggcgggatgctagtcagaaatccactctctaggaacagtacacatgaaatgtattggatttcgaatggaaccggcaacatcgtggccagcgttaatatggtgtcccgcctgttgctgaaccggtttactatgacgcacagacgtcccacaatcgagaaggacgtcgatctcggtgctgggaccaggcatgtgaacgcggaaccggagactcctaatatggacgtaattggagagcggataaaacgcatcaaggaagagcacaactctacctggcactacgacgatgaaaatccatataagacatgggcctaccatggctcatatgaggtgaaagcaacgggcagcgcttccagtatgattaacggggttgtcaagcttctgaccaaaccctgggacgtggtgcctatggtcactcaaatggccatgacagataccactccattcggacagcagcgagtttttaaggaaaaagtggacacaagaacccccaggtctatgccgggtacacggcgcgtaatgggcatcactgcagagtggttatggagaaccctggggaggaataagaagcctcgattgtgcacgcgggaggaattcaccaaaaaggtgcgtacaaacgccgctatgggagccgtctttactgaggaaaatcaatgggatagcgcgaaagcagccgtggaggacgaagatttctggaagctcgttgacagagagcgcgagctgcacaaactaggcaagtgtggttcatgcgtgtacaacatgatggggaaaagggaaaagaagcttggagagtttggcaaagctaagggctcccgggccatttggtacatgtggctgggggcaagatatctcgaattcgaggctctgggatttttgaatgaggatcattggttcagtcgcgaaaacagctactctggtgtcgagggcgaagggctgcacaaactcggatatatccttagggacatatccaagatccccggcggtgccatgtacgctgatgacaccgccgggtgggacacacgaattactgaggatgacctgcataatgaagagaaaatcacccagcagatggatccagagcaccggcagttagcaaacgcgatttttaagctgacgtatcaaaataaggtggtaaaagttcagagacctacacccaccggaactgtgatggacatcatatcaaggaaggatcagcgcggcagcggccaggtcgggacatacggattgaacacctgccactcgaatatggaagcccaactcattcgtcagatggagggtgaaggcgtgctgtctaaagctgacctagagaacccacatcttagtgaaaagaaaatcactcagtggctggagaccaagggggtggagcggctcaagagaatggccatctccggagatgactgtgtcgttaaacccattgatgacaggttcgcaaacgctctgttggccttaaatgatatgggcaaggtgcgcaaagacatacctcagtggcaaccaagcaagggttggcacgattggcagcaggtaccgttttgctcacatcacttccacgaactgatcatgaaagacgggcgaaagctcgtggtcccctgtcggcctcaggacgagcttattggaagagcaaggatctcccaaggcgccggctggtctctgcgcgaaacagcgtgcctagggaaggcttatgcccagatgtggagcctgatgtacttccatagacgggatctcaggttggcaagtaacgccatttgttccgctgtgccagttcactgggtgcccacgagccgtaccacttggtctatccatgcccaccatcagtggatgacaaccgaggacatgctgactgtctggaatcgagtgtggatagaagataacccttggatggaggacaaaacaccagtaaccacgtgggagaatgttccctaccttggaaagcgcgaagatcaatggtgcggttcactgatcggcctcacaagtagagcaacctgggctcagaacattcctactgccatccagcaggtgcggtccttaattgggaatgaggaatttctggactatatgccgagcatgaaaaggttccgcaaggaggaggaatctgagggagcgatctggtga

SEQ ID NO: 15420 - RNA, 9873 nt, synthetic construct
  misc_feature 1..9873: note = derived and/or modified CDS sequence (opt3) from DENV-3__EU687234__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaagtgcctttctccacagaggacggccaaggtaaggctcattcagggcgtcttatcactgcgaacccagtagtcaccaaaaaggaggaacccgtgaatatagaggcagaaccgcctttcggcgagagcaacattgttatcggaatcggcgataatgccttgaaaattaactggtataagaaggggagttctatcggaaaaatgtttgaagctacagcccgcggtgcaagaaggatggccattctgggcgacactgcttgggatttcgggtccgtgggaggcgtcctcaatagcctgggtaagatggtgcaccagatatttgggtcggcctacaccgcacttttctctggcgtatcctgggtgatgaaaatcggaattggcgttctgttgacgtggatcgggctcaactcaaagaatacaagtatgagcttttcctgcatcgtcattggaataatcaccctgtatttaggcgcggtggtgcaggctgacatgggttgtgtcattaactggaaagggaaggagctgaagtgcggatctggcatcttcgttactaatgaggtgcatacatggaccgaacagtacaaatttcaagccgatagccccaagcggctagcaactgccattgctggtgcctgggagaacggcgtgtgtgggatccgatcaaccacacgcatggaaaatctcctgtggaaacagatagcaaacgagcttaattatatcttgtgggaaaacaatattaagctgacggtagtcgtgggagacatcattggcgttctcgagcaggggaaaagaaccctgactccacagcctatggagttaaagtacagttggaaaacatggggaaaggctaagatcgtgaccgccgaaacacaaaactccagcttcataattgatggccccaacactccagagtgcccctctgcgtcaagggcctggaatgtctgggaagtggaggactatggttttggggttttcaccacgaacatctggctgaaacttcgggaagtgtacacacagttgtgtgaccaccgcctcatgagtgctgcagtaaaggatgagagagccgtccacgctgacatgggatactggattgagagccagaaaaatggctcctggaagctggaaaaagcctctctaatcgaggtgaagacctgcacttggcctaagtcgcataccctgtggagcaacggtgtgctcgaatccgatatgataatcccaaaatcactggcaggcccgattagtcagcacaattataggcccgggtaccatacacaaactgcgggaccttggcaccttggcaagttggagctggactttaactattgcgaggggaccacagtcgttatcacggaaaattgtggaacccgtggcccatctttacggactacaaccgtgagcggtaaactcattcacgagtggtgctgtcgatcctgcactctgccccctcttagatacatgggggaagatggatgttggtatggcatggagatcaggccaatatcagaaaaggaggagaacatggtaaaaagcctggtgtctgccggttccggcaaggtcgacaatttcacaatgggggtgttgtgcctcgctattctgtttgaagaggttatgcgcggaaagttcggcaaaaagcatatgatcgccggggtgttctttaccttcgtcctactgctcagtggacagatcacgtggcgggatatggcacacactctgattatgatcggcagcaacgcttctgacagaatgggtatgggggtgacctaccttgccttgattgcaacatttaaaatacagcccttcctggccttaggatttttcctcaggaagctgacctcccgcgaaaatcttctgctaggcgttggcctcgctatggcgactacactgcaattgccggaggatatcgaacagatggccaacgggattgcactgggattaatggctctcaaactgatcacccagtttgagacatatcagctttggactgccctgatttcattgacctgtagtaatacgatcttcacactcaccgtggcctggcgaactgctaccctgatactagcaggtgtcagcctgcttcctgtatgccaatcgtcctctatgcggaagacagactggctcccaatgactgtggccgcgatgggcgttccccctctgcccttgtttatcttcagcctgaaggataccttaaaacgtagatcatggccactcaacgagggggtgatggctgtcggactggtgagtattcttgcctcctctctgttgaggaatgacgtacctatggcaggccccctcgtggccggtgggctgctaatcgcttgttacgtcattacgggaacaagcgcagatctgaccgttgaaaaggccgcggacgtgacttgggaggaagaggctgaacagacaggcgtgtcccataaccttatgatcaccgtcgacgatgacggcactatgcgcataaaagatgacgagacagagaacattctcaccgtgctgttgaagacggccttactgatcgtttcagggatctttccatacagcattccggcaactctcctggtatggcacacctggcagaaacagacacaacggagtggagtgctttgggatgtcccttctcccccagaaacccagaaggccgagctggaagagggtgtgtatagaataaaacagcagggcatcttcgggaagacacaagttggagtgggcgtccagaaggagggtgtgtttcatactatgtggcacgtaaccaggggggctgtcttgacgtacaatggaaaacgactagaacccaactgggcctccgtgaagaaagacctgattagctatggcggcgggtggcgcctctcggcacagtggcaaaagggagaggaagttcaggtgatcgctgtcgagcctggtaaaaatccaaagaacttccagacaatgcccggcactttccagaccacaaccggggaaattggagccatcgcgctggattttaagcctggcacttcaggttctccgataatcaatcgggaggggaaagtggttggactttacggcaacggcgtggtcaccaagaatgggggatatgtgagtggtattgcccaaacaaacgcagagccagacggccccacgcctgaattagaggaagagatgttcaaaaagagaaatctgactatcatggatctccacccagggtccggaaaaaccaggaagtacttgcccgctattgtacgtgaagccatcaagcgccggctgagaacactcatactggctcctaccagggtggttgcagccgagatggaggaagcccttaaaggcctgccgattcgatatcagactacagctaccaagagcgagcatacgggtcgggaaatcgtcgacttgatgtgccacgcgacttttacaatgcgcctactgtctcccgtgagagtgccaaactacaatctcatcattatggatgaggcacatttcaccgaccctgccagcatcgctgccagggggtacatatccacccgggtcggaatgggcgaagcagccgctatttttatgactgcgacacccccaggcaccgccgatgcattccctcagtcaaacgctcccatccaggacgaggagcgagacattccagaaagaagttggaatagcgggaacgagtggatcacagattttgccggaaaaactgtatggttcgtgccgtctataaaggcaggtaatgacattgccaactgtttacgcaaaaacggcaagaaggttatccaactgtccaggaaaacgtttgataccgaatatcagaagacaaaacttaatgactgggatttcgtggtcactaccgacatctcagagatgggggctaactttaaggccgatcgtgtgattgaccctcggagatgcctgaaacccgttatcctcacagatggaccagagagggtgattttggcgggccccatgcctgtcaccgcagccagtgctgcccagcgccgaggtagagtggggcggaatccacagaaggaaaacgaccaatacatattcactggccagcccctgaataacgatgaggaccacgctcattggacggaagcaaagatgctcctggacaatatcaacacccctgagggaattatcccggcccttttcgaaccagagagggagaaaagcgctgccatcgatggcgaatatcgcctaaagggggagtcccgtaaaacatttgtagaactgatgagacggggagacttgcccgtgtggttagcacacaaggttgcgtctgagggtattaaatacactgataggaagtggtgcttcgacggccagcgcaataaccagatactggaagagaatatggatgtcgagatctggaccaaagaaggggagaagaagaaactccgacctagatggctggacgcccggacatattcggatccccttgctctgaaggaatttaaagacttcgccgcaggaaggaagagcattgctctcgatttggtgaccgagatcggccgcgtgccatcacacctggcccatagaactaggaacgcactagacaatctggtcatgctccacacatccgaacatggtgggcgggcctaccgtcacgctgttgaggagcttcctgaaacgatggagaccctgttattgctgggcctcatgattctgcttactggaggcgcgatgctgtttctcatcagtgggaaaggaataggtaagacatctatcggcttgatttgtgtgatcgccagctccgggatgctgtggatggcagaaattcccttacaatggatcgcttcagccatagtactagagttctttatgatggtgctgctcattccagagcctgaaaagcagcgcaccccgcaggataaccaacttgcctatgtcgtgatcggaattctgaccttggcagctatcatagccgcgaatgagatgggcctgctcgaaacaactaaacgagacctgggtatgtctaaggagcccggggttgtgagcccaacgagttaccttgatgtcgacctccaccctgcttccgcctggaccctgtacgcagtagccacaactgtgatcacccccatgttgagacatacaattgaaaacagcaccgctaatgtttctctggcagccatcgcgaaccaggctgtggtcttaatgggcctagacaaaggatggccaatttcaaagatggatctgggcgtgcctctccttgccctggggtgctattcccaggtcaaccccttgactctgacggcagccgtgctcctgcttatcacacactacgctataattggaccgggcttacaggccaaagcaaccagggaggctcaaaagcggactgccgcgggtatcatgaagaatccaaccgttgacgggatcatgacaattgatctggaccctgtgatctatgatagtaaattcgagaagcagctcggacaggtaatgttgctggtgctatgtgccgtccagctgctccttatgcgcactagctgggcactgtgcgaagctttgaccctggccacaggccccataacgaccctctgggagggttcgccaggcaaattttggaacactacaattgcagtttctatggctaatatcttcagagggtcctacctggccggagccggcttagcgtttagcattatgaagtcagtggggaccggaaaaaggggcactggtagtcaaggggaaacacttggagagaagtggaagaaaaagctgaaccagctctctcggaaagaattcgacctatataagaaatccggcatcaccgaggtcgatcgaacggaggctaaggaaggtctgaaaagaggcgagataacccatcacgcagtgagccgcgggtcagccaagttgcagtggtttgtagaaaggaatatggtgatccccgagggacgggttattgacctgggctgtgggcgtggaggctggagttactattgcgctggtctcaagaaagtgacagaagtcagagggtacactaagggaggccctggccatgaggagccggtgcccatgagcacctacgggtggaacatcgtcaaacttatgtccggaaaggatgtgttctatctgccacctgaaaaatgtgacacattgctgtgcgatattggtgagtctagcccctcccctactgttgaagagtcaaggaccatccgcgtactcaagatggtggagccatggttaaagaataaccagttctgtattaaagtcctgaatccctacatgcctacagtgatcgaacaccttgagcggctgcaacgaaagcacggcgggatgctagttagaaacccactctctaggaatagtacccatgaaatgtattggatatcgaacggaactggcaatattgtggccagcgtcaacatggtgtcccgcctgttgctgaatcggtttacgatgacacacagacgtcccaccatcgagaaagacgtagatctcggtgcagggactaggcatgtgaacgccgaaccggagacccctaacatggacgttatcggagagcggattaagcgcataaaagaagagcacaattctacatggcactacgacgatgaaaacccatataagacgtgggcttaccatggctcatatgaggtcaaggcgaccggcagcgcctccagtatgatcaatggggtggtgaaacttctgactaagccctgggacgtcgttcctatggtgacacagatggcaatgaccgatactacaccattcggacagcaacgagtatttaaagaaaaggtggacaccagaacacccaggtctatgccgggtactcggcgcgtcatgggcattaccgctgagtggttatggagaacgctggggaggaacaaaaagcctcgattgtgcacccgggaggaattcacaaagaaagtgcgtactaatgccgcaatgggagccgtttttaccgaggaaaaccagtgggatagcgctaaggccgcggtggaggacgaagatttctggatcctcgtcgacagagagcgcgagctgcacaaactaggcaagtgtggttcatgcgtgtacaatatgatggggaaaagggaaaagaaacttggagagtttggcaaggcaaagggctcccgggccatttggtacatgtggctgggggctagatatctcgaattcgaggccctgggatttttgaacgaggatcattggttcagtcgcgaaaatagctactctggtgtagagggcgaagggctgcacaaactcggatatatccttagggacatatccaagatccccggcggtgcaatgtacgctgatgacacagccgggtgggacactcgaattaccgaggatgacctgcataacgaagagaaaatcacgcagcagatggatccagagcaccggcaattagcttcagccatttttaagctgacatatcagaataaagttgtgaaggtccagagacctacccccactggaacagtgatggacatcataagcaggaaggatcagcgcggctcgggccaagtggggacctacggattgaacactttcaccaatatggaagcacagctcattcgtcagatggagggtgaaggcgtcctgtctaaagcggacctagagaacccacaccttcccgaaaagaaaatcacacagtggctggagacgaagggggttgagcggctcaaaagaatggccatcagtggagatgactgcgtggtaaagcctattgatgacaggtttgctaatgccctgttggcattaaacgatatgggcaaggtgcgcaaagacataccacaatggcagccgtccaagggttggcatgattggcagcaggtccccttctgtagccaccatttccacgaactgatcatgaaagacgggcgaaagctcgtggttccttgccggccacaagacgagcttattggaagagctaggatctcacagggcgccggctggtccctgcgcgaaaccgcatgtctagggaaagcctatgcgcagatgtggtctctgatgtactttcacagacgggatctcaggttggctagcaacgccatttgcagtgcagtgcccgtccattgggtgcctacttcccgtacaacctggagcatccacgcccatcaccaatggatgactacagaggacatgctgaccgtatggaatcgagtttggatagaagataacccatggatggaggacaagacgcccgtgacaacctgggagaatgtcccttaccttggaaagcgcgaagatcagtggtgtggttctctgatcggcctcacttcaagagctacctgggcccagaacattccgacagcaatccagcaagtgcggagtttaattgggaatgaggaattcctggactatatgccatccatgaaaaggtttcgcaaggaggaggaaagcgagggagctatctggtga

SEQ ID NO: 15421 - RNA, 9873 nt, synthetic construct
  misc_feature 1..9873: note = derived and/or modified CDS sequence (opt3) from DENV-3__EU687196__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcaaggtagacaacttcaccatgggggtgttgtgcctcgccattctgtttgaagaggtcatgcgcggaaagttcggcaaaaagcatatgatcgcaggggtgatcttcacgtttgttctactgctctccggacagattacttggcgggatgtggctcacaccctgatcatgattggcagtaatgccagcgacagaatgggtatgggggtcacataccttgcattgatagccaccttcaaaatccagccctttctggctttaggattctttctcaggaagctgacttctcgcgaaaaccttctgctaggcgtgggcctcgcgatggccacaaccctgcaattgccggaggatattgaacagatggcaaatgggatcgctctgggattaatggccctcaaactgacaactcagttcgagacctatcagctttggacggccctgatttccttgacatgttcaaacaccatctttactctcaccgttgcttggcgaacagcaactctgatactagccggtgtgagtctgcttcctgtctgccaaagctcgtccatgcggaagaccgactggctcccaatgacggtagcggctatgggcgtgccccctctgcccttgttcatcttttctctgaaggatacattaaaacgtagaagctggccactcaatgagggggttatggccgtgggactggtctcaattcttgcaagttccctgttgaggaacgacgtgcctatggccggccccctcgtagctggtgggctgctaatcgcatgttacgtgattaccggaacttctgccgatctgacagtcgaaaaggcggctgacgttacctgggaggaagaggccgaacagactggcgtgagccataaccttatgatcacagtggacgatgacggcaccatgcgcataaaagatgacgagacggagaatattctcactgtcctgttgaagaccgcattactgatcgtgtccgggatcttcccatactcaattccggccacactcctggtttggcacacctggcagaaacagacacaacggagcggagtactttgggatgtgcctagtcccccagaaactcagaaggctgagctggaagagggtgtctatagaataaaacagcagggcatctttgggaagacccaagtgggagttggcgtgcagaaggagggtgtcttccatacgatgtggcacgtgacaaggggggccgtattgacttacaacggaaaacgactagaacccaattgggcatctgtcaagaaagacctgatttcctatggcggcgggtggcgcctcagcgctcagtggcaaaagggagaggaagtgcaggttatcgccgtggagcctggtaaaaacccaaagaattttcagaccatgcccggcattttccagacaaccactggggaaatcggagcgatagccctggatttcaagcctggcacctcgggttcaccgatcattaaccgggaggggaaagtcgtgggactttacggcaatggcgttgtgacaaagaacgggggatatgtctctggtatcgcacaaacgaatgctgagccagacggccccactcctgaattagaggaagagatgtttaaaaagagaaacctgaccattatggatctccacccagggagtggaaaaacaaggaagtacttgcccgccatcgtgcgtgaagctataaagcgccggctgagaaccctcattctggcacctactagggtagtggccgccgagatggaggaagctcttaaaggcctgccgatccgatatcagacaaccgcgacgaagtccgagcatactggtcgggaaatcgttgacttgatgtgccacgcaacattcaccatgcgcctactgagccccgtcagagtgccaaattacaacctcattatcatggatgaggcccattttaccgaccctgcttctatagccgcaagggggtacattagcactcgggtgggaatgggcgaagccgctgcgatcttcatgacagccacccccccaggcacagcagatgcttttcctcagtccaatgcccccattcaggacgaggagcgagacatcccagaaagatcatggaacagtgggaatgagtggataactgatttcgcaggaaaaacggtctggtttgtaccgagcattaaggccggtaacgacatcgctaactgtttacgcaaaaatggcaagaaggtgatccaactgtctaggaaaaccttcgatacagaatatcagaagactaaacttaacgactgggattttgttgtgaccacagacatttccgagatgggggccaatttcaaggcggatcgtgtcatcgaccctcggagatgcctgaaacccgtgattctcaccgatggaccagagagggttatattggcaggccccatgcctgtgactgccgcttcagccgctcagcgccgaggtagagtcgggcggaacccacagaaggaaaatgaccaatacatctttacgggccagcccctgaacaatgatgaggaccacgcacattggaccgaagccaagatgctcctggacaacattaatacacctgagggaatcatcccggctcttttcgaaccagagagggagaaaagtgccgcaattgatggcgaatatcgcctaaagggggagagccgtaaaactttcgtggaactgatgagacggggagacttgcccgtatggttagcgcacaaggtggcctccgagggtataaaatacaccgataggaagtggtgctttgacggccagcgcaacaatcagatcctggaagagaacatggatgttgagatttggacaaaagaaggggagaagaagaaactccgacctagatggctggacgctcggacctattctgatccccttgccctgaaggaattcaaagactttgcagctggaaggaagtcgatcgccctcgatttggtcactgagattggccgcgtgccaagccacctggcacatagaacaaggaatgccctagacaacctggtgatgctccacatgtcagaacatggtgggaaagcttaccggcacgcggtcgaggagcttcctgaaacgatggagaccctgttattgctgggcctcatgatcctgcttactggaggcgccatgctgttcctcatatccgggaagggaatcggtaagacaagtattggcttgatctgtgttattgcatctagcgggatgctgtggatggctgaaatccccttacaatggatagcctccgccattgtgctagagtttttcatgatggtactgctcatcccagagcctgaaaaacagcgtaccccgcaggataatcaacttgcatatgtggtcattggaatcctgaccttggctgccataatcgcggctaacgagatgggcctgctcgaaacaactaagcgcgacctgggtatgtcaaaagagcccggggtggtttctccaacgagctaccttgatgtggacctccaccctgccagtgcatggaccctgtacgccgtcgctacaactgtaattacccccatgttgcgacatacaatcgaaaattccaccgcaaacgtgagcctggccgcgattgctaaccaggccgttgtgttaatgggcctagacaagggatggccaatctctaaaatggatctgggcgtccctctccttgcactggggtgctattcacaggtgaatcccttgactctgacggccgctgtcctcctgcttataacacactacgccattatcggaccgggcttacaggcaaaggctaccagagaggcccaaaagaggactgcggccggtatcatgaaaaacccaaccgtggacgggattatgacaatcgatctggaccctgttatatatgattccaagtttgagaaacagctcggacaggtgatgttgctggtactatgtgcagtgcagctgctccttatgcggactagttgggctctgtgcgaagccttgaccctggcaacaggccccattacgaccctctgggagggtagcccaggcaagttctggaatactacaatcgctgtctcgatggccaacatttttcgcgggtcttacctggccggagcgggcttagctttctccatcatgaaaagcgttgggaccggaaagagaggcactggttcacaaggggaaacacttggagagaagtggaaaaagaaactgaatcagctcagtaggaaggaatttgacctatataaaaagtctggcataaccgaggtggatcggacggaggcaaaagaaggtctgaagcgaggcgagatcacccatcacgccgtctccagagggagcgctaagttgcagtggttcgtggaacgcaacatggtaattcccgagggaagggtgatcgacctgggctgtgggcggggaggctggtcatactattgcgccggtctcaaaaaggttacagaagtgcgtgggtacactaaaggaggccctggccatgaggagccggtccccatgagtacctacgggtggaatattgtgaagcttatgagcggaaaagatgtcttttatctgccacctgaaaagtgtgacacattgctgtgcgatatcggtgagtcctctcccagccctactgtggaagagtccagaaccgttagggtactcaagatggtggagccatggttaaaaaacaatcagttctgtattaaggtcctgaacccctacatgcctacagtgatcgaacaccttgagcgcctgcaacggaaacacggcgggatgctagttcgaaatccactctcaagaaactctacccatgaaatgtattggataagtaatggaactggcaacattgtggcatcggtcaatatggtgagcaggctgttgctgaaccgcttcacgatgacacaccggagacccaccatcgagaaggacgtagatctcggtgccgggactcgtcatgtgaacgctgaaccggagacccctaatatggacgttatcggagagaggattaaacggataaaggaagagcacatctccacatggcactacgacgatgaaaacccatataagacgtgggcgtaccatggctcttatgaggtcaaagccaccggctcagcaagctccatgattaatggggtggtgaagcttctgactaaaccctgggacgtcgttcctatggtgacacagatggctatgaccgatactacaccatttggacagcaacgcgtattcaaggaaaaagtggacacccgaacacccagaagtatgccgggtactaggcgggtcatgggcatcaccgccgagtggttatggcgcacgctggggagaaacaagaagcctaggttgtgcacccgagaggaatttacaaaaaaggtgcggactaatgcagccatgggagctgttttcaccgaggaaaaccagtgggattctgccaaagcggcagtggaggacgaagatttttggaagctcgtcgaccgtgagagagagctgcacaaactaggcaagtgtggtagctgcgtgtacaatatgatggggaaacgcgaaaagaagcttggagagttcggcaaagccaagggctcaagggctatttggtacatgtggctgggggcccggtatctcgaatttgaggcactgggattcttgaacgaggatcattggttttccagagaaaatagttacagcggtgtagagggcgaagggctgcacaaactcggatatatccttcgcgacatatctaagatccccggcggtgctatgtacgccgatgacacagctgggtgggacactaggattaccgaggatgacctgcataacgaagagaaaatcacgcagcagatggatccagagcaccgacaattagccaatgcaattttcaagctgacatatcagaacaaggttgtgaaagtccagcggcctacccccactggaacagtgatggacatcatatccagaaaggatcagaggggctcaggccaagtggggacctacggattgaatacttttaccaacatggaagcgcagctcattcgccagatggagggtgaaggcgtcctgagcaaagccgacctagagaatccacaccttcccgaaaagaaaatcacacagtggctggagacgaagggggttgagcgtctcaagcggatggctatctcgggagatgactgcgtggtaaaacctattgatgacagattcgccaacgcactgttggctttaaacgatatgggcaaggtgaggaaagacataccacaatggcagccgtctaagggttggcatgattggcagcaggtccccttttgtagtcaccatttccacgaactgatcatgaaagacgggcgcaagctcgtggttccttgccgaccacaagacgagcttattggacgggccagaatctcccagggcgcaggctggagcttcagggaaaccgcctgtctggggaaggcgtatgctcagatgtggtcactaatgtactttcaccgcagagatctgcggctcgcctccaatgcaatttgctctgccgtgcccgtccattgggtgcctactagcaggacaacctggagtatccacgctcatcaccaatggatgactacagaggacatgttgaccgtatggaaccgtgtttggatagaagataatccatggatggaggacaaaacgcccgtgacaacctgggagaacgtcccttacctgggaaagcgagaagatcagtggtgtggttcccttatcggcctgactagccgcgccacctgggcacagaatattccgacagctatccagcaagtgagatctctcattgggaacgaggaattcttagactatatgccatcaatgaaacggtttaggaaggaggaggaaagtgagggagccatctggtga

SEQ ID NO: 15422 - RNA, 9873 nt, synthetic construct
  misc_feature 1..9873: note = derived and/or modified CDS sequence (opt3) from DENV-3__EU854298__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccaacgccagcagggcttggaatgtttgggaagtggaggactatggttttggggtcttcaccacgaacatttggctgaaacttcgggaagtgcacacacagttgtgtgaccaccgcctcatgtctgcagccgttaaggatgagagagctgtgcatgccgacatgggatactggatcgagtcacagaaaaatggcagttggaagctggaaaaagcaagcctaatagaggtaaagacctgcacttggcctaagtcccacaccctgtggtctaacggtgtcctcgaatcggatatgatcattccaaaaagcctggcgggcccgatctcccagcataattacaggcccgggtatcacacacaaactgccggaccttggcaccttggcaagttggagctggactttaactactgcgaggggaccacagtggtgattacggaaaattgtggaacccgtggcccatcattacggactacaaccgtcagtggtaaactcatccatgagtggtgctgtcgatcttgcactctgccccctcttagatatatgggggaagatggatgttggtacggcatggagataaggccaattagcgaaaaggaggagaacatggttaaatccctggtgtcagctggtagcggcaaggtagacaatttcacaatgggggtgttgtgcctcgccatcctgtttgaagaggtcatgcgcggaaagttcggcaaaaagcacatgatcgcaggggtgttctttaccttcgttctactgctctctggacagattacgtggcgggatatggctcatactctgatcatgattggctccaacgccagtgacagaatgggtatgggggtgacctatcttgcattgatagccacatttaaaatccagcccttcctggctttaggatttttcctcaggaagctgaccagccgcgaaaatcttctgctaggcgtcggcctcgcgatggccactacactgcaattgccggaggatattgaacagatggcaaacgggatcgctctgggattaatggccctcaaactgattacccagtttgagacataccagctttggactgccctgatctctttgacctgttccaatacgatattcacactcaccgtggcttggcgaactgcaaccctgatcctagccggtgtttcactgcttcctgtgtgccaaagtagctcgatgcggaagacagactggctcccaatgactgtcgcggctatgggcgtaccccctctgcccttgtttattttctccctgaaggataccttaaaacgtagatcttggccactcaacgagggggtgatggccgttggactggtgagcatccttgcatcaagtctgttgaggaacgacgtccctatggccggccccctcgtggctggtgggctgctaattgcatgttatgtaatcacgggaacatccgccgatctgaccgtggaaaaggcggctgacgtcacttgggaggaagaggccgaacagacaggcgtttctcacaatcttatgataaccgtggacgatgacggcactatgcgcattaaagatgacgagacagagaacatcctcaccgtgctgttgaagacggcattactgatcgtcagcgggatttttccatactccataccggccactctcctggtgtggcatacctggcagaaacagacacaacggtcaggagttctttgggatgtacctagccccccagaaacccagaaggctgagctggaagagggtgtgtacagaatcaaacagcagggcattttcgggaagacacaagtcggagtgggcgttcagaaggagggtgtgtttcacactatgtggcacgtcaccaggggggccgtgttggcatataatggaaaacgactagaacccaactgggctagtgtaaagaaagacctgatctcttacggcggcgggtggcgcctctccgcccagtggcaaaagggagaggaagtccaggtgattgcggttgagcctggtaaaaatccaaagaacttccagacgatccccggcacattccagactaccacaggggaaataggagccatcgcactggattttaagcctggcaccagcggttcgccgattatcaatcgggaggggaaagtggtcggactttatggcaacggcgtggttactaagaatgggggatacgtgtcaggtattgctcaaaccaacgccgagccagacggccccacacctgaattagaggaagagatgttcaaaaagagaaatctgacgatcatggatctccatccagggtctggaaaaactaggaagtatttgcccgctatagtccgtgaagcaattaagcgccggctgagaaccctcatcctggcccctacaagggtggtagccgctgagatggaggaagcgcttaaaggcctgccgatccgataccagaccactgcaacaaagagtgagcacaccggtcgggaaattgtggacttgatgtgccatgccacgtttactatgcgcctactgtcccccgttagagtcccaaactataatctcatcataatggatgaggctcacttcacagaccctgccagcattgcagccagggggtacatctctacccgggtgggaatgggcgaagctgcggccatttttatgaccgcaactcccccaggcacagctgatgccttccctcagagcaacgcacccatccaggacgaggagcgagacataccagaaagatcctggaattcagggaacgagtggattaccgattttgccggaaaaacagtgtggttcgtcccgagtatcaaggctggtaacgacatcgccaattgtttacgcaaaaacggcaagaaggtaattcaactgagcaggaaaacttttgatacggaataccagaagaccaaacttaatgactgggatttcgtggttacaactgacatctctgagatgggggcgaactttaaggcagatcgtgtgattgaccctcggagatgcctgaaacccgtcatactcaccgatggaccagagagggtgatcttggccggccccatgcctgttacagctgcctccgctgcacagcgccgaggtagagtggggcggaatccacagaaggaaaacgaccaatatattttcaccggccagcccctgaataacgatgaggaccatgcccactggactgaagctaagatgctcctggacaatatcaacacgcctgagggaatcattccggcccttttcgaaccagagagggagaaatcagcagcgatagatggcgaataccgcctaaagggggagagtcgtaaaacctttgtcgaactgatgagacggggagacttgcccgtgtggttagcccacaaggtagctagcgagggtatcaaatatacagataggaagtggtgcttcgacggccagcgcaataaccagattctggaagagaatatggatgtggagatctggactaaagaaggggagcgaaagaagctcagacctcggtggctggacgccaggacctactccgatccccttgcactgaaagaatttaaggacttcgctgccggacgcaaatctattgcactcgatttggttacagagatcggcagagtcccatcgcatctggcccacaggacccggaacgctctagacaatctggtgatgctccatactagcgaacacggtgggaaggcgtatcgtcacgccgtggaggagcttcctgaaacaatggagacgctgttattgctgggcctcatgatactgcttaccggaggcgcaatgctgtttctcatctcagggaaaggaattggtaagacttccatcggcttgatttgtgtcatcgctagttctgggatgctgtggatggccgaaatacccttacaatggattgccagcgcaatcgttctagagttctttatgatggtgctgctcattccagagcctgaaaagcagcgcacaccgcaggataaccaacttgcttacgtagtgatcggaatactgaccttggccgcgatcattgctgccaatgagatgggcctgctcgaaaccacaaaacgagacctgggtatgtccaaggagcccggggtcgtgtcaccaacttcttatcttgatgttgacctccatcctgcaagcgcctggacgctgtacgctgtggcaaccacagtcatcactcccatgttgagacacaccattgaaaacagtacagccaacgtatccctggcggctatcgccaatcaggcagtggttttaatgggcctagacaaaggatggccaataagcaagatggatctgggcgtgcctctccttgccctggggtgctactctcaggtcaaccccttgaccctgactgctgccgtgctcctgcttattacgcattatgcaatcatcggaccgggcttacaggctaaagccacaagggaggcgcaaaagcggaccgccgcaggtattatgaagaatccaactgtcgacgggatcatgaccatagatctggaccctgtgatttacgattcaaaattcgagaagcagctcggacaggttatgttgctggtgctatgtgctgtacagctgctccttatgcgcacatcctgggccctgtgcgaagcattgactctggctaccggccccatcacaacgctctgggagggtagtccaggcaaattttggaacaccactattgccgtgagcatggccaatatcttcagagggtcgtatctggcgggagctggcttagcattttctataatgaagtccgtcgggacaggaaaaaggggcaccggtagccaaggggaaactcttggagagaagtggaagaaaaagctgaaccagctctcacggaaagaattcgacctatacaagaaaagtggcatcacagaggttgatcgaaccgaggccaaggaaggtctgaaaagaggcgagattacgcaccatgctgtgtctcgcgggtccgccaagttgcagtggtttgtcgaaaggaatatggtgatccccgagggacgggtaattgacctgggctgtgggcgtggaggctggagctattactgcgcaggtctcaagaaagtgaccgaagttagagggtatacaaagggaggccctggccacgaggagccggtgcccatgtcaacttacgggtggaacatcgtcaaacttatgagtggaaaggatgtgttctacctgccacctgaaaaatgtgacaccttgctgtgcgatattggtgagagctccccctctcctacagtcgaagagagcaggactatccgcgtgctcaagatggttgagccatggttaaagaataaccagttctgtataaaagtactgaatccctatatgcctaccgtgattgaacaccttgagcggctgcaacgaaagcatggcgggatgctagtcagaaacccactctccaggaattcaacacacgaaatgtactggatctctaacggaaccggcaatatcgtggccagtgttaacatggtgtcgcgcctgttgctgaaccggtttactatgacgcatagacgtcccacaattgagaaagacgtcgatctcggtgctgggaccaggcacgtgaatgcggaaccggagactcctaacatggacgtaataggagagcggatcaagcgcattaaagaagagcacaatagcacctggcattatgacgatgaaaacccatacaagacatgggcctatcacggctcctacgaggtgaaggcaacgggctctgcttcaagcatgatcaatggggttgtcaaacttctgaccaagccctgggacgtggtgcctatggtcactcagatggccatgacagataccactccattcggacagcaacgagtttttaaagaaaaggtggacacaagaacccccaggtccatgccgggtacacggcgcgtaatgggcattactgcagagtggttatggagaaccctggggaggaacaaaaagcctcgattgtgcacgcgggaggaattcaccaagaaagtgcgtacaaatgccgctatgggagccgtctttactgaggaaaaccagtgggatagtgcgaaggcagccgtggaggacgaagatttctggaaactcgttgacagagagcgcgagctgcataagctaggcaaatgtggttcttgcgtgtataatatgatggggaagagggaaaaaaagcttggagagtttggcaaggctaaaggcagccgggccatctggtacatgtggctgggggcaagatacctcgaattcgaggctctgggatttttgaacgaggatcactggttctcacgcgaaaattcctatagtggtgtcgagggcgaagggctgcataagctcggatacatacttagggacatcagcaaaattcccggcggtgccatgtatgctgatgacaccgccgggtgggacacacgaatcactgaggatgacctgcacaacgaagagaagattacccagcagatggatccagagcaccggcaattagcaaatgcgatctttaaactgacgtaccagaacaaggtggtaaaggttcagagacctacacccaccggaactgtgatggacataatttctaggaaagatcagcgcggctccggccaagtcgggacatatggattgaataccttcactaacatggaagtgcagctcatccgtcagatggagggtgaaggcgtgctgtcaaaggccgacctagagaacccacatcttcccgaaaaaaagatcacccagtggctggagacaaaaggggtcgagcggctcaagagaatggctattagcggagatgactgcgttgtgaagcctatagatgacaggtttgccaatgcactgttggctttaaacgatatgggcaaagtacgcaaggacatcccacaatggcagccgtcgaaaggttggcacgattggcagcaggtgcccttctgttctcatcacttccacgaactgattatgaaggacgggcgaaaactcgtcgtgccttgccggccacaagacgagcttatcggaagagccaggattagtcagggcgcaggctggtccctgcgcgaaacggcctgtctagggaaggcgtacgctcagatgtggagcctgatgtattttcatagacgggatctcaggttggcctcaaatgcaatctgctccgccgttcccgtgcactgggtccctacctctcgtactacatggagcatacatgctcaccatcaatggatgaccactgaggacatgctgacagtgtggaaccgagtatggatcgaagataatccatggatggaggacaagacccccgttacgacatgggagaacgtgccttaccttggaaaacgcgaagatcagtggtgtggtagtctgattggcctcacctccagagccacttgggcacagaatatcccgaccgctattcaccaggtccggagcttaatcgggaacgaggaattcctggactacatgccatctatgaagaggtttcgcaaagaggaggaattggagggagccatttggtga

SEQ ID NO: 15423 - RNA, 9873 nt, synthetic construct
  misc_feature 1..9873: note = derived and/or modified CDS sequence (opt3) from DENV-3__FJ373306__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacgttggcacatctctcactcagaaggtggtcatcttcatattactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatcgagctccagaagaccgaagcaactcaactggccacacttaggaaactgtgtattgagggaaagatcaccaacattacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaagtacctttctccacagaggacggccaaggtaaggctcataacgggcgtcttattactgcgaatccagtcgtgaccaaaaaggaggaacccgttaacatcgaggcagaaccgcctttcggcgagtcaaatatagtgattggaatcggcgataacgccttgaaaatcaattggtataagaaggggagcagtattggaaaaatgtttgaagctacagcccgcggtgcaagaaggatggccatcctgggcgacactgcttgggatttcgggtctgtcggaggcgtgctcaactccctgggtaagatggtacaccagatttttgggagcgcctacaccgcacttttctcgggcgtgtcttgggttatgaaaataggaatcggcgtcctgttgacgtggattgggctcaattccaagaacacatcaatgagttttagctgcatcgtgatcggaattataaccctgtatttaggcgcggtggtccaggctgacatgggttgtgttatcaattggaaagggaaggagctgaagtgcggatccggcattttcgtgactaacgaggtgcatacatggaccgaacagtacaaatttcaagccgattctcccaagcggctagcaactgccatcgctggtgcctgggagaatggcgtatgtgggattcgaagcaccacacgcatggaaaacctcctgtggaaacagatcgcaaatgagcttaactatatattgtgggaaaataacatcaagctgacggtcgtggttggagacattatcggcgtgctcgagcaggggaaaagaaccctgactccacagcctatggagttaaagtactcatggaaaacatggggaaaggctaagattgtcaccgccgaaacacaaaacagttccttcatcatagatggccccaatactccagagtgccccagcgcgtctagggcctggaacgtgtgggaagttgaggactatggttttggggtgttctcaaccaatatttggctgaaacttcgggaagtatacacgcagttgtgtgaccaccgcctcatgagtgctgcagtcaaggatgagagagccgtgcacgctgacatgggatactggatcgagagccagaaaaacggctcctggaagctggaaaaagcctctctaattgaggtgaagacatgcacctggcctaagtcgcatactctgtggagcaatggtgtcctcgaatccgatatgatcataccaaaatcactggcaggcccgatcagtcagcacaactataggcccgggtaccatacccaaacagcgggaccttggcaccttggcaagttggagctggactttaattattgcgaggggactaccgttgtgattacagaaaactgtggaacgcgtggcccatctttacggaccactacagtaagcggtaaactcatccacgagtggtgctgtcgatcctgcaccctgccccctcttagatacatgggggaagatggatgttggtatggcatggagattaggccaatctcagaaaaggaggagaatatggtgaaaagcctggtctctgccggttccggcaaggtggacaacttcactatgggggttttgtgcctcgctatactgtttgaagaggtgatgcgcggaaagttcggcaaaaagcatatgattgccggggtcttctttacattcgtgctactgctcagtggacagatcacctggcgggatatggcacacacgctgatcatgattggcagcaatgcttctgacagaatgggtatgggggttacttaccttgccttgatcgcaacctttaaaattcagcccttcctggccttaggatttttcctcaggaagctgacatcccgcgaaaaccttctgctaggcgtgggcctcgctatggcgaccactctgcaattgccggaggatatagaacagatggccaatgggatcgcactgggattaatggctctcaaactgattacacagtttgagacctatcagctttggacagccctgatctcattgacttgtagtaacaccattttcacgctcacagtcgcctggcgaaccgctactctgatcctagcaggtgtaagcctgcttcctgtgtgccaatcgtcctctatgcggaagaccgactggctcccaatgacagttgccgcgatgggcgtgccccctctgcccttgtttatattcagcctgaaggatactttaaaacgtagatcatggccactcaatgagggggtcatggctgtgggactggtaagtatccttgcctcctctctgttgaggaacgacgtgcctatggcaggccccctcgtcgccggtgggctgctaattgcttgttacgttatcaccggaacgagcgcagatctgacagtggaaaaggccgcggacgtgacctgggaggaagaggctgaacagactggcgtctcccataaccttatgattacagtggacgatgacggcaccatgcgcatcaaagatgacgagactgagaatatactcacagttctgttgaagaccgccttactgattgtatcagggatctttccatacagcatcccggcaacgctcctggtgtggcacacttggcagaaacagacccaacggagtggagtcctttgggatgtgccttctcccccagaaacacagaaggccgagctggaagagggtgtttatagaattaaacagcagggcatattcgggaagacccaagtgggagtcggcgtgcagaaggagggtgtatttcatacaatgtggcacgtcactaggggggctgtgttgacctacaacggaaaacgactagaacccaattgggcctccgttaagaaagacctgatcagctatggcggcgggtggcgcctctcggcacagtggcaaaagggagaggaagtgcaggtcattgctgtggagcctggtaaaaacccaaagaatttccagacgatgcccggcacattccagactaccacaggggaaatcggagccattgcgctggattttaagcctggcacctcaggttctccgatcataaaccgggaggggaaagttgtgggactttacggcaatggcgtcgtgactaagaacgggggatatgtaagtggtatcgcccaaaccaatgcagagccagacggccccacacctgaattagaggaagagatgttcaaaaagagaaacctgacgattatggatctccacccagggtccggaaaaactaggaagtacttgcccgctatcgtgcgtgaagccattaagcgccggctgagaaccctcatcctggctcctacaagggttgtcgcagccgagatggaggaagcccttaaaggcctgccgatacgatatcagaccactgctacaaagagcgagcataccggtcgggaaattgtggacttgatgtgccacgcgacgtttactatgcgcctactgtctcccgtgagagtcccaaattacaacctcatcatcatggatgaggcacatttcacagaccctgccagcattgctgccagggggtacatctccacccgggtaggaatgggcgaagcagccgctatatttatgaccgcgactcccccaggcacagccgatgcattccctcagtcaaatgctcccattcaggacgaggagcgagacatcccagaaagaagttggaacagcgggaatgagtggattaccgattttgccggaaaaacagtgtggttcgttccgtctatcaaggcaggtaacgacatagccaactgtttacgcaaaaatggcaagaaggtgattcaactgtccaggaaaacttttgatacggaatatcagaagaccaaacttaacgactgggatttcgtcgtgacaactgacatctcagagatgggggctaattttaaggccgatcgtgttatcgaccctcggagatgcctgaaacccgtgattctcaccgatggaccagagagggtcatcttggcgggccccatgcctgtgacagcagccagtgctgcccagcgccgaggtagagtagggcggaacccacagaaggaaaatgaccaatacattttcaccggccagcccctgaacaatgatgaggaccacgctcattggactgaagcaaagatgctcctggacaacataaatacgcctgagggaatcattccggcccttttcgaaccagagagggagaaaagcgctgccatcgatggcgaatatcgcctaaagggggagtcccgtaaaacctttgtggaactgatgagacggggagacttgcccgtttggttagcacacaaggtcgcgtctgagggtatcaaatacacagataggaagtggtgcttcgacggccagcgcaacaatcagattctggaagagaacatggatgtggagatatggactaaagaaggggagaagaagaaactccgacctagatggctggacgcccggacctattcggatccccttgctctgaaggaatttaaagacttcgccgcaggaaggaagagcatcgctctcgatttggtgacagagattggccgcgtcccatcacacctggcccatagaaccaggaatgcactagacaacctggttatgctccacacttccgaacatggtgggaaagcctaccggcacgctgtggaggagcttcctgaaacaatggagacgctgttattgctgggcctcatgatcctgcttaccggaggcgcgatgctgtttctcattagtgggaagggaatcggtaagacttctataggcttgatctgtgtaattgccagctccgggatgctgtggatggcagaaatccccttacaatggattgcttcagccatcgtgctagagttctttatgatggtcctgctcataccagagcctgaaaaacagcgtacaccgcaggataatcaacttgcctatgtggttattggaatcctgaccttggcagctattatcgccgcgaacgagatgggcctgctcgaaaccacaaagcgcgacctgggtatgtctaaagagcccggggtggtcagcccaactagttaccttgatgtagacctccaccctgcttccgcctggacgctgtacgcagtggccaccacagttataactcccatgttgcgacataccatcgaaaatagcacagctaacgtgtctctggcagccattgcgaaccaggctgtcgtgttaatgggcctagacaagggatggccaatctcaaaaatggatctgggcgtccctctccttgccctggggtgctattcccaggtgaatcccttgaccctgactgcagccgttctcctgcttattacgcactacgctatcataggaccgggcttacaggccaaggcaacaagagaggctcaaaagaggaccgccgcgggtattatgaaaaacccaactgtggacgggatcatgaccatcgatctggaccctgtaatttatgatagtaagttcgagaaacagctcggacaggtgatgttgctggtcctatgtgccgttcagctgctccttatgcggacaagctgggcactgtgcgaagctttgactctggccaccggccccatcacaacgctctgggagggttcgccaggcaagttttggaataccactatagcagtgtctatggctaacattttccgcgggtcctacctggccggagccggcttagcgtttagcatcatgaaatcagtcgggacaggaaagagaggcaccggtagtcaaggggaaactcttggagagaagtggaaaaagaaactgaatcagctctctaggaaggaattcgacctatataaaaagtccggcattacagaggtggatcggaccgaggctaaagaaggtctgaagcgaggcgagatcacgcatcacgcagtaagcagagggtcagccaagttgcagtggtttgtggaacgcaacatggttatacccgagggaagggtgatcgacctgggctgtgggcggggaggctggagttactattgcgctggtctcaaaaaggtcaccgaagtgcgtgggtacacaaaaggaggccctggccatgaggagccggtccccatgagcacttacgggtggaatattgtgaagcttatgtccggaaaagatgttttctatctgccacctgaaaagtgtgacaccttgctgtgcgatatcggtgagtctagcccctcccctacagtagaagagtcaagaactattagggtgctcaagatggtcgagccatggttaaaaaacaatcagttctgtatcaaggtgctgaacccctacatgcctaccgttattgaacaccttgagcgcctgcaacggaaacacggcgggatgctagtgcgaaatccactctctagaaacagtacacatgaaatgtattggatctcgaatggaaccggcaacatagtcgccagcgtgaatatggtatccaggctgttgctgaaccgctttactatgacgcaccggagacccacaattgagaaggacgtggatctcggtgcagggacccgtcatgttaacgccgaaccggagactcctaatatggacgtcatcggagagaggatcaaacggattaaggaagagcacaactctacctggcactacgacgatgaaaatccatataagacatgggcttaccatggctcatatgaggtgaaagcgacgggcagcgcctccagtatgataaacggggtggtcaagcttctgaccaaaccctgggacgttgtgcctatggtaactcagatggcaatgacagataccactccattcggacagcaacgcgtgtttaaggaaaaagtcgacacacgaacccccagatctatgccgggtacaaggcgggtgatgggcatcactgctgagtggttatggcgcaccctggggagaaataagaagcctaggttgtgcacgcgagaggaattcaccaaaaaggttcggacaaacgccgcaatgggagccgtgtttactgaggaaaatcagtgggatagcgctaaagccgcggtcgaggacgaagatttctggattctcgtggaccgtgagagagagctgcacaagctaggcaaatgtggttcatgcgtatacaacatgatggggaagcgcgaaaaaaagcttggagagtttggcaaggcaaaaggctccagggccatctggtacatgtggctgggggctcggtatctcgaattcgaggccctgggatttttgaatgaggatcattggttcagtagagaaaacagctactctggtgttgagggcgaagggctgcacaagctcggatatattcttcgcgacatctccaaaatacccggcggtgcaatgtacgctgatgacaccgccgggtgggacacaaggatcactgaggatgacctgcataatgaagagaagattacccagcagatggatccagagcaccgacaattagctaacgccatctttaaactgacgtatcagaataaggtggtcaaggtgcagcggcctacacccaccggaactgtgatggacattatctcaagaaaagatcagaggggcagcggccaagtcgggacatacggattgaacaccttcactaatatggaagcacagctcatacgccagatggagggtgaaggcgttctgtcgaaggcggacctagagaacccacaccttcccgaaaaaaagattacccagtggctggagacaaaaggggtggagcgtctcaagcggatggccatctctggagatgactgcgtagtgaagcctatcgatgacagatttgctaacgccctgttggcattaaatgatatgggcaaagtcaggaaggacattccacaatggcagccgagtaaaggttggcatgattggcagcaggtgcccttctgttcccaccatttccacgaactgataatgaaggacgggcgcaaactcgttgtgccttgccgaccacaagacgagcttatcggacgggctagaattagccagggcgccggctggtcactgagggaaacggcatgtctagggaaggcctatgcgcagatgtggtccctgatgtactttcaccgcagagatctccggttggcttctaacgccatctgcagcgcagtccccgtgcattgggtacctaccagtaggactacatggtccattcacgcccatcaccaatggatgaccactgaggacatgctgacagtttggaatcgtgtgtggatcgaagataacccatggatggaggacaagacccccgtcacgacatgggagaatgtgccttaccttggaaaacgagaagatcagtggtgtggtagcctgataggcctcacctctcgcgctacttgggcccagaacatcccgaccgcaattcagcaagttagatcattaatcgggaatgaggaattcctggactatatgccaagtatgaagcggtttaggaaagaggaggaatccgagggagctatttggtga

SEQ ID NO: 15424 - RNA, 9873 nt, synthetic construct
  misc_feature 1..9873: note = derived and/or modified CDS sequence (opt3) from DENV-3__EU687197__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtggtgaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccaacgccagcagggcttggaatgtgtgggaagtcgaggactatggttttggggtgttcaccacgaacatctggctgaaacttcgggaagtttacacacagttgtgtgaccaccgcctcatgtctgcagccgtgaaggatgagagagctgtacacgccgacatgggatactggattgagtcacagaaaaatggcagttggaagctggaaaaagcaagcctaatcgaggtcaagacctgcacttggcctaagtcccataccctgtggtctaacggtgtgctcgaatcggatatgataatcccaaaaagcctggcgggcccgatttcccagcacaattataggcccgggtaccatacacaaactgccggaccttggcaccttggcaagttggagctggactttaactattgcgaggggaccacagtggtcatcacggaaaattgtggaacccgtggcccatcattacggactacaaccgttagtggtaaactcattcacgagtggtgctgtcgatcttgcactctgccccctcttagatacatgggggaagatggatgttggtatggcatggagatcaggccaataagcgaaaaggaggagaacatggtgaaatccctggtatcagctggtagcggcaaggtggacaatttcacaatgggggtcttgtgcctcgccattctgtttgaagaggtgatgcgcggaaagttcggcaaaaagcatatgatcgcaggggttttctttaccttcgtgctactgctctctggacagatcacgtggcgggatatggctcacactctgattatgatcggctccaacgccagtgacagaatgggtatgggggtcacctaccttgcattgattgccacatttaaaatacagcccttcctggctttaggatttttcctcaggaagctgaccagccgcgaaaatcttctgctaggcgtgggcctcgcgatggccactacactgcaattgccggaggatatcgaacagatggcaaacgggattgctctgggattaatggccctcaaactgatcacccagtttgagacatatcagctttggactgccctgatttctttgacctgttccaatacgatcttcacactcaccgttgcttggcgaactgcaaccctgatactagccggtgtgtcactgcttcctgtctgccaaagtagctcgatgcggaagacagactggctcccaatgactgtagcggctatgggcgtgccccctctgcccttgtttatcttctccctgaaggataccttaaaacgtagatcttggccactcaacgagggggttatggccgtgggactggtcagcattcttgcatcaagtctgttgaggaacgacgtgcctatggccggccccctcgtagctggtgggctgctaatcgcatgttacgtgattacgggaacatccgccgatctgaccgtcgaaaaggcggctgacgttacttgggaggaagaggccgaacagacaggcgtgtctcataatcttatgatcaccgtggacgatgacggcactatgcgcataaaagatgacgagacagagaacattctcaccgtcctgttgaagacggcattactgatcgtgagcgggatctttccatactccattccggccactctcctggtttggcacacctggcagaaacagacacaacggtcaggagtactttgggatgtgcctagccccccagaaacccagaaggctgagctggaagagggtgtctatagaataaaacagcagggcatcttcgggaagacacaagtgggagttggcgtgcagaaggagggtgtctttcatactatgtggcacgtgaccaggggggccgtattggcatacaatggaaaacgactagaacccaactgggctagtgtcaagaaagacctgatttcttatggcggcgggtggcgcctctccgcccagtggcaaaagggagaggaagtgcaggttatcgcggtggagcctggtaaaaatccaaagaacttccagacgatgcccggcacattccagactaccacaggggaaattggagccatcgcactggattttaagcctggcaccagcggttcgccgataatcaatcgggaggggaaagtcgtgggactttacggcaacggcgttgtgactaagaatgggggatatgtctcaggtattgctcaaaccaacgccgagccagacggccccacacctgaattagaggaagagatgttcaaaaagagaaatctgacgatcatggatctccacccagggtctggaaaaactaggaagtacttgcccgctattgtgcgtgaagcaatcaagcgccggctgagaaccctcatactggcccctacaagggtagtggccgctgagatggaggaagcgcttaaaggcctgccgattcgatatcagaccactgcaacaaagagtgagcataccggtcgggaaatcgttgacttgatgtgccacgccacgtttactatgcgcctactgtcccccgtcagagtgccaaactacaatctcatcattatggatgaggctcatttcacagaccctgccagcatcgcagccagggggtacatatctacccgggtgggaatgggcgaagctgcggccatttttatgaccgcaactcccccaggcacagctgatgccttccctcagagcaacgcacccatccaggacgaggagcgagacattccagaaagatcctggaattcagggaacgagtggatcaccgattttgccggacgcacagtctggttcgtaccgagtataaaagctggtaacgacattgccaattgtttaaggaagaacggcaaaaaggtgatccaactgagccgtaagacttttgatacggaatatcagaaaaccaagcttaatgactgggatttcgttgtgacaactgacatctctgagatgggggcgaactttaaagcagatcgggtcattgaccctagaaggtgcctgaagcccgtgatcctcaccgatggaccagagcgcgttattttggccggccccatgcctgtgacagctgcctccgctgcacagcgaagaggtcgggtcgggaggaatccacagaaagaaaacgaccaatacatattcaccggccagcccctgaataacgatgaggaccacgcccattggactgaagctaagatgctcctggacaatatcaacacgcctgagggaattatcccggcccttttcgaaccagagcgcgagaagtcagcagcgatcgatggcgaatatcgtctaaaaggggagagtagaaagacctttgtggaactgatgcggaggggagacttgcccgtatggttagcccacaaagtggctagcgagggtattaagtacacagatcgcaaatggtgcttcgacggccagcgaaataaccagatactggaagagaatatggatgttgagatctggactaaggaaggggagagaaaaaagctccggcctaggtggctggacgcccgcacctattccgatccccttgcactgaaggaatttaaagacttcgctgccggaagaaagtctattgcactcgatttggtcacagagatcggcagggtgccatcgcacctggcccatcggacccgtaacgctctagacaatctggtgatgctccacactagcgaacatggtgggaaagcgtaccgccacgccgtcgaggagcttcctgaaacaatggagacgctgttattgctgggcctcatgattctgcttaccggaggcgcaatgctgtttctcatctcagggaagggaataggtaaaacttccatcggcttgatttgtgttatcgctagttctgggatgctgtggatggccgaaattcccttacaatggatcgccagcgcaatagtgctagagttctttatgatggtactgctcattccagagcctgaaaagcagcgaacaccgcaggataaccaacttgcttatgtggtcatcggaattctgaccttggccgcgatcatagctgccaatgagatgggcctgctcgaaaccacaaagagagacctgggtatgtccaaagagcccggggtggtttcaccaacttcttaccttgatgtggacctccaccctgcaagcgcctggacgctgtacgctgtcgcaaccacagtaatcactcccatgttgaggcataccattgaaaacagtacagccaacgtgtccctggcggctatcgccaatcaggcagttgtgttaatgggcctagacaagggatggccaattagcaaaatggatctgggcgtccctctccttgccctggggtgctattctcaggtgaaccccttgaccctgactgctgccgtcctcctgcttatcacgcactacgcaataattggaccgggcttacaggctaaggccacacgggaggcgcaaaaacgcaccgccgcaggtatcatgaagaatccaactgtggacgggatcatgaccattgatctggaccctgttatctatgattcaaagttcgagaaacagctcggacaggtgatgttgctggtactatgtgctgtgcagctgctccttatgagaacatcctgggccctgtgcgaagcattgactctggctaccggccccataacaacgctctgggagggtagtccaggcaagttttggaacaccactattgccgtcagcatggccaatatcttcagggggtcgtacctggcgggagctggcttagcattttctattatgaaatccgttgggacaggaaagcggggcaccggtagccaaggggaaactcttggagagaaatggaagaagaaactgaaccagctctcacgaaaggaattcgacctatataaaaagagtggcatcacagaggtggatagaaccgaggccaaagaaggtctgaagcgcggcgagataacgcatcacgctgtctctagggggtccgccaaattgcagtggtttgtggaacggaatatggtaatccccgagggacgtgtgattgacctgggctgtgggagaggaggctggagctactattgcgcaggtctcaagaaggttaccgaagtgagggggtacacaaaaggaggccctggccatgaggagccggtccccatgtcaacttacgggtggaacatcgtgaagcttatgagtggaaaagatgtcttctatctgccacctgaaaagtgtgacaccttgctgtgcgatattggtgagagctccccctctcctacagtggaagagagccgcactatccgggttctcaaaatggtagagccatggttaaagaataaccagttctgtattaaggtgctgaatccctacatgcctaccgtcatcgaacaccttgagcgactgcaaagaaaacacggcgggatgctagtgaggaacccactctcccgcaattcaacacatgaaatgtattggatatctaacggaaccggcaatattgttgccagtgtgaacatggtctcgcggctgttgctgaacagatttactatgacgcaccgtaggcccacaatcgagaaggacgtggatctcggtgctgggacccggcatgtaaatgcggaaccggagactcctaacatggacgtgatcggagagcgcattaaacgaataaaggaagagcacaatagcacctggcactacgacgatgaaaacccatataaaacatgggcctaccatggctcctatgaggttaaggcaacgggctctgcttcaagcatgatcaatggggtcgtgaagcttctgaccaaaccctgggacgtggtccctatggttactcagatggccatgacagataccactccattcggacagcaaagagtgtttaaggaaaaagtagacacaaggaccccccggtccatgccgggtacacgcagagtgatgggcattactgcagagtggttatggaggaccctggggcgaaacaagaaacctcggttgtgcacgcgtgaggaattcaccaagaaggtcagaacaaatgccgctatgggagccgtgtttactgaggaaaaccagtgggatagtgcgaaagcagccgttgaggacgaagatttctggaagctcgtggaccgcgagagggagctgcacaaactaggcaagtgtggttcttgcgtctacaatatgatggggaaacgggaaaagaaacttggagagtttggcaaggctaagggcagcagagccatctggtacatgtggctgggggcacgctatctcgaattcgaggctctgggatttttgaacgaggatcattggttctcaagggaaaattcctacagtggtgtggagggcgaagggctgcacaaactcggatatattcttcgagacatcagcaagatacccggcggtgccatgtacgctgatgacaccgccgggtgggacacacggatcactgaggatgacctgcataacgaagagaaaattacccagcagatggatccagagcacagacaattagcaaatgcgatctttaagctgacgtatcagaacaaagtagttaaggtgcagaggcctacacccaccggaactgtcatggacattatctctcgcaaggatcagcgtggctccggccaagtggggacatacggattgaataccttcactaacatggaagtgcagctcatacggcagatggagggtgaaggcgtcctgtcaaaagccgacctagagaacccacaccttcccgaaaagaaaattacccagtggctggagacaaagggggttgagagactcaaaaggatggctatcagcggagatgactgcgtggtaaagcctatcgatgaccgctttgccaatgcactgttggctttaaacgatatgggcaaggtgcgaaaagacattccacaatggcagccgtcgaagggttggcatgattggcagcaggtccccttctgttctcaccatttccacgaactgataatgaaagacgggcggaagctcgtggttccttgcagaccacaagacgagcttatcggaagggcccgcattagtcagggcgcaggctggtccctgagagaaacggcctgtctagggaaagcgtatgctcagatgtggagcctgatgtactttcaccggagggatctccgtttggcctcaaatgcaatctgctccgccgtgcccgtccattgggtgcctacctctcgaactacatggagcattcacgctcatcaccaatggatgaccactgaggacatgctgacagtatggaaccgcgtttggatcgaagataatccatggatggaggacaagacccccgtgacgacatgggagaacgtcccttaccttggaaagagagaagatcagtggtgtggtagtctgataggcctcacctcccgggccacttgggcacagaatatcccgaccgctattcatcaggtgaggagcttaatcgggaacgaggaattcctggactatatgccatctatgaaacgctttagaaaggaggaggaattggagggagccatttggtga

SEQ ID NO: 15425 - RNA, 9873 nt, synthetic construct
  misc_feature 1..9873: note = derived and/or modified CDS sequence (opt3) from DENV-3__EU687198__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggagttggcgataacgctttgaaaattaattggtataagaaggggagcagtatcggaaaaatgtttgaagccaccgcacgcggtgccagaaggatggctattctgggcgacacagcctgggatttcgggtctgtgggaggcgtcctcaactccctgggtaagatggtgcaccagatatttgggagcgcatacactgcgcttttctcgggcgtatcttgggtgatgaaaatcggaattggcgttctgttgacctggatcgggctcaattccaagaacacgtcaatgagttttagctgcatcgctattggaataatcacactgtatttaggcgccgtcgtgcaggcagacaccggttgtgtgattaattggaaagggaaggagctgaagtgcggatccggcatcttcgtcactaacgaggttcatacatggaccgaacagtacaaatttcaagccgattctcccaagcggctagctactgccattgcaggtgcttgggagaatggcgtgtgtgggatccgaagcaccacacgcatggaaaacctcctgtggaaacagatagccaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggcgaagatcgttaccgccgaaacacaaaacagttccttcataattgatggccccaatactccagagtgccccagcgcttctagggcatggaacgtgtgggaagtcgaggactatggttttggggtgttcaccacgaatatctggctgaaacttcgggaagtttacacacagttgtgtgaccaccgcctcatgtcagccgctgtgaaggatgagagagccgtacacgcagacatgggatactggattgagagtcagaaaaacggcagctggaagctggaaaaagcgtccctaatcgaggtcaagacctgcacttggcctaagtctcataccctgtggtcgaatggtgtgctcgaaagcgatatgataatcccaaaatccctggccggcccgatttcacagcacaactataggcccgggtaccatacacaaactgctggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgccggttctggcaaggtggacaacttcacaatgggggtcttgtgcctcgcaattctgtttgaagaggtgatgcgcggaaagttcggcaaaaagcatatgatcgctggggttttctttaccttcgtgctactgctctccggacagatcacgtggcgggatatggcccacactctgattatgatcggcagtaatgcaagcgacagaatgggtatgggggtcacctaccttgccttgattgctacatttaaaatacagcccttcctggcgttaggatttttcctcaggaagctgacctctcgcgaaaaccttctgctaggcgtgggcctcgccatggcaactacactgcaattgccggaggatatcgaacagatggctaatgggattgccctgggattaatggccctcaaactgatcacccagtttgagacatatcagctttggactgctctgatttccttgacctgttcaaacacgatcttcacactcaccgttgcatggcgaactgccaccctgatactagcgggtgtgagtctgcttcctgtctgccaaagctcgtccatgcggaagtctgactggctcccaatgacagtagctgccatgggcgtgccccctctgcccttgtttatcttcagcctgaaggatactttaaaacgtagatcatggccactcaatgagggggttatggcagtgggactggtcagtattcttgcctcctctctgttgaggaacgacgtgcctatggctggccccctcgtagcaggtgggctgctaatcgcctgttacgtgattaccggaacgagcgcggatctgacagtcgaaaaggctgccgacgttacctgggaggaagaggcagaacagactggcgtgtcccataaccttatgatcacagtggacgatgacggcaccatgcgcataaaagatgacgagactgagaatattctcacagtcctgttgaagaccgccttactgatcgtgtcagggatctttccatacagcattccggctacgctcctggtttggcacacttggcagaaacagacccggagaagtggagtactttgggatgtgccttctcccccagaaacacaaaaggccgagctggaagagggtgtctataggataaaacagcagggcatcttcgggaagacccaggtgggagttggcgtgcaaaaggagggtgtctttcatacaatgtggcacgtgactcgaggggcagtattgacctacaacggaaaacgcctagaacccaattgggcttccgtcaagaaagacctgattagctatggcggcgggtggcggctctcggcccagtggcagaagggagaggaagtgcaagttatcgcggtggagcctggtaaaaacccaaagaatttccagacgatgcccggcacattccagactaccacaggggaaattggagccatcgcactggattttaagcctggcacctcaggttctccgataatcaacagagaggggaaagtcgtgggactttacggcaatggcgttgtgactaagaacgggggatatgtcagtggtattgctcagaccaatgccgagccagacggccccacacctgaattagaggaagagatgttcaaaaagaggaacctgacgatcatggatctccacccagggtccggaaaaactcgtaagtacttgcccgctattgtgcgcgaagcaatcaagcggagactgaggaccctcatactggcccctacacgagtagtggccgctgagatggaggaagcgcttaaaggcctgccgattcggtatcaaaccactgcaacaaagagcgagcataccggtcgcgaaatcgttgacttgatgtgccacgccacgtttactatgagactactgtctcccgtcagggtgccaaattacaacctcatcattatggatgaggctcatttcacagaccctgccagcatcgcagcccgggggtacatatccacccgagtgggaatgggcgaagctgcggccatttttatgaccgcaactcccccaggcacagctgatgccttccctcagtcaaatgcacccatccaggacgaggagagagacattccagaacgcagttggaacagcgggaatgagtggatcaccgattttgccggaaaaacagtctggttcgtaccgtctataaaggctggtaacgacattgccaactgtttaaggaaaaatggcaagaaggtgatccagctgtcccgtaaaacttttgatacggaatatcaaaagacccggcttaacgactgggatttcgttgtgacaactgacatctcagagatgggggcgaattttaaagcagatagagtcattgaccctaggcgctgcctgaagcccgtgatcctcaccgatggaccagagcgagttattttggccggccccatgcctgtgacagctgccagtgctgcacagagacggggtagggtcgggcgcaacccacagaaagaaaatgaccagtacatattcaccggccaacccctgaacaatgatgaggaccacgcccattggactgaagctaagatgctcctggacaacatcaatacgcctgagggaattatcccggcccttttcgaaccagagcgtgagaagagcgcagcgatcgatggcgaatatagactaaaaggggagtcccggaagacctttgtggaactgatgaggcgcggagacttgcccgtatggttagcccacaaagtggcttctgagggtattaagtacacagatcgaaaatggtgcttcgacggccagagaaacaatcagatactggaagagaacatggatgttgagatctggactaaggaaggggagaaaaagaagctccggcctaggtggctggacgcccgcacctattcggatccccttgcactgaaagaatttaaggacttcgctgccggaagaaaaagcattgcactcgatttggtcacagagatcggcagggtgccatcacacctggcccatcggacccgtaatgctctagacaacctggtgatgctccacacttccgaacatggtgggaaggcgtaccgccacgccgtcgaggagcttcctgaaacaatggagacgctgttattgctgggcctcatgattctgcttaccggaggcgcaatgctgtttctcatcagtgggaaaggaataggtaagacttctatcggcttgatttgtgttatcgctagctccgggatgctgtggatggccgaaattcccttacagtggatcgcctcagcaatagtgctagagttctttatgatggtactgctcattccagagcctgaaaagcaacgaacaccgcaggataatcagcttgcttatgtggtcatcggaattctgaccttggccgcgatcatagctgccaacgagatgggcctgctcgaaaccacaaaaagagacctgggtatgtctaaggagcccggggtggttagcccaactagttaccttgatgtggacctccaccctgcatccgcctggacgctgtacgctgtcgcaaccacagtaatcactcccatgttgaggcataccattgaaaatagcacagccaacgtgtctctggcggctatcgccaaccaagcagttgtgttaatgggcctagacaaaggatggccaatttcaaagatggatctgggcgtccctctccttgccctggggtgctattcccaggtgaatcccttgaccctgactgctgccgtcctcctgcttatcacgcactacgcaataattggaccgggcttacaggctaaagccacacgggaggcgcagaagcgcaccgccgcaggtatcatgaagaacccaactgtggacgggatcatgaccattgatctggaccctgttatctatgatagtaaattcgagaagcaactcggacaggtgatgttgctggtactatgtgctgtgcagctgctccttatgagaacaagctgggccctgtgcgaagcattgactctggctaccggccccataacaacgctctgggagggttcgccaggcaaattttggaataccactattgccgtctctatggccaacatcttcagggggtcctacctggcgggagctggcttagcatttagcattatgaagtcagttgggacaggaaaacggggcaccggtagtcagggggaaactcttggagagaagtggaagaaaaagctgaatcaactctctcgaaaagaattcgacctatataagaaatccggcatcacagaggtggatagaaccgaggccaaggaaggtctgaaacgcggcgagataacgcatcacgctgtcagcagggggtcagccaagttgcagtggtttgtggaacggaacatggtaatccccgagggacgtgtgattgacctgggctgtgggagaggaggctggagttactattgcgcaggtctcaagaaagttaccgaagtgagggggtacacaaagggaggccctggccatgaggagccggtccccatgagcacttacgggtggaatatcgtgaaacttatgtccggaaaggatgtcttctatctgccacctgaaaaatgtgacaccttgctgtgcgatattggtgagtctagcccctcccctacagtggaagagtcacgcactatccgggttctcaagatggtagagccatggttaaagaacaatcagttctgtattaaagtgctgaacccctacatgcctaccgtcatcgaacaccttgagcgactgcagagaaagcacggcgggatgctagtgaggaatccactctctcgcaacagtacacatgaaatgtattggatatcgaatggaaccggcaacattgttgccagcgtgaatatggtctcccggctgttgctgaacagatttactatgacgcaccgtaggcccacaatcgagaaagacgtggatctcggtgctgggacccggcatgtaaacgcggaaccggagactcctaatatggacgtgatcggagagcgcattaagcgaataaaagaagagcacaactctacctggcactacgacgatgaaaatccatataagacatgggcctaccatggctcatatgaggttaaggcaacgggcagcgcttccagtatgatcaacggggtcgtgaaacttctgaccaagccctgggacgtggtccctatggttactcaaatggccatgacagataccactccattcggacagcagagagtgtttaaagaaaaggtagacacaaggaccccccggtctatgccgggtacacgcagagtgatgggcattactgcagagtggttatggaggaccctggggcgaaataaaaagcctcggttgtgcacgcgtgaggaattcaccaagaaagtcagaacaaacgccgctatgggagccgtgtttactgaggaaaatcaatgggatagcgcgaaggcagccgttgaggacgaagatttctggaaactcgtggaccgcgagagggagctgcacaagctaggcaaatgtggttcatgcgtctacaacatgatggggaagcgggaaaaaaagcttggagagtttggcaaggctaaaggctccagagccatctggtacatgtggctgggggcacgctatctcgaattcgaggctctgggatttttgaatgaggatcattggttcagtagggaaaacagctactctggtgtggagggcgaagggctgcacaagctcggatatattcttcgagacatctccaaaatacccggcggtgccatgtacgctgatgacaccgccgggtgggacacacggatcactgaggatgacctgcataatgaagagaagattacccagcagatggatccagagcacagacagttagcaaacgcgatctttaaactgacgtatcaaaataaggtagttaaggtgcagaggcctacacccaccggaactgtcatggacattatctcacgcaaagatcagcgtggcagcggccaggtggggacatacggattgaacaccttcactaatatggaagcccaactcatacggcagatggagggtgaaggcgtgctgtcgaaggctgacctagagaacccacacctttctgaaaaaaagattacccagtggctggagacaaaaggggtcgagagactcaagaggatggccatcagtggagatgactgcgttgtgaagcccatcgatgaccgctttgcaaacgctctgttggccttaaatgatatgggcaaagtacgaaaggacattcctcagtggcaaccatccaaaggttggcatgattggcagcaggtgccgttctgtagccaccatttccacgaactgataatgaaggacgggcggaaactcgtcgtgccctgcagacctcaggacgagcttatcggaagggcacgcatttcacaaggcgccggctggtccctgagagaaacggcgtgtctagggaaggcttatgcccagatgtggtctctgatgtactttcaccggagggatctccgtttggcaagcaacgccatctgcagtgctgttccagtgcattgggtccccacctcccgaactacatggagcattcacgcccatcaccagtggatgaccactgaggacatgctgacagtgtggaatcgcgtatggatcgaagataacccttggatggaggacaagaccccagttacgacatgggagaatgtgccctaccttggaaaaagagaagatcaatggtgtggttctctgataggcctcacctcacgggcaacttgggctcagaacatccctaccgccattcagcaggtcaggagtttaatcgggaatgaggaattcctggactatatgccgtccatgaagcgctttagaaaagaggaggaaagcgagggagcgatttggtga

SEQ ID NO: 15426 - RNA, 9873 nt, synthetic construct
  misc_feature 1..9873: note = derived and/or modified CDS sequence (opt3) from DENV-3__EU726769__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatggttgccggggtgttctttaccttcgtcctactgctctccggacagatcacgtggcgggatatggcacacactctgattatggtgggcagtaatgctagcgacagaatgggtatgggggttacctaccttgccttgatcgcaacatttaaaattcagcccttcctggccttaggatttttcctcaggaagctgacctctcgcgaaaaccttctgctaggcgtgggcctcgctatggcgactacactgcaattgccggaggatatagaacagatggccaatgggatcgcactgggattaatggctctcaaactgattacccagtttgagacatatcagctttggactgccctgatctccttgacctgttcaaacacgattttcacactcaccgtcgcctggcgaactgctaccctgatcctagcaggtgtaagtctgcttcctgtgtgccaaagctcgtccatgcggaagacagactggctcccaatgactgttgccgcgatgggcgtgccccctctgcccttgtttatattctctctgaaggataccttaaaacgtagaagctggccactcaatgagggggtcatggctgtgggactggtatcaatccttgccagttccctgttgaggaacgacgtgcctatggcaggccccctcgtcgccggtgggctgctaattgcttgttacgttatcacgggaacatctgcagatctgaccgtggaaaaggccgcggacgtgacttgggaggaagaggctgaacagacaggcgtcagccataaccttatgattaccgtggacgatgacggcactatgcgcatcaaagatgacgagacagagaatatactcaccgttctgttgaagacggccttactgattgtatccgggatctttccatactcaatcccggcaactctcctggtgtggcacacctggcagaaacagacacaacggagcggagtcctttgggatgtgcctagtcccccagaaacccagaaggccgagctggaagagggtgtttatagaattaaacagcagggcatattcgggaagacacaagtgggagtcggcgtgcagaaggagggtgtatttcatactatgtggcacgtcaccaggggggctgtgttgacgtacaacggaaaacgactagaacccaattgggcctctgttaagaaagacctgatctcctatggcggcgggtggcgcctcagcgcacagtggcaaaagggagaggaagtgcaggtcattgctgtggagcctggtaaaaacccaaagaatttccagacaatgcccggcactttccagaccacaaccggggaaatcggagccattgcgctggattttaagcctggcacttcgggttcaccgatcataaaccgggaggggaaagttgtgggactttacggcaatggcgtcgtgaccaagaacgggggatatgtatctggtatcgcccaaacaaatgcagagccagacggccccacgcctgaattagaggaagagatgttcaaaaagagaaacctgactattatggatctccacccagggagtggaaaaaccaggaagtacttgcccgctatcgtgcgtgaagccattaagcgccggctgagaacactcatcctggctcctaccagggttgtcgcagccgagatggaggaagcccttaaaggcctgccgatacgatatcagactacagctaccaagtccgagcatacgggtcgggaaattgtggacttgatgtgccacgcgacttttacaatgcgcctactgagccccgtgagagtcccaaattacaacctcatcatcatggatgaggcacatttcaccgaccctgcctctattgctgccagggggtacatcagcacccgggtaggaatgggcgaagcagccgctatatttatgactgcgacacccccaggcaccgccgatgcattccctcagtccaatgctcccattcaggacgaggagcgagacatcccagaaagatcatggaacagtgggaatgagtggattacagattttgccggaaaaactgtgtggttcgttccgagcatcaaggcaggtaacgacatagccaactgtttacgcaaaaatggcaagaaggtgattcaactgtctaggaaaacgtttgataccgaatatcagaagacaaaacttaacgactgggatttcgtcgtgactaccgacatctccgagatgggggctaattttaaggccgatcgtgttatcgaccctcggagatgcctgaaacccgtgattctcacagatggaccagagagggtcatcttggcgggccccatgcctgtgaccgcagcctcagctgcccagcgccgaggtagagtagggcggaacccacagaaggaaaatgaccaatacattttcactggccagcccctgaacaatgatgaggaccacgctcattggacggaagcaaagatgctcctggacaacataaatacccctgagggaatcattccggcccttttcgaaccagagagggagaaaagtgctgccatcgatggcgaatatcgcctaaagggggagagccgtaaaacatttgtggaactgatgagacggggagacttgcccgtttggttagcacacaaggtcgcgtccgagggtatcaaatacactgataggaagtggtgcttcgacggccagcgcaacaatcagattctggaagagaacatggatgtggagatatggaccaaagaaggggagaagaagaaactccgacctagatggctggacgcccggacatattctgatccccttgctctgaaggaatttaaagacttcgccgcaggaaggaagtcgatcgctctcgatttggtgaccgagattggccgcgtcccaagccacctggcccatagaactaggaatgcactagacaacctggttatgctccacacatcagaacatggtgggaaagcctaccggcacgctgtggaggagcttcctgaaacgatggagaccctgttattgctgggcctcatgatcctgcttactggaggcgcgatgctgtttctcatttccgggaagggaatcggtaagacaagtataggcttgatctgtgtaattgcctctagcgggatgctgtggatcgcagaaattcccttacaatggatcgcttccgccatagtgctagagttctttatgatggtcctgctcattccagagcctgaaaaacagcgtaccccgcaggataatcaacttgcctatgtggttatcggaattctgaccttggcagctatcatagccgcgaacgagatgggcctgctcgaaacaactaagcgcgacctgggtatgtcaaaagagcccggggtggtctctccaacgagctaccttgatgtagacctccaccctgctagtgcctggaccctgtacgcagtggccacaactgttatcacccccatgttgcgacatacaattgaaaattccaccgctaacgtgagcctggcagccatcgcgaaccaggctgtcgtgttaatgggcctagacaagggatggccaatttctaaaatggatctgggcgtccctctccttgccctggggtgctattcacaggtgaatcccttgactctgacggcagccgttctcctgcttatcacacactacgctataattggaccgggcttacaggccaaggcaaccagagaggctcaaaagaggactgccgcgggtatcatgaaaaacccaaccgtggacgggatcatgacaattgatctggaccctgtaatctatgattccaagttcgagaaacagctcggacaggtgatgttgctggtcctatgtgccgttcagctgctccttatgcggactagttgggcactgtgcgaagctttgaccctggccacaggccccataacgaccctctgggagggtagcccaggcaagttttggaatactacaattgcagtgtcgatggctaacatcttccgcgggtcttacctggccggagccggcttagcgttttccattatgaaaagcgtcgggaccggaaagagaggcactggttcacaaggggaaacacttggagagaagtggaaaaagaaactgaatcagctcagtaggaaggaattcgacctatataaaaagtctggcatcaccgaggtggatcggacggaggctaaagaaggtctgaagcgaggcgagataacccatcacgcagtatccagagggagcgccaagttgcagtggtttgtggaacgcaacatggttatccccgagggaagggtgattgacctgggctgtgggcggggaggctggtcatactattgcgctggtctcaaaaaggtcacagaagtgcgtgggtacactaaaggaggccctggccatgaggagccggtccccatgagtacctacgggtggaatatcgtgaagcttatgagcggaaaagatgttttctatctgccacctgaaaagtgtgacacattgctgtgcgatattggtgagtcctctcccagccctactgtagaagagtccagaaccatcagggtgctcaagatggtcgagccatggttaaaaaacaatcagttctgtattaaggtgctgaacccctacatgcctacagttatcgaacaccttgagcgcctgcaacggaaacacggcgggatgctagtgcgaaatccactctcaagaaactctacccatgaaatgtattggataagtaatggaactggcaacattgtcgcctcggtgaatatggtaagcaggctgttgctgaaccgctttacgatgacataccggagacccaccatcgagaaggacgtggatctcggtgcagggactcgtcacgttaacgccgaaccggagacccctaatatggacgtcatcggagagaggattaaacggataaaggaagagcataactccacatggcactatgacgatgaaaatccatacaagacgtgggcttatcacggctcttacgaggtgaaagcgaccggctcagccagctccatgatcaacggggtggtcaagcttctgactaaaccctgggacgttgtgcctatggtaacacagatggcaatgaccgatactacaccattcggacagcaacgcgtgtttaaggaaaaagtcgacacccgaacacccagaagtatgccgggtactaggcgggtgatgggcattaccgctgagtggttatggcgcacgctggggagaaataagaagcctaggttgtgcacccgagaggaattcacaaaaaaggttcggactaacgccgcaatgggagccgtgtttaccgaggaaaatcagtgggattctgctaaagccgcggtcgaggacgaagatttctggatcctcgtggaccgtgagagagagctgcataaggtaggcaaatgtggtagctgcgtttacaacatgatggggaagcgcgaaaaaaagctaggagagtttggcaaggcaaaaggctcaagggccatttggtatatgtggcttggggctcggtacctggaattcgaggccctcggatttctgaatgaggatcactggttctccagagaaaacagttatagcggtgtggagggcgaagggttgcataagctgggatacatcctccgcgacatatctaaaatccccggcggtgcaatgtatgctgatgacacagccgggtgggacactaggattaccgaggatgaccttcacaatgaagagaagatcacgcagcagatggatccagagcatcgacaactggctaacgccatttttaaattaacataccagaataaggtcgtgaaggtgcagcggcctacccccactggaacagtcatggacatcatatccagaaaagatcagaggggctcaggccaagttgggacctatggactgaacactttcaccaatatggaagcacagttgattcgccagatggagggtgaaggcgtgctcagcaaggcggacctggagaacccacacctacccgaaaaaaagatcacacagtggcttgagacgaaaggggtagagcgtctgaagcggatggccatctcgggagatgactgcgtggtcaagcctattgatgacagatttgctaacgccctcctggcattgaatgatatgggcaaagtgaggaaggacataccacaatggcagccgtctaaaggttggcacgattggcagcaggttcccttctgtagtcatcacttccatgaattaatcatgaaggacgggcgcaaactggtggtcccttgccgaccacaagacgagctcattggacgggctagaatctcccagggcgccggctggagccttagggaaaccgcatgtctggggaaggcctacgcgcagatgtggtcactaatgtactttcaccgcagagatctgcggctcgcttccaacgccatttgctctgcagtgcccgtacactgggttcctactagcaggacaacctggagtatccatgcccaccatcaatggatgactacagaggacatgttgaccgtgtggaatcgtgtctggatagaagataacccatggatggaggacaagacgcccgtgacaacctgggagaatgttccttatctgggaaaacgagaagatcagtggtgtggttcccttatcggcctgactagccgcgctacctgggcccagaacattccgacagcaatccagcaagtgagatctctcattgggaatgaggaattcttagactacatgccatcaatgaagcggtttaggaaagaggaggaaagtgagggagctatctggtga

SEQ ID NO: 15427 - RNA, 9873 nt, synthetic construct
  misc_feature 1..9873: note = derived and/or modified CDS sequence (opt3) from DENV-3__EU687239__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggagttggcgataacgctttgaaaattaattggtataagaaggggagcagtatcggaaaaatgtttgaagccaccgcacgcggtgccagaaggatggctattctgggcgacacagcctgggatttcgggtctgtgggaggcgtcctcaactccctgggtaagatggtgcaccagatatttgggagcgcatacactgcgcttttctcgggcgtatcttgggtgatgaaaatcggaattggcgttctgttgacctggatcgggctcaattccaagaacacgtcaatgagttttagctgcatcgctattggaataatcacactgtatttaggcgccgtcgtgcaggcagacaccggttgtgtgattaattggaaagggaaggagctgaagtgcggatccggcatcttcgtcactaacgaggttcatacatggaccgaacagtacaaatttcaagccgattctcccaagcggctagctactgccattgcaggtgcttgggagaatggcgtgtgtgggatccgaagcaccacacgcatggaaaacctcctgtggaaacagatagccaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggcgaagatcgttaccgccgaaacacaaaacagttccttcataattgatggccccaatactccagagtgccccagcgcttctagggcatggaacgtgtgggaagtcgaggactatggttttggggtgttcaccacgaatatctggctgaaacttcgggaagtttacacacagttgtgtgaccaccgcctcatgtcagccgctgtgaaggatgagagagccgtacacgcagacatgggatactggattgagagtcagaaaaacggcagctggaagctggaaaaagcgtccctaatcgaggtcaagacctgcacttggcctaagtctcataccctgtggtcgaatggtgtgctcgaaagcgatatgataatcccaaaatccctggccggcccgatttcacagcacaactataggcccgggtaccatacacaaactgctggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgccggttctggcaaggtggacaacttcacaatgggggtcttgtgcctcgcaattctgtttgaagaggtgatgcgcggaaagttcggcaaaaagcatatgatcgctggggttttctttaccttcgtgctactgctctccggacagatcacgtggcgggatatggcccacactctgattatgatcggcagtaatgcaagcgacagaatgggtatgggggtcacctaccttgccttgattgctacatttaaaatacagcccttcctggcgttaggatttttcctcaggaagctgacctctcgcgaaaaccttctgctaggcgtgggcctcgccatggcaactacactgcaattgccggaggatatcgaacagatggctaatgggattgccctgggattaatggccctcaaactgatcacccagtttgagacatatcagctttggactgctctgatttccttgacctgttcaaacacgatcttcacactcaccgttgcatggcgaactgccaccctgatactagcgggtgtgagtctgcttcctgtctgccaaagctcgtccatgcggaagtctgactggctcccaatgacagtagctgccatgggcgtgccccctctgcccttgtttatcttcagcctgaaggatactttaaaacgtagatcatggccactcaatgagggggttatggcagtgggactggtcagtattcttgcctcctctctgttgaggaacgacgtgcctatggctggccccctcgtagcaggtgggctgctaatcgcctgttacgtgattaccggaacgagcgcggatctgacagtcgaaaaggctgccgacgttacctgggaggaagaggcagaacagactggcgtgtcccataaccttatgatcacagtggacgatgacggcaccatgcgcataaaagatgacgagactgagaatattctcacagtcctgttgaagaccgccttactgatcgtgtcagggatctttccatacagcattccggctacgctcctggtttggcacacttggcagaaacagacccggagaagtggagtactttgggatgtgccttctcccccagaaacacaaaaggccgagctggaagagggtgtctataggataaaacagcagggcatcttcgggaagacccaggtgggagttggcgtgcaaaaggagggtgtctttcatacaatgtggcacgtgactcgaggggcagtattgacctacaacggaaaacgcctagaacccaattgggcttccgtcaagaaagacctgattagctatggcggcgggtggcggctctcggcccagtggcagaagggagaggaagtgcaagttatcgcggtggagcctggtaaaaacccaaagaatttccagacgatgcccggcacattccagactaccacaggggaaattggagccgtcgcactggattttaagcctggcacctcaggttctccgatcataaacagagaggggaaagtggttggactttacggcaatggcgtggtcactaagaacgggggatatgtgagtggtatcgctcagaccaatgccgagccagacggccccacacctgaattagaggaagagatgttcaaaaagaggaacctgacgattatggatctccacccagggtccggaaaaactcgtaagtacttgcccgctatcgtacgcgaagcaattaagcggagactgaggaccctcatcctggcccctacacgagtggttgccgctgagatggaggaagcgcttaaaggcctgccgatacggtatcaaaccactgcaacaaagagcgagcataccggtcgcgaaattgtcgacttgatgtgccacgccacgtttactatgagactactgtctcccgtgagggtgccaaattacaacctcatcatcatggatgaggctcatttcacagaccctgccagcattgcagcccgggggtacatctccacccgagtcggaatgggcgaagctgcggccatatttatgaccgcaactcccccaggcacagctgatgccttccctcagtcaaatgcacccattcaggacgaggagagagacatcccagaacgcagttggaacagcgggaatgagtggattaccgattttgccggaaaaacagtatggttcgtgccgtctatcaaggctggtaacgacatagccaactgtttaaggaaaaatggcaagaaggttattcagctgtcccgtaaaacttttgatacggaatatcaaaagaccaaacttaacgactgggatttcgtggtcacaactgacatctcagagatgggggcgaattttaaggcagatcgggtgatcgaccctagaaggtgcctgaaacccgttattctcaccgatggaccagagcgcgtgatcttggccggccccatgcctgtcacagctgccagtgctgcacagcgaagaggtcgggtggggaggaacccacagaaggaaaatgaccagtacattttcaccggccaacccctgaacaatgatgaggaccacgcccattggactgaagctaagatgctcctggacaacataaatacgcctgagggaatcattccggcccttttcgaaccagagcgcgagaaaagcgcagcgatcgatggcgaatatcgtctaaagggggagtccagaaaaacctttgtagaactgatgcggaggggagacttgcccgtgtggttagcccacaaggttgcttctgagggtatcaaatacacagatcgcaagtggtgcttcgacggccagcgaaacaatcagattctggaagagaacatggatgtcgagatatggactaaagaaggggagaagaagaaactcagacctcggtggctggacgccaggacctattcggatccccttgcactgaaggaatttaaagacttcgctgccggacgcaagagcatcgcactcgatttggtgacagagattggcagagtgccatcacacctggcccataggacccggaatgctctagacaacctggtcatgctccacacttccgaacatggtgggaaagcgtaccgtcacgccgttgaggagcttcctgaaacaatggagacgctgttattgctgggcctcatgatcctgcttaccggaggcgcaatgctgtttctcattagtgggaagggaatcggtaagacttctataggcttgatctgtgtgattgctagctccgggatgctgtggatggccgaaatccccttacagtggattgcctcagcaatcgtactagagttctttatgatggtgctgctcataccagagcctgaaaaacaacgcacaccgcaggataatcagcttgcttatgtcgtgattggaatcctgaccttggccgcgattatcgctgccaacgagatgggcctgctcgaaaccacaaagcgagacctgggtatgtctaaagagcccggggttgtgagcccaactagttaccttgatgtcgacctccaccctgcatccgcctggacgctgtacgctgtagcaaccacagtgataactcccatgttgagacataccatcgaaaatagcacagccaacgtttctctggcggctattgccaaccaagcagtggtcttaatgggcctagacaagggatggccaatctcaaaaatggatctgggcgtgcctctccttgccctggggtgctattcccaggtcaatcccttgaccctgactgctgccgtgctcctgcttattacgcactacgcaatcataggaccgggcttacaggctaaggccacaagggaggcgcagaagcggaccgccgcaggtattatgaaaaacccaactgttgacgggatcatgaccatcgatctggaccctgtgatttatgatagtaagttcgagaaacaactcggacaggtaatgttgctggtgctatgtgctgtccagctgctccttatgcgcacaagctgggccctgtgcgaagcattgactctggctaccggccccatcacaacgctctgggagggttcgccaggcaagttttggaataccactatagccgtttctatggccaacattttcagagggtcctacctggcgggagctggcttagcatttagcatcatgaaatcagtggggacaggaaagaggggcaccggtagtcagggggaaactcttggagagaagtggaaaaagaaactgaatcaactctctcggaaggaattcgacctatataaaaagtccggcattacagaggtcgatcgaaccgaggccaaagaaggtctgaagagaggcgagatcacgcatcacgctgtgagccgcgggtcagccaagttgcagtggtttgtagaaaggaacatggtgatacccgagggacgggttatcgacctgggctgtgggcgtggaggctggagttactattgcgcaggtctcaaaaaggtgaccgaagtcagagggtacacaaaaggaggccctggccatgaggagccggtgcccatgagcacttacgggtggaatattgtcaagcttatgtccggaaaagatgtgttctatctgccacctgaaaagtgtgacaccttgctgtgcgatatcggtgagtctagcccctcccctacagttgaagagtcaaggactattcgcgtactcaagatggtggagccatggttaaaaaacaatcagttctgtatcaaggtcctgaacccctacatgcctaccgtgattgaacaccttgagcggctgcagcgaaaacacggcgggatgctagttagaaatccactctctaggaacagtacacatgaaatgtattggatctcgaatggaaccggcaacatagtggccagcgtcaatatggtgtcccgcctgttgctgaaccggtttactatgacgcacagacgtcccacaattgagaaggacgtagatctcggtgctgggaccaggcatgtgaacgcggaaccggagactcctaatatggacgttatcggagagcggatcaaacgcattaaggaagagcacaactctacctggcactacgacgatgaaaatccatataagacatgggcctaccatggctcatatgaggtcaaagcaacgggcagcgcttccagtatgataaacggggtggtgaagcttctgaccaaaccctgggacgtcgttcctatggtgactcaaatggccatgacagataccactccattcggacagcagcgagtatttaaggaaaaagtggacacaagaacccccaggtctatgccgggtacacggcgcgtcatgggcatcactgcagagtggttatggagaaccctggggaggaataagaagcctcgattgtgcacgcgggaggaattcaccaaaaaggtgcgtacaaacgccgctatgggagccgtttttactgaggaaaatcaatgggatagcgcgaaagcagccgtggaggacgaagatttctggaagctcgtcgacagagagcgcgagctgcacaaactaggcaagtgtggttcatgcgtgtacaacatgatggggaaaagggaaaagaagcttggagagtttggcaaagctaagggctcccgggccatttggtacatgtggctgggggcaagatatctcgaattcgaggctctgggatttttgaatgaggatcattggttcagtcgcgaaaacagctactctggtgtagagggcgaagggctgcacaaactcggatatatccttagggacatttccaagatccccggcggtgccatgtacgctgatgacaccgccgggtgggacacacgaataactgaggatgacctgcataatgaagagaaaatcacccagcagatggatccagagcaccggcagttagcaaacgcgatttttaagctgacgtatcaaaataaggttgtgaaagtccagagacctacacccaccggaactgtgatggacatcatttcaaggaaggatcagcgcggcagcggccaggtggggacatacggattgaacaccttcactaatatggaagcccaactcatccgtcagatggagggtgaaggcgtcctgtcgaaagctgacctagagaacccacacctttctgaaaagaaaataacccagtggctggagacaaagggggttgagcggctcaagagaatggccattagtggagatgactgcgtggtaaaacccatcgatgacaggtttgcaaacgctctgttggccttaaatgatatgggcaaggtgcgcaaagacatccctcagtggcaaccatccaagggttggcatgattggcagcaggtcccgttctgtagccaccatttccacgaactgattatgaaagacgggcgaaagctcgtggttccctgccggcctcaggacgagcttataggaagagcaaggatctcacaaggcgccggctggtccctgcgcgaaacggcgtgtctagggaaggcttatgcccagatgtggtctctgatgtactttcacagacgggatctcaggttggcaagcaacgccatttgcagtgctgtgccagtccattgggtgcccacctcccgtactacatggagcatccacgcccatcaccagtggatgaccactgaggacatgctgacagtatggaatcgagtttggattgaagataacccttggatggaggacaaaaccccagtgacgacatgggagaatgtcccctaccttggaaagcgcgaagatcaatggtgtggttctctgatcggcctcacctcaagagcaacttgggctcagaacatacctaccgccatccagcaggtgcggagtttaattgggaatgaggaattcctggactatatgccgtccatgaaaaggtttcgcaaggaggaggaaagcgagggagttatctggtga

SEQ ID NO: 15428 - RNA, 9873 nt, synthetic construct
  misc_feature 1..9873: note = derived and/or modified CDS sequence (opt3) from DENV-3__FJ182004__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgtcaatgagttttagctgcattgccataggaatcattacactgtatttaggcgcagtggttcaggccgacaccggttgtgtcatcaattggaaagggaaggagctgaagtgcggatccggcattttcgtgactaacgaggtgcatacatggaccgaacagtacaaatttcaagctgattctcccaagcggctagccactgcaatcgctggtgcctgggagaatggcgtctgtgggatacgaagcaccacacgcatggaaaacctcctgtggaaacaggttgcgaatgagcttaactatatcttgtgggaaaataacattaagctgacggtggtggtaggagacatcattggcgtcctcgagcaggggaaaagaaccctgactccacagcctatggagttaaagtactcatggaaaacatggggaaaggccaagatcgtgaccgctgaaacacaaaacagttccttcataattgatggccccaatactccagagtgccccagcgcatctagggcctggaacgtttgggaagtggaggactatggttttggggtcttcaccacgaatatctggctgaaacttcgggaagtgtacacacagttgtgtgaccaccgcctcatgtcagctgccgttaaggatgagagagcagtgcacgcggacatgggatactggattgagagtcagaaaaacggcagctggaagctggaaaaagcctccctaatcgaggtaaagacctgcacttggcctaagtctcataccctgtggtcgaatggtgtcctcgaaagcgatatgataatcccaaaatccctggctggcccgatttcacagcacaactataggcccgggtaccatacacaaactgccggaccttggcaccttggcaagttggagctggactttaattattgcgaggggaccacagtggtgatcacggaaaactgtggaacccgtggcccaagtttacggactacaaccgtctctggtaaactcattcacgagtggtgctgtcgaagctgcactctgccccctcttagatacatgggggaagatggatgttggtatggcatggagatcaggccaatatccgaaaaggaggagaatatggttaaatcactggtgagcgcaggttctggcaaggtagacaacttcacaatgggggtgttgtgcctcgctattctgtttgaagaggtcatgcgcggaaagttcggcaaaaagcatatgatcgccggggtgttctttaccttcgttctactgctctccggacagatcacgtggcgggatatggcacacactctgattatgatcggcagtaatgccagcgacagaatgggtatgggggtgacctaccttgctttgattgcgacatttaaaatacagcccttcctggccttaggatttttcctcaggaagctgacctctcgcgaaaaccttctgctaggcgtcggcctcgcaatggctactacactgcaattgccggaggatatcgaacagatggccaatgggattgccctgggattaatggctctcaaactgatcacccagtttgagacatatcagctttggactgcactgatttccttgacctgttcaaacacgatcttcacactcaccgtggcctggcgaactgcgaccctgatactagctggtgttagtctgcttcctgtgtgccaaagctcgtccatgcggaagtctgactggctcccaatgacagtcgccgcaatgggcgtaccccctctgcccttgtttatcttcagcctgaaggatactttaaaacgtagatcatggccactcaatgagggggtgatggccgttggactggtgagtattcttgcttcctctctgttgaggaacgacgtccctatggcaggccccctcgtggccggtgggctgctaatcgcgtgttacgtaattaccggaacgagcgctgatctgacagtggaaaaggccgcagacgtcacctgggaggaagaggccgaacagactggcgtttcccataaccttatgatcacagtggacgatgacggcaccatgcgcataaaagatgacgagactgagaatattctcacagtgctgttgaagaccgctttactgatcgtctcagggatctttccatacagcattccggccacgctcctggtgtggcacacttggcagaaacagacccggagaagtggagttctttgggatgtaccttctcccccagaaacacaaaaggcagagctggaagagggtgtgtataggataaaacagcagggcatcttcgggaagacccaggtcggagtgggcgttcaaaaggagggtgtgtttcatacaatgtggcacgtcactcgaggggctgtgttgacctacaacggaaaacgcctagaacccaattgggcctccgtaaagaaagacctgattagctatggcggcgggtggcggctctcggcgcagtggcagaagggagaggaagtccaagtgatcgccgttgagcctggtaaaaacccaaagaatttccagacgatgcccggcacattccagactaccacaggggaaattggagcaatcgctctggattttaagcctggcacctcaggttctccgataatcaacagagaggggaaagtggtcggactttacggcaatggcgtggttactaagaacgggggatatgtgagtggtattgcccagaccaatgctgagccagacggccccacacctgaattagaggaagagatgttcaaaaagaggaacctgacgatcatggatctccacccagggtccggaaaaactcgtaagtacttgcccgcaattgtccgcgaagccatcaagcggagactgaggaccctcatactggcccctacacgagtggtagctgcggagatggaggaagcacttaaaggcctgccgattcggtatcaaaccactgccacaaagagcgagcataccggtcgcgaaatcgtggacttgatgtgccacgctacgtttactatgagactactgtctcccgttagggtcccaaattacaacctcatcattatggatgaggcccatttcacagaccctgcaagcatcgccgctcgggggtacatatccacccgagtgggaatgggcgaagcggccgcaatttttatgaccgctactcccccaggcacagccgatgcattccctcagtcaaatgcccccatccaggacgaggagagagacattccagaacgcagttggaacagcgggaatgagtggatcaccgattttgctggaaaaacagtgtggttcgtcccgtctataaaggccggtaacgacattgcgaactgtttaaggaaaaatggcaagaaggtaatccagctgtcccgtaaaacttttgatacggaatatcaaaagaccaaacttaacgactgggatttcgtggttacaactgacatctcagagatgggggcaaattttaaggccgatcgggtgattgaccctagaaggtgcctgaaacccgtcatcctcaccgatggaccagagcgcgtgattttggctggccccatgcctgttacagccgctagtgcagcccagcgaagaggtcgggtggggaggaacccacagaaggaaaatgaccagtacatattcaccggccaacccctgaacaatgatgaggaccacgctcattggactgaagccaagatgctcctggacaacatcaatacgcctgagggaattatcccggcacttttcgaaccagagcgcgagaaaagcgcggccatcgatggcgaatatcgtctaaagggggagtccagaaaaacctttgtcgaactgatgcggaggggagacttgcccgtgtggttagctcacaaggtagcctctgagggtattaaatacacagatcgcaagtggtgcttcgacggccagcgaaacaatcagatactggaagagaacatggatgtggagatctggactaaagaaggggagaagaagaaactcagacctcggtggctggacgcaaggacctattcggatccccttgctctgaaggaatttaaagacttcgccgcaggacgcaagagcattgccctcgatttggttacagagatcggcagagtcccatcacacctggctcataggacccggaatgcgctagacaacctggtgatgctccacacttccgaacatggtgggaaagcctaccgtcacgcagtggaggagcttcctgaaacaatggagacgctgttattgctgggcctcatgattctgcttaccggaggcgctatgctgtttctcatcagtgggaagggaataggtaagacttctatcggcttgatttgtgtcatcgccagctccgggatgctgtggatggccgaaattcccttacagtggatcgcatcagctatagttctagagttctttatgatggtgctgctcattccagagcctgaaaaacaacgcacaccgcaggataatcagcttgcctatgtagtgatcggaattctgaccttggcggctatcatagccgcaaacgagatgggcctgctcgaaaccacaaagcgagacctgggtatgtctaaagagcccggggtcgtgagcccaactagttaccttgatgttgacctccaccctgcctccgcttggacgctgtacgcagtggccaccacagtcatcactcccatgttgagacataccattgaaaatagcacagcgaacgtatctctggctgccatcgcaaaccaagccgtggttttaatgggcctagacaagggatggccaatttcaaaaatggatctgggcgtgcctctccttgctctggggtgctattcccaggtcaatcccttgaccctgactgccgcagtgctcctgcttatcacgcactacgctataattggaccgggcttacaggccaaggcgacaagggaggcccagaagcggaccgcagctggtatcatgaaaaacccaactgtcgacgggatcatgaccattgatctggaccctgtgatctatgatagtaagttcgagaaacaactcggacaggttatgttgctggtgctatgtgccgtacagctgctccttatgcgcacaagctgggcactgtgcgaagctttgactctggccaccggccccataacaacgctctgggagggttcgccaggcaagttttggaataccactattgccgtgtctatggcgaacatcttcagagggtcctacctggctggagcaggcttagcctttagcattatgaaatcagtcgggacaggaaagaggggcaccggtagtcagggggaaactcttggagagaagtggaaaaagaaactgaatcaactctctcggaaggaattcgacctatataaaaagtccggcatcacagaggttgatcgaaccgaggctaaagaaggtctgaagagaggcgagataacgcatcacgccgtgagccgcgggtcagcaaagttgcagtggtttgtcgaaaggaacatggtgatccccgagggacgggtaattgacctgggctgtgggcgtggaggctggagttactattgcgccggtctcaaaaaggtgaccgaagttagagggtacacaaaaggaggccctggccatgaggagccggtgcccatgagcacttacgggtggaatatcgtcaagcttatgtccggaaaagatgtgttctatctgccacctgaaaagtgtgacaccttgctgtgcgatattggtgagtctagcccctcccctacagtcgaagagtcaaggactatccgcgtgctcaagatggttgagccatggttaaaaaacaatcagttctgtattaaggtactgaacccctacatgcctaccgtgatcgaacaccttgagcggctgcagcgaaaacacggcgggatgctagtcagaaatccactctctaggaacagtacacatgaaatgtattggatatcgaatggaaccggcaacattgtggctagcgttaatatggtgtcccgcctgttgctgaaccggtttactatgacgcacagacgtcccacaatcgagaaggacgtcgatctcggtgcggggaccaggcatgtgaacgccgaaccggagactcctaatatggacgtaatcggagagcggattaaacgcataaaggaagagcacaactctacctggcactacgacgatgaaaatccatataagacatgggcataccatggctcatatgaggtgaaagctacgggcagcgcctccagtatgatcaacggggttgtcaagcttctgaccaaaccctgggacgtggtgcctatggtcactcaaatggcaatgacagataccactccattcggacagcagcgagtttttaaggaaaaagtggacacaagaacccccaggtctatgccgggtacacggcgcgtaatgggcattactgccgagtggttatggagaaccctggggaggaataagaagcctcgattgtgcacgcgggaggaattcaccaaaaaggtgcgtacaaacgctgccatgggagcggtctttactgaggaaaatcaatgggatagcgcaaaagccgctgtggaggacgaagatttctggaagctcgttgacagagagcgcgagctgcacaaactaggcaagtgtggttcatgcgtgtacaacatgatggggaaaagggaaaagaagcttggagagtttggcaaagccaagggctcccgggcaatctggtacatgtggctgggggctagatatctcgaattcgaggccctgggatttttgaatgaggatcattggttcagtcgcgaaaacagctactctggtgtcgagggcgaagggctgcacaaactcggatatattcttagggacatctccaagatacccggcggtgctatgtacgccgatgacaccgcagggtgggacacacgaatcactgaggatgacctgcataatgaagagaaaattacccagcagatggatccagagcaccggcagttagcgaacgccatctttaagctgacgtatcaaaataaggtggtaaaagttcagagacctacacccaccggaactgtgatggacattatctcaaggaaggatcagcgcggcagcggccaggtcgggacatacggattgaacaccttcactaatatggaagctcaactcatacgtcagatggagggtgaaggcgtgctgaccaaagccgacctagagaacccacacctttcggaaaagaaaattacacagtggctggagacgaagggggtggagcggctcaagagaatggcaatctctggagatgactgcgtcgttaaacccatcgatgacaggtttgctaacgccctgttggcattaaatgatatgggcaaggtgcgcaaagacattcctcagtggcaaccaagtaagggttggcatgattggcagcaggtaccgttctgttcccaccatttccacgaactgataatgaaagacgggcgaaagctcgtggtcccctgccggcctcaggacgagcttatcggaagagccaggattagccaaggcgcgggctggtcactgcgcgaaaccgcttgtctagggaaggcctatgcacagatgtggtccctgatgtactttcacagacgggatctcaggttggcctctaacgctatctgcagcgccgtgccagttcattgggtgcccactagtcgtacaacctggtccattcacgcacatcaccagtggatgactacagaggacatgctgaccgtctggaatcgagtgtggatcgaagataacccttggatggaggacaaaacgccagtaacaacctgggagaatgttccctaccttggaaagcgcgaagatcaatggtgtggtagcctgataggcctcacttctagagctacctgggcccagaacatccctacagcgattcagcaggtgcggtcattaatcgggaatgaggaattcctggactatatgccgagtatgaaaaggtttcgcaaggaggaggaatccgagggagctatttggtga

SEQ ID NO: 15429 - RNA, 9873 nt, synthetic construct
  misc_feature 1..9873: note = derived and/or modified CDS sequence (opt3) from DENV-3__FJ024465__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacaccggttgtgtgatcaattggaaagggaaggagctgaagtgcggatccggcattttcgtgactaacgaggtccatacatggaccgaacagtacaaatttcaagccgattctcccaagcggctagctactgccatcgcaggtgcttgggagaatggcgtttgtgggatacgaagcaccacacgcatggaaaacctcctgtggaaacagatcgccaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggcgaagatagtgaccgccgaaacacaaaacagttccttcattatcgatggccccaatactccagagtgccccagcgcttctagggcatggaacgtttgggaagtggaggactatggttttggggtcttcaccacgaatatttggctgaaacttcgggaagtgtacacacagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacctgcacttggcctaagtctcataccctgtggtcgaatggtgtcctcgaaagcgatatgatcattccaaaatccctggccggcccgatctcacagcacaactataggcccgggtaccatacacaaactgctggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgccggttctggcaaggtagacaacttcacaatgggggtgttgtgcctcgcaatcctgtttgaagaggtcatgcgcggaaagttcggcaaaaagcatatgatcgctggggtgttctttaccttcgttctactgctctccggacagattacgtggcgggatatggcccacactctgatcatgattggcagtaatgcaagcgacagaatgggtatgggggtgacctaccttgccttgatagctacatttaaaatccagcccttcctggcgttaggatttttcctcaggaagctgacctctcgcgaaaaccttctgctaggcgtcggcctcgccatggcaactacactgcaattgccggaggatattgaacagatggctaatgggatcgccctgggattaatggccctcaaactgattacccagtttgagacatatcagctttggactgctctgatctccttgacctgttcaaacacgatattcacactcaccgtggcatggcgaactgccaccctgatcctagcgggtgttagtctgcttcctgtgtgccaaagctcgtccatgcggaagtctgactggctcccaatgacagtcgctgccatgggcgtaccccctctgcccttgtttattttcagcctgaaggatactttaaaacgtagatcatggccactcaatgagggggtgatggcagttggactggtgagtatccttgcctcctctctgttgaggaacgacgtccctatggctggccccctcgtggcaggtgggctgctaattgcctgttacgtaatcaccggaacgagcgcggatctggctgtggaaaaggccgcagacgtcacatgggaggaagaggccgaacagaccggcgtttcccataaccttatgataactgtggacgatgacggcacaatgcgcattaaagatgacgagaccgagaatatcctcactgtgctgttgaagacagctttactgatcgtctcagggatttttccatacagcataccggccaccctcctggtgtggcacacgtggcagaaacagactcaacggagtggagttctttgggatgtaccttctcccccagaaacccagaaggcagagctggaagagggtgtgtatagaatcaaacagcagggcattttcgggaagacacaagtcggagtgggcgttcagaaggagggtgtgtttcataccatgtggcacgtcacaaggggggctgtgttgacttacaacggaaaacgactagaacccaattgggcctccgtaaagaaagacctgatcagctatggcggcgggtggcgcctctcggcgcagtggcaaaagggagaggaagtccaggtgattgccgttgagcctggtaaaaacccaaagaatttccagaccatgcccggcacgttccagacaactaccggggaaatcggagcaatagctctggattttaagcctggcacatcaggttctccgatcattaaccgggaggggaaagtggtcggactttacggcaatggcgtggttaccaagaacgggggatatgtgagtggtatcgcccaaactaatgctgagccagacggccccacccctgaattagaggaagagatgttcaaaaagagaaacctgacaattatggatctccacccagggtccggaaaaacgaggaagtacttgcccgcaatcgtccgtgaagccataaagcgccggctgagaactctcattctggcccctaccagggtggtagctgcggagatggaggaagcacttaaaggcctgccgatccgatatcagacaaccgccactaagagcgagcatacaggtcgggaaatcgtggacttgatgtgccacgctacctttacgatgcgcctactgtctcccgttagagtcccaaattacaacctcattatcatggatgaggcccatttcactgaccctgcaagcatagccgctagggggtacatttccacacgggtgggaatgggcgaagcggccgcaatctttatgaccgctacccccccaggcactgccgatgcattccctcagtcaaatgcccccattcaggacgaggagcgagacatcccagaaagaagttggaacagcgggaatgagtggataacagattttgctggaaaaaccgtgtggttcgtcccgtctattaaggccggtaacgacatcgcgaactgtttacgcaaaaatggcaagaaggtaatccaactgtccaggaaaacatttgatactgaatatcagaagacgaaacttaacgactgggatttcgtggttaccacagacatttcagagatgggggcaaattttaaggccgatcgtgtgatcgaccctcggagatgcctgaaacccgtcattctcactgatggaccagagagggtgatattggctggccccatgcctgttaccgccgctagtgcagcccagcgccgaggtagagtggggcggaacccacagaaggaaaatgaccaatacatcttcacaggccagcccctgaacaatgatgaggaccacgctcattggaccgaagccaagatgctcctggacaacattaatactcctgagggaatcatcccggcacttttcgaaccagagagggagaaaagcgcggccattgatggcgaatatcgcctaaagggggagtcccgtaaaacgtttgtcgaactgatgagacggggagacttgcccgtgtggttagctcacaaggtagcctctgagggtataaaatacaccgataggaagtggtgcttcgacggccagcgcaacaatcagatcctggaagagaacatggatgtggagatttggacaaaagaaggggagaagaagaaactccgacctagatggctggacgcacggacttattcggatccccttgctctgaaggaatttaaagacttcgccgcaggaaggaagagcatcgccctcgatttggttaccgagattggccgcgtcccatcacacctggctcatagaacaaggaatgcgctagacaacctggtgatgctccacacctccgaacatggtgggaaagcctaccggcacgcagtggaggagcttcctgaaactatggagacactgttattgctgggcctcatgatcctgcttacgggaggcgctatgctgtttctcataagtgggaagggaatcggtaagacctctattggcttgatctgtgtcattgccagctccgggatgctgtggatggccgaaatccccttacaatggatagcatcagctattgttctagagttctttatgatggtgctgctcatcccagagcctgaaaaacagcgtactccgcaggataatcaacttgcctatgtagtgattggaatcctgacattggcggctataatcgccgcaaacgagatgggcctgctcgaaaccaccaagcgcgacctgggtatgtctaaagagcccggggtcgtgagcccaacaagttaccttgatgttgacctccaccctgcctccgcttggactctgtacgcagtggccacgaccgtcattacacccatgttgcgacatactatcgaaaatagcaccgcgaacgtatctctggctgccattgcaaaccaggccgtggttttaatgggcctagacaagggatggccaatctcaaaaatggatctgggcgtgcctctccttgctctggggtgctattcccaggtcaatcccttgacactgaccgccgcagtgctcctgcttataactcactacgctattatcggaccgggcttacaggccaaggcgacgagagaggcccaaaagaggacagcagctggtatcatgaaaaacccaaccgtcgacgggattatgactatcgatctggaccctgtgatatatgatagtaagttcgagaaacagctcggacaggttatgttgctggtgctatgtgccgtacagctgctccttatgcggaccagctgggcactgtgcgaagctttgacactggccactggccccattaccacactctgggagggttcgccaggcaagttttggaatacgaccatcgccgtgtctatggcgaacattttccgcgggtcctacctggctggagcaggcttagcctttagcatcatgaaatcagtcgggactggaaagagaggcacaggtagtcaaggggaaacccttggagagaagtggaaaaagaaactgaatcagctctctaggaaggaattcgacctatataaaaagtccggcataactgaggttgatcggacagaggctaaagaaggtctgaagcgaggcgagatcacccatcacgccgtgagcagagggtcagcaaagttgcagtggtttgtcgaacgcaacatggtgattcccgagggaagggtaatcgacctgggctgtgggcggggaggctggagttactattgcgccggtctcaaaaaggtgacggaagttcgtgggtacaccaaaggaggccctggccatgaggagccggtgcccatgagcacatacgggtggaatattgtcaagcttatgtccggaaaagatgtgttctatctgccacctgaaaagtgtgacactttgctgtgcgatatcggtgagtctagcccctcccctaccgtcgaagagtcaagaacaattagggtgctcaagatggttgagccatggttaaaaaacaatcagttctgtatcaaggtactgaacccctacatgcctactgtgatagaacaccttgagcgcctgcaacggaaacacggcgggatgctagtccgaaatccactctctagaaacagtacccatgaaatgtattggatttcgaatggaacaggcaacatcgtggctagcgttaatatggtgtccaggctgttgctgaaccgctttaccatgactcaccggagacccacgatcgagaaggacgtcgatctcggtgcggggacacgtcatgtgaacgccgaaccggagacccctaatatggacgtaattggagagaggataaaacggatcaaggaagagcacaactctacttggcactacgacgatgaaaatccatataagacctgggcataccatggctcatatgaggtgaaagctacaggcagcgcctccagtatgattaacggggttgtcaagcttctgacgaaaccctgggacgtggtgcctaccgtcactcagatggcaatgacagataccactccattcggacagcaacgcgtttttaaggaaaaagtggacacacgaacccccagatctatgccgggtacaaggcgggtaatgggcatcactgccgagtggttatggcgcaccctggggagaaataagaagcctaggttgtgcacgcgagaggaattcaccaaaaaggtgcggacaaacgctgccatgggagcggtctttactgaggaaaatcagtgggatagcgcaaaagccgctgtggaggacgaagatttctggaagctcgttgaccgtgagagagagctgcacaaactaggcaagtgtggttcatgcgtgtacaacatgatggggaaacgcgaaaagaagcttggagagtttggcaaagccaagggctccagggcaatttggtacatgtggctgggggctcggtatctcgaattcgaggccctgggatttttgaatgaggatcattggttcagtagagaaaacagctactctggtgtcgagggcgaagggctgcacaaactcggatatatccttcgcgacatatccaagatccccggcggtgctatgtacgccgatgacaccgcagggtgggacacaaggattactgaggatgacctgcataatgaagagaaaatcacccagcagatggatccagagcaccgacaattagcgaacgccatttttaagctgacgtatcagaataaggtggtaaaagttcagcggcctacacccaccggaactgtgatggacatcatatcaagaaaggatcagaggggcagcggccaagtcgggacatacggattgaacaccttcactaatatggaagctcagctcattcgccagatggagggtgaaggcgtgctgtcgaaagccgacctagagaactctcaccttagtgaaaagaaaatcacccagtggctggagacaaagggggtggagcgtctcaagcggatggcaatctccggagatgactgcgtcgttaaaccaattgatgacagatttgctaacgccctgttggcattaaatgatatgggcaaggtgaggaaagacataccccaatggcagcctagcaagggttggcatgattggcagcaggtaccattctgttcacaccatttccacgaactgatcatgaaagacgggcgcaagctcgtggtcccgtgccgaccccaagacgagcttattggacgggccagaatctcccagggcgcgggctggtctctgagggaaacggcttgtctagggaaggcctatgcacagatgtggagcctgatgtactttcaccgcagagatctccggttggccagtaacgctatttgctccgccgtgcctgttcattgggtgccaaccagcaggactacatggtctatccacgcacatcaccaatggatgaccactgaggacatgctgacagtctggaatcgtgtgtggatagaagataacccctggatggaggacaaaacccctgtaacgacatgggagaatgttccataccttggaaagcgagaagatcagtggtgtggttcactgatcggcctcaccagtcgcgctacttgggcccagaacattcccaccgcgatccagcaagtgagatccttaattgggaatgaggaattcctggactatatgcctagcatgaaacggtttaggaaggaggaggaatctgagggagctatctggtga

SEQ ID NO: 15430 - RNA, 9873 nt, synthetic construct
  misc_feature 1..9873: note = derived and/or modified CDS sequence (opt3) from DENV-3__FJ024466__SS-prME
  source 1..9873: mol_type = other RNA
accagcctgtgcctcatgatgatccttcccgccgctctggcattccacttgacttccagagacggcgagcctaggatgattgtggggaagaacgaacggggaaaatctttactgtttaagactgcctcaggtataaatatgtgtacgctaatcgcgatggatctcggcgagatgtgcgacgataccgtcacttacaaatgtccacatattgctgaagttgagccggaagacatcgattgctggtgtaacctgacaagtacctgggtgacctatgggacctgcaatcaggccggagagcaccgccgagacaagcgtagcgtcgcacttgccccacatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcaaaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgtcaatgagttttagctgcattgccataggaatcattacactgtatttaggcgcagtggttcaggccgacaccggttgtgtcatcaattggaaagggaaggagctgaagtgcggatccggcattttcgtgactaacgaggtgcatacatggaccgaacagtaccggtttcaagctgattctcccaaacgactagccactgcaatcgctggtgcctgggagaatggcgtctgtgggatacgcagcaccacaagaatggaaaacctcctgtggaagcagatcgcgaatgagcttaactatattttgtgggaaaataacatcaaactgacggttgtggtgggagacattatcggcgtactcgagcaggggaagaggaccctgactccacagcctatggagttaaaatactcatggaagacatggggaaaagccaagatagtcaccgctgaaacacaaaacagttccttcattatcgatggccccaatactccagagtgccccagcgcatctcgggcctggaacgtgtgggaagttgaggactatggttttggggtgttcaccacgaatatttggctgaaacttcgcgaagtctacacacagttgtgtgaccacagactcatgtcagctgccgtgaaagatgagagggcagttcacgcggacatgggatactggatcgagagtcagaagaacggcagctggaaactggaaaaggcctccctaatagaggtgaaaacctgcacttggcctaagtctcataccctgtggtcgaatggtgtactcgaaagcgatatgatcattccaaagtccctggctggcccgatctcacagcacaactatcgtcccgggtaccatacacaaactgccggaccttggcaccttggcaaattggagctggactttaattattgcgaggggaccacagtcgtgattacggataactgtggaacccggggcccaagtttacgaactacaaccgtgtctggtaagctcatccacgaatggtgctgtagaagctgcactctgccccctcttaggtacatgggggaggacggatgttggtatggcatggaaatacgcccaatttccgagaaagaagagaatatggtcaagtcactggttagcgcaggttctggcaaagtggataacttcacaatgggggtattgtgcctcgctatcctgtttgaggaagtgatgcggggaaagttcggcaagaaacatatgatcgccggggtcttctttaccttcgtgctactgctctccggacagattacgtggagagacatggcacacactctgatcatgattggcagtaatgccagcgataggatgggtatgggggttacctaccttgctttgatagcgacatttaagatccagcccttcctggccttaggatttttcctccgcaaactgacctctcgagagaaccttctgctaggcgtgggcctcgcaatggctactacactgcaattgccggaagacattgagcagatggccaatgggatcgccctgggattaatggctctcaagctgattacccagtttgaaacatatcagctttggactgcactgatctccttgacctgttcaaacacgatattcacactcaccgtcgcctggcggactgcgaccctgatcctagctggtgtgagtctgcttcctgtttgccaaagctcgtccatgcgtaaatctgattggctcccaatgacagtggccgcaatgggcgtaccccctctgcccttgtttattttcagcctgaaggacactttaaagagaaggtcatggccactcaatgagggggtaatggccgtgggactggttagtatccttgcttcctctctgttgcgcaacgatgtgcctatggcaggccccctcgtcgccggtgggctgctaattgcgtgttacgtgatcaccggaacgagcgctgacctgacagtagagaaagccgcagacgtgacctgggaagaggaagccgagcagactggcgtctcccataaccttatgataacagttgatgacgatggcaccatgcggattaaggacgatgaaactgagaatatcctcacagtgctgttgaaaaccgctttactgatcgtgtcagggatttttccatacagcataccggccacgctcctggtctggcacacttggcagaagcagaccagaaggagtggagtgctttgggacgttccttctcccccagagacacaaaaagcagaactggaggaaggtgtatatcgaatcaagcagcagggcattttcgggaaaacccaggtgggagtcggcgtgcaaaaggagggtgtttttcatacaatgtggcacgtgactcgcggggctgtcttgacctacaacggaaagcggctagagcccaattgggcctccgtgaaaaaggatctgatcagctatggcggcgggtggagactctcggcgcagtggcagaaaggagaagaggtacaagtcattgccgtggaacctggtaagaaccccaagaatttccagacgatgcccggcacattccagactaccacaggggagatcggagcaatagctctggactttaagcctggcacctcaggttctccgatcattaacagggaagggaaggttgtgggactttacggcaatggcgtcgtgactaaaaacgggggatatgttagtggtatcgcccagaccaatgctgagccagatggccccacacctgagttagaagaggaaatgttcaagaaacgtaacctgacgattatggacctccacccagggtccggaaagactcgcaaatacttgcccgcaatcgtgcgggaggccataaagagaaggctgcgaaccctcattctggcccctacacgggtcgtggctgcggaaatggaggaggcacttaagggcctgccgatccgctatcaaaccactgccacaaaaagcgaacataccggtagagagatcgtagatttgatgtgccacgctacgtttactatgaggctactgtctcccgtgcgggttccaaattacaacctcattatcatggacgaagcccatttcacagatcctgcaagcatagccgctcgagggtacatttccaccagagtcggaatgggcgaggcggccgcaatctttatgaccgctactcccccaggcacagccgacgcattccctcagtcaaatgcccccattcaggacgaagaacgcgatatcccagagaggagttggaacagcgggaatgaatggataaccgactttgctggaaagacagtgtggttcgtgccgtctattaaagccggtaacgatatcgcgaactgtttacgtaagaatggcaaaaaggtcatccagctgtcccggaagacttttgacacggagtatcagaagaccaaacttaacgattgggacttcgtagtgacaactgatatttcagaaatgggggcaaattttaaagccgacagagttatcgatcctaggcgctgcctgaagcccgtgattctcaccgacggaccagagcgagtcatattggctggccccatgcctgtgacagccgctagtgcagcccagagacggggtagggttgggcgcaacccacagaaagagaatgatcagtacatcttcaccggccaacccctgaacaatgacgaagaccacgctcattggactgaggccaagatgctcctggataacattaatacgcctgaaggaatcatcccggcacttttcgagccagaacgtgaaaagagcgcggccattgacggcgagtatagactaaaaggggaatcccggaagacctttgtggagctgatgaggcgcggagatttgcccgtctggttagctcacaaagtggcctctgaaggtataaagtacacagaccgaaaatggtgcttcgatggccagagaaacaatcagatcctggaggaaaacatggacgtagagatttggactaaggagggggagaagaagaagctccggcctaggtggctggatgcacgcacctattcggacccccttgctctgaaagagtttaaggatttcgccgcaggaagaaaaagcatcgccctcgacttggtgacagaaattggcagggttccatcacacctggctcatcggacccgtaatgcgctagataacctggtcatgctccacacttccgagcatggtgggaaggcctaccgccacgcagtggaggaacttcctgagacaatggaaacgctgttattgctgggcctcatgatcctgcttaccggaggcgctatgctgtttctcataagtgggaaaggaatcggtaagacttctattggcttgatctgtgtgattgccagctccgggatgctgtggatggccgagatccccttacagtggatagcatcagctattgtcctagagttctttatgatggttctgctcatcccagagcctgagaagcaacgaacaccgcaggacaatcagcttgcctatgtggtaattggaatcctgaccttggcggctataatcgccgcaaacgaaatgggcctgctcgagaccacaaaaagagatctgggtatgtctaaggaacccggggtggtcagcccaacaagttaccttgacgtggacctccaccctgcctccgcttggacgctgtacgcagttgccaccacagtgattactcccatgttgaggcataccatcgagaatagcacagcgaacgtctctctggctgccattgcaaaccaagccgtagtgttaatgggcctagataaaggatggccaatctcaaagatggacctgggcgttcctctccttgctctggggtgctattcccaggtgaatcccttgaccctgactgccgcagtcctcctgcttataacgcactacgctattatcggaccgggcttacaggccaaagcgacacgggaagcccagaagcgcaccgcagctggtatcatgaagaacccaactgtggatgggattatgaccatcgacctggatcctgtcatatatgacagtaaattcgagaagcaactcggacaggtgatgttgctggttctatgtgccgtgcagctgctccttatgagaacaagctgggcactgtgcgaggctttgactctggccaccggccccattacaacgctctgggaaggttcgccaggcaaattttggaataccactatcgccgtatctatggcgaacattttcagggggtcctacctggctggagcaggcttagcctttagcatcatgaagtcagtggggacaggaaaacggggcaccggtagtcagggggagactcttggagaaaagtggaagaaaaagctgaatcaactctctcgaaaagagttcgatctatataagaaatccggcataacagaagtcgacagaaccgaggctaaggagggtctgaaacgcggcgaaatcacgcatcacgccgttagcagggggtcagcaaagttgcagtggtttgtggagcggaacatggtcattcccgaaggacgtgtgatcgatctgggctgtgggagaggaggctggagttactattgcgccggtctcaagaaagtaaccgaggtgagggggtacacaaagggaggccctggccatgaggaaccggttcccatgagcacttacgggtggaatattgtgaaacttatgtccggaaaggacgtcttctatctgccacctgagaaatgtgataccttgctgtgcgacatcggtgaatctagcccctcccctacagtggaggaatcacgcactattcgggtcctcaagatggtggagccatggttaaagaacaatcagttctgtatcaaagttctgaacccctacatgcctaccgtaatagagcaccttgaacgactgcagagaaagcacggcgggatgctagtgaggaatccactctctcgcaacagtacacatgagatgtattggatttcgaatggaaccggcaacatcgtcgctagcgtgaatatggtttcccggctgttgctgaacagatttactatgacgcaccgtaggcccacaatcgaaaaagatgtggacctcggtgcggggacccggcatgtcaacgccgagccggaaactcctaatatggacgtgattggagagcgcataaagcgaatcaaagaggaacacaactctacctggcactacgatgacgagaatccatataagacatgggcataccatggctcatatgaagtaaaggctacgggcagcgcctccagtatgattaacggggtggttaaacttctgaccaagccctgggatgtcgtgcctatggtgactcaaatggcaatgacagacaccactccattcggacagcagagagtctttaaagagaaggttgatacaaggacaccccggtctatgccgggtacacgcagagtgatgggcatcactgccgaatggttatggaggaccctggggcgaaataaaaagcctcggttgtgcacgcgtgaggagttcaccaagaaagtaagaacaaacgctgccatgggagcggtgtttactgaagagaatcaatgggacagcgcaaaggccgctgtcgaagatgaggacttctggaaactcgtggatcgcgaaagggagctgcacaagctaggcaaatgtggttcatgcgtttacaacatgatggggaagcgggagaagaaacttggagaatttggcaaagccaaaggctccagagcaatttggtacatgtggctgggggctcgctatctcgagttcgaagccctgggatttttgaatgaggaccattggttcagtagggagaacagctactctggtgtggaaggcgaggggctgcacaagctcggatatatccttcgagatatatccaaaatccccggcggtgctatgtacgccgacgacaccgcagggtgggatacacggattactgaagacgatctgcataatgaggaaaagatcacccaccagatggacccagagcacagacagttagcgaacgccatttttaaactgacgtatcagaataaggtcgtgaaggtacaaaggcctacacccaccggaactgttatggatatcatatcacgcaaagaccagcgtggcagcggccaggtggggacatacggattgaacaccttcactaatatggaggctcagctcattcggcaaatggaaggtgagggcgtcctgtcgaaggccgatctagaaaacccacatctttctgagaaaaagatcacccagtggctggaaacaaaaggggtggagagactcaagaggatggcaatcagtggagacgattgcgtggtcaagcccattgacgatcgctttgctaacgccctgttggcattaaatgacatgggcaaagttcgaaaggatatacctcagtggcagccatccaaaggttggcacgactggcaacaggtgccgttctgtagccatcacttccacgagctgatcatgaaggacgggcggaaactcgtagtgccctgcagacctcaggatgaacttattggaagggcccgcatctcacagggcgcgggctggtccctgagagagacggcttgtctagggaaggcctatgcacaaatgtggtctctgatgtactttcatcggagggacctccgtttggccagcaacgctatttgcagtgccgtcccagtgcactgggttcccacctcccgaactacatggagcatccatgcacaccatcagtggatgaccactgaagatatgctgacagtgtggaatcgcgtctggatagaggacaacccttggatggaagataagaccccagtgacgacatgggagaatgtaccctaccttggaaaaagagaggaccagtggtgtggttctctgatcggcctcacctcacgggctacttgggcccaaaacattcctaccgcgatccagcaggttaggagtttaattgggaatgaagagttcctggattatatgccgtccatgaagcgctttagaaaagaagaggagagcgaaggagctatctggtga

SEQ ID NO: 15431 - RNA, 9873 nt, synthetic construct
  misc_feature 1..9873: note = derived and/or modified CDS sequence (opt3) from DENV-3__FJ024467__SS-prME
  source 1..9873: mol_type = other RNA
accagcctgtgcctcatgatggtgcttcccgccgctctggcattccacttgacatccagagacggcgagcctaggatgatcgtcgggaagaacgaacggggaaaatctttactgtttaagactgcctcaggtattaatatgtgtacgctaatagcgatggatctcggcgagatgtgcgacgataccgttacatacaaatgtccacatatcactgaagtggagccggaagacattgattgctggtgtaacctgaccagtacatgggtaacctatgggacttgcaatcaggctggagagcaccgccgagacaagcgtagcgtggcccttgcaccccatgtcggcatgggtctggatacaagaacccaaacgtggatgtccgccgagggggcttggaggcaggtggaaaaagttgagacttgggcattgcggcaccctggattcaccatcctcgccctgtttctggctcattacattggcacatctctcactcagaaggtggtcatcttcatattactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatcgagctccagaagaccgaagcaactcaactggccacacttaggaaactgtgtattgagggaaagatcaccaacattacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgctccctgtaaaattcctttctccacagaggacggccaaggtaaggcgcataacgggcgtcttatcactgcaaatccagtggtaaccaaaaaggaggaacccgtcaacatagaggccgaaccgcctttcggcgagtcaaatattgtgatcggaatcggcgataacgctttgaaaattaattggtataagaaggggagcagtatcggaaaaatgtttgaagccacagcacgcggtgccagaaggatggctattctgggcgacactgcctgggatttcgggtctgttggaggcgtgctcaactccctgggtaagatggtccaccagatatttgggagcgcatacaccgcgcttttctcgggcgtgtcttgggtaatgaaaatcggaattggcgtgctgttgacgtggatcgggctcaattccaagaacacatcaatgagttttagctgcatcgctattggagttataaccctgtatttaggcgccgtcgtgcaggcagacatgggttgtgtgatcaattggaaagggaaggagctgaagtgcggatccggcattttcgtcactaacgaggttcatacatggaccgaacagtacaaatttcaagccgattctcccaagcggctagctactgccatcgcaggtgcttgggagaatggcgtgtgtgggattcgaagcaccacacgcatggaaaacctcctgtggaaacagatcgccaatgagcttaactatatattgtgggaaaataacatcaagctgacggtggtagtcggagacattatcggcgtgctcgagcaggggaaaagaaccctgactccacagcctatggagttaaagtactcatggaaaacatggggaaaggcgaagattgttaccgccgaaacacaaaacagttccttcatcatagatggccccaatactccagagtgccccagcgcttctagggcatggaacgtgtgggaagtcgaggactatggttttggggtgttcaccacgaatatttggctgaaacttcgggaagtttacacacagttgtgtgaccaccgcctcatgtcagccgctgtgaaggatgagagagccgtacacgcagacatgggatactggatcgagagtcagaaaaacggcagctggaagctggaaaaagcgtccctaattgaggtcaagacctgcacttggcctaagtctcataccctgtggtcgaatggtgtgctcgaaagcgatatgatcataccaaaatccctggccggcccgatctcacagcacaaccataggcccgggtatcaaacacagactgctggaccttggcaccttggcaagttggagctggactttaattactgcgaggggaccacagtggtcattacggaaaactgtggaacccgtggcccaagtttacggactacaaccgtttctggtaaactcatccacgagtggtgctgtcgaagctgcactctgccccctcttagatatatgggggaagatggatgttggtacggcatggagattaggccaatctccgaaaaggaggagaatatggtgaaatcactggtaagcgccggttctggcaaggtggacaacttcacaatgggggtcttgtgcctcgcaatactgtttgaagagatgatgcgcggaaagttcggcaaaaagcatatgattgctggggtgttctttaccttcgttctactgctctccggacagatcacgtggcgggatatggcccacactctgatcatgattggcagtaatgcaagcgacagaatgggtatgggggtgacctatcttgccttgatcgctgcgtttaaaattcaacccttcctggccttaggatttttcctcaggaagctgacatctcgcgaaaaccttctgctaggcgtcggcctcgcaatggctaccactctgcagttgccggaggatatagaacagatggccaatgggatcgccctgggattaatggctctcaaactgattacacagtttgagacctaccaactttggacagcactgatctccttgacttgttcaaacaccatgttcacgctcacagtggcctggcgaaccgcgactctgattctagctggtgttagtctgcttcctgtgtgccagagctcgtccatgcggaagaccgactggctcccaatggccgtcgcagccatgggcgtaccccctctgcccttgtttatcttctctctgaaggatacattaaaacgtagaagctggccactcaatgagggggtgatggctgttggactggtgtcaatacttgcaagttccctgttgaggaacgacgtccctatggccggccccctcgtggcgggtgggctgctaatcgcttgttatgtaattactggaacctctgccgatctgacggtggaaaaggcagccgacatcacatgggaggaagaggctgaacagaccggcgtcagccataaccttatgattactgttgacgatgacggcacaatgcgcatcaaagatgacgagaccgagaatatactcactgtgctgttgaagacagccttactgattgtgtccggggtctttccatactcaatcccggcaaccctcctggtgtggcacacgtggcagaaacaaactcagcggagcggagttctttgggatgtacctagtcccccagaaacccagaaggctgagctggaagagggtgtgtacagaatcaaacagcaaggcattttcgggaagacacaggtcggagtgggcgttcagaaggagggtgtgtttcataccatgtggcacgtcacaaggggggccgtgttgacttataacggaaaacgactagaacccaattgggcgtctgtaaagaaagacctgatatcctacggcggcgggtggcgcctcagcgcccaatggcagaagggagaggaagtccaggtgatcgcagttgagcctggtaaaaacccaaagaatttccagaccatgcccggcacgttccaaacaactaccggggaaattggagctatcgccctggattttaagcctggcacatcgggttcaccgattatcaaccgggaggggaaagtggtcggactttatggcaatggcgtggttaccaagaacgggggatacgtgtctggtatagctcagactaatgcagagccagacggccccacccctgaattagaggaagagatgttcaaaaagagaaacctgacaatcatggatctccacccagggagtggaaaaacgaggaagtatttgcccgccattgtccgtgaagccatcaagcgccggctgagaactctcattctggctcctaccagggtggtagcggcagagatggaggaagcccttaaaggcctgccgatccgataccagacaaccgctactaagtccgagcatacaggtcgggaaatagtggacttgatgtgccacgccacctttacgatgcgcctactgagccccgttagagtcccaaattataacctcattatcatggatgaggcacatttcactgaccctgcctctatcgctgcgagggggtacattagcacacgggtgggaatgggcgaagccgcagctatctttatgaccgccacccccccaggcactgcagatgccttccctcagtccaatgctcccatacaagacgaggagaaagacattccagaacgatcatggaacagtgggaatgagtggatcacagattttgccggaaagaccgtgtggttcgtcccgagcattaaagcgggtaacgacatcgcaaactgtttaagaaagaatggcaagaaagtaatacagctgtctcgcaagacatttgatactgaataccagaaaacgaagcttaacgactgggatttcgtggttaccacagacatttccgagatgggggccaattttaaagctgatagggtgatcgaccctcgtcggtgcctgaagcccgtcatcctcactgatggaccagagagagtgattttggccggccccatgcctgttaccgctgcatcagccgctcagaggcgcggtcgagtggggagaaacccacaaaaggaaaatgaccagtatatcttcacaggccagcccctgaacaatgatgaggaccacgcccattggaccgaagcaaaaatgctcctggacaacattaatactcctgagggaataatcccggcgcttttcgaaccagagcgggagaagagtgccgctattgatggcgaatacaggctaaaaggggagagccgcaagacgtttgtcgaactgatgcgtagaggagacttgcccgtgtggttagcccacaaagtagcatccgagggtatcaagtataccgatcggaaatggtgcttcgacggccagaggaacaatcaaatcctggaagagaacatggatgtggagatttggacaaaggaaggggagaagaaaaagctccgccctcgatggctggacgctagaacttactctgatccccttgccctgaaagaatttaaggacttcgcagccggacggaaatcgatagctctcgatttggttaccgagatcggcagggtcccaagccacctggcgcatcgcacaagaaatgccctagacaacctggtgatgctccacacctcagaacatggtgggagggcatatcggcacgctgtggaggagcttcctgaaactatggagacactgttattgctgggcctcatgattctgcttacgggaggcgccatgctgtttctcatctccgggaagggaattggtaagaccagtatcggcttgatatgtgtcatcgcctctagcgggatgctgtggatggcagaaattcccttacagtggatcgcttccgccattgttctagagttctttatgatggtgctgctcatcccagagcctgaaaaacagcgtactccgcaagataatcagcttgcgtacgtagtgataggaattctgacattggctgccatcattgcagccaacgagatgggcctgctcgaaaccaccaagcgcgacctgggtatgtcaaaagagcccggggtcgtgtctccaacaagctatcttgatgttgacctccaccctgctagtgcatggactctgtacgccgtggcgacgaccgtcatcacacccatgttgcgacatactatagaaaattccaccgctaacgtaagcctggccgcaatcgccaaccaggctgtggttttaatgggcctagacaagggatggccaatttctaaaatggatctgggcgtgcctctccttgccctggggtgctactcacaggtcaatcccttgacactgaccgcagctgtgctcctgcttatcactcactatgccattatcggaccgggcttacaagcgaaggccacgagagaggcacagaagaggacagctgccggtataatgaaaaacccaaccgtcgacgggattatgactatcgatctggaccctgtgatctacgattccaagttcgagaaacagctcggacaggttatgttgctggtgctatgtgcagtacaactgctccttatgcggaccagttgggctctgtgcgaagccttgacactggccactggccccattaccacactctgggagggtagcccaggcaagttttggaatacgaccatcgcggtgtcgatggctaacatattccgcgggtcttatctggcaggagccggcttagctttttccattatgaaaagcgtcgggactggaaagagaggcacaggttcacagggggaaacccttggagagaagtggaaaaagaaactgaatcagctcagtaggaaggaattcgacctatacaaaaagtctggcatcactgaggttgatcggacagaggccaaagaaggtctgaagcgaggcgagaccacgcatcacgcagtgtccagagggaccgccaagttgcagtggtttgtcgaacgcaacatggtgattcccgagggaagggtaatcgacctgggctgtgggcggggaggctggagctattactgcgctggtctcaaaaaggtgacagaagttcgtgggtatactaaaggaggccctggccatgaggagccggtgcccatgtcaacctacgggtggaatatagtcaagcttatgagtggaaaagatgtgttctacctgccacctgaaaagtgtgacacattgctgtgcgatatcggtgagagctccccctctcctactgtcgaagagagcagaaccattagggtgctcaagatggttgagccatggttaaaaaacaatcaattctgtatcaaggtactgaacccctatatgcctacagtgattgaacaccttgagcgcctgcagcggaaacacggcgggatgctagtccgaaatccactctccagaaactcaacccatgaaatgtactggatctctaatggaactggcaacattgtggcgagtgttaatatggtgtcgaggctgttgctgaaccgctttacgatgacacaccggagacccaccatcgagaaggacgtcgatctcggtgccgggactcgtcatgtgaacgcagaaccggagacccctaatatggacgtaataggagagaggattaaacggatcaaggaagagcacaacagcacatggcactatgacgatgaaaatccatacaagacgtgggcttatcatggctcctacgaggtgaaagccaccggctctgcatcaagcatgatcaacggggttgtcaagcttctgactaaaccctgggacgtggtgcctatggtcacacagatggccatgaccgatactacaccattcggacaacagcgcgtttttaaggaaaaagtggacacccgaacacccagatccatgccgggtactaggcgggctatgggcattaccgccgagtggttatggcgcacgctggggagaaataagaagcctaggttgtgcacccgagaggaattcacaaaaaaggtacggactaacgcggcaatgggagccgtgtttaccgaggaaaatcagtgggatagtgctaaagccgcagtcgaggacgaaaacttctggaagctcgtggatcgtgagagagagctgcacaaactaggcaagtgtggttcttgcgtttataatatgatggggaaacgcgaaaagaagcttggagagtttggcaaagctaagggcagcagggccatatggtacatgtggctgggggctcggtacctcgaattcgaggccctgggatttttgaacgaggaccattggttctcaagagaaaattcctatagtggtgtggagggcgaagggctgcacaaactcggatacatccttcgcgatattagcaagatccccggcggtgcaatgtatgcggacgatacagccgggtgggacactaggattaccgaggacgatctgcataacgaagagaaaatcacgcagcaaatggacccagagcaccgacagttagctaatgccatatttaagctgacataccagaacaaggtcgtgaaagtacagcggcctacccccactggaacagttatggatatcatttctagaaaggaccaaaggggctccggccaggtggggacctatggattgaatactttcaccaacatggaagcacagctcatccgccagatggagggtgaaggcgtcctgtcaaaagctgatctagagaacccacaccttcccgaaaagaaaattacacaatggctggagacgaagggggtggagcgtctccggagaatggccatcagcggagacgattgcgtggtcaagcctatagacgataggtttgcaaatgccctgttggcgttaaacgacatgggcaaagttcgcaaggatattccacagtggcagccgtcgaaaggttggcatgactggcagcaagtgcccttctgttctcaccatttccacgaactgatcatgaaggatgggcgaaaactcgtagtgccttgccggccacaggacgagcttatcggaagagctaggattagtcagggcgccggctggtccctgcgcgaaaccgcatgtctagggaaggcctacgctcaaatgtggagcctgatgtattttcacagacgggacctcaggttggcctcaaatgcaatatgctccgctgtccccgtgcattgggttcctacttctcgtacaacctggagcatccacgcccatcaccagtggatgactacagaggatatgctgaccgtgtggaaccgagtctggattgaagacaatccatggatggaggataagacgcccgtgacaacctgggagaacgtaccttaccttggaaaacgcgaagaccagtggtgtggtagtctgatcggcctcacttccagagcgacctgggctcagaatattccgacagccatccaacaggttcggagcttaatagggaacgaggaattcctggattacatgccatctatgaagaggtttcgcaaagaggaggaatcagagggagcaatctggtga

SEQ ID NO: 15432 - RNA, 9873 nt, synthetic construct
  misc_feature 1..9873: note = derived and/or modified CDS sequence (opt3) from DENV-3__FJ024468__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggagtgatcaccctgtatttaggcgccgttgtccaggcagacatgggttgtgtgattaattggaaagggaaggagctgaagtgcggatccggcatcttcgtgactaacgaggtccatacatggaccgaacagtacaaatttcaagccgattctcccaagcggctagctactgccattgcaggtgcttgggagaatggcgtttgtgggatccgaagcaccacacgcatggaaaacctcctgtggaaacagatagccaatgagcttaactatatcttgtgggaaaataacattaagctgacggtggtggtaggagacatcattggcgtcctcgagcaggggaaaagaaccctgactccacagcctatggagttaaagtactcatggaaaacatggggaaaggcgaagatcgtgaccgccgaaacacaaaacagttccttcataattgatggccccaatactccagagtgccccagcgcttctagggcatggaacgtttgggaagtggaggactatggttttggggtcttcaccacgaatatctggctgaaacttcgggaagtgtacacacagttgtgtgaccaccgcctcatgtcagccgctgttaaggatgagagagccgtgcacgcagacatgggatactggattgagagtcagaaaaacggcagctggaagctggaaaaagcgtccctaatcgaggtaaagacctgcacttggcctaagtctcataccctgtggtcgaatggtgtcctcgaaagcgatatgataatcccaaaatccctggccggcccgatttcacagcacaactataggcccgggtaccatacacaaactgctggaccttggcaccttggcaagttggagctggactttaattattgcgaggggaccacagtggtgatcacggaaaactgtggaacccgtggcccaagtttacggactacaaccgtctctggtaaactcattcacgagtggtgctgtcgaagctgcactctgccccctcttagatacatgggggaagatggatgttggtatggcatggagatcaggccaatatccgaaaaggaggagaatatggttaaatcactggtgagcgccggttctggcaaggtagacaacttcacaatgggggtgttgtgcctcgcaattctgtttgaagaggtcatgcgcggaaagttcggcaaaaagcatatgatcgctggggtgttctttaccttcgttctactgctctccggacagatcacgtggcgggatatggcccacactctgattatgatcggcagtaatgcaagcgacaaaatgggtatgggggtgacctaccttgccttgattgctacatttaagatacagcccttcctggcgttaggatttttcctcagaaaactgacctctagggaaaaccttctgctaggcgtcggcctcgccatggcaactacactgcaattgccggaggatatcgaacagatggctaatgggattgccctgggattaatggccctcaagctgatcacccagtttgagacatatcagctttggactgctctgatttccttgacctgttcaaacacgatgttcacactcaccgtggcatggcgcactgccaccctgatcctagcgggtgttagtctgcttcctgtgtgccaaagctcgtccatgcgaaagacagactggctcccaatggctgtcgccgcaatgggcgtaccccctctgcccttgtttatattctctctgaaagatactttaaagcggcgtagctggccactcaatgagggggtgatggccgttggactggtgtcaatccttgctagttccctgttgagaaacgacgtccctatggcaggccccctcgtggccggtgggctgctaattgcgtgttacgtaatcaccggaacgtctgctgatctgacagtggaaaaagccgcagacattacctgggaggaagaggccgaacagactggcgtcagccataaccttatgatcacagttgacgatgacggcaccatgaggataaaggatgacgagactgagaatattctcacagtgctgttgaaaaccgctttactgatcgtgtccggggtctttccatactcaatcccggccacgctcctggtgtggcacacttggcagaagcagacccaacgcagcggagttctttgggatgtacctagtcccccagaaacacagaaagcagagctggaagagggtgtgtatcggattaagcagcagggcatattcgggaagacccaagtcggagtgggcgttcagaaagagggtgtgtttcatacaatgtggcacgtcactagaggggctgtgttgacctacaacggaaagaggctagaacccaattgggcctctgtaaaaaaggacctgatctcctatggcggcgggtggcgactcagcgcgcagtggcaaaaaggagaggaagtccaggtgattgccgttgagcctggtaagaacccaaagaatttccagacgatgcccggcacattccagactaccacaggggaaatcggagcaattgctctggattttaaacctggcacctcgggttcaccgatcataaaccgcgaggggaaggtggtcggactttacggcaatggcgtggttactaaaaacgggggatatgtgtctggtatcgcccaaaccaatgctgagccagacggccccacacctgaattagaggaagagatgttcaagaaacggaacctgacgattatggatctccacccagggagtggaaagactagaaagtacttgcccgcaatcgtcagggaagccattaaacgtcgcctgcggaccctcatcctggcccctacaagagtggtagctgcggagatggaggaagcacttaagggcctgccgataaggtatcagaccactgccacaaaatccgagcataccggtcgagaaattgtggacttgatgtgccacgctacgtttactatgcggctactgagccccgttcgcgtcccaaattacaacctcatcatcatggatgaggcccatttcacagaccctgcatctattgccgctagagggtacatcagcaccagggtgggaatgggcgaagcggccgcaatatttatgaccgctactcccccaggcacagccgatgcattccctcagtccaatgcccccattcaggacgaggagcgggacatcccagaacgatcatggaacagtgggaatgagtggattaccgattttgctggaaagacagtgtggttcgtcccgagcatcaaagccggtaacgacatagcgaactgtttaagaaagaatggcaagaaagtaattcaactgtctcgcaagacttttgatacggaatatcagaaaaccaagcttaacgactgggatttcgtggttacaactgacatctccgagatgggggcaaattttaaagccgatagggtgatcgaccctcgtcggtgcctgaagcccgtcattctcaccgatggaccagagagagtgatcttggctggccccatgcctgttacagccgcttcagcagcccagaggcgcggtcgagtggggagaaacccacagaaggaaaatgaccaatacattttcaccggccagcccctgaacaatgatgaggaccacgctcattggactgaagccaaaatgctcctggacaacataaatacgcctgagggaatcattccggcacttttcgaaccagagcgggagaagagtgcggccatcgatggcgaatataggctaaaaggggagagccgcaagacctttgtcgaactgatgcgtagaggagacttgcccgtgtggttagctcacaaagtagcctccgagggtatcaagtacacagatcggaaatggtgcttcgacggccagaggaacaatcagattctggaagagaacatggatgtggagatatggactaaggaaggggagaagaaaaagctccgccctcgatggctggacgcaagaacctattctgatccccttgctctgaaagaatttaaggacttcgccgcaggacggaaatcgatcgccctcgatttggttacagagattggcagggtcccaagccacctggctcatcgcaccagaaatgcgctagacaacctggtgatgctccacacttcagaacatggtgggagggcctaccggcacgcagtggaggagcttcctgaaacaatggagacgctgttattgctgggcctcatgatcctgcttaccggaggcgctatgctgtttctcatttccgggaagggaatcggtaagactagtataggcttgatctgtgtcattgcctctagcgggatgctgtggatggccgaaatccccttacaatggattgcatccgctatcgttctagagttctttatgatggtgctgctcataccagagcctgaaaaacagcgtacaccgcaggataatcaacttgcctatgtagtgattggaatcctgaccttggcggctattatcgccgcaaacgagatgggcctgctcgaaaccacaaagcgcgacctgggtatgtcaaaagagcccggggtcgtgtctccaactagctaccttgatgttgacctccaccctgccagtgcttggacgctgtacgcagtggccaccacagtcataactcccatgttgcgacataccatcgaaaattccacagcgaacgtaagcctggctgccattgcaaaccaggccgtggttttaatgggcctagacaagggatggccaatctctaaaatggatctgggcgtgcctctccttgctctggggtgctattcacaggtcaatcccttgaccctgactgccgcagtgctcctgcttattacgcactacgctatcataggaccgggcttacaggccaaggcgacaagagaggcccaaaagaggaccgcagctggtattatgaaaaacccaactgtcgacgggatcatgaccatcgatctggaccctgtgatttatgattccaagttcgagaaacagctcggacaggttatgttgctggtgctatgtgccgtacagctgctccttatgcggacaagttgggcactgtgcgaagctttgactctggccaccggccccatcacaacgctctgggagggtagcccaggcaagttttggaataccactatagccgtgtcgatggcgaacattttccgcgggtcttacctggctggagcaggcttagccttttccatcatgaaaagcgtcgggacaggaaagagaggcaccggttcacaaggggaaactcttggagagaagtggaaaaagaaactgaatcagctcagtaggaaggaattcgacctatataaaaagtctggcattacagaggttgatcggaccgaggctaaagaaggtctgaagcgaggcgagacgacccatcacgccgtgtccagagggacagcaaagttgcagtggtttgtcgaacgcaacatggtgatccccgagggaagggtaatagacctgggctgtgggcggggaggctggagctactattgcgccggtctcaaaaaggtgactgaagttcgtgggtacaccaaaggaggccctggccatgaggagccggtgcccatgtcaacatacgggtggaatatcgtcaagcttatgagtggaaaagatgtgttctatctgccacctgaaaagtgtgacactttgctgtgcgatattggtgagagctccccctctcctaccgtcgaagagagcagaacaatcagggtgctcaagatggttgagccatggttaaaaaacaatcagttctgtattaaggtactgaacccctacatgcctaccgtgatcgaacaccttgagcgcctgcaacggaaacacggcgggatgctagtccgaaatccactctccagaaactcaactcatgaaatgtattggatttctaatggaacgggcaacatcgtggctagtgttaatatggtgtcgaggctgttgctgaaccgctttacaatgacccaccggagacccactatagagaaggacgtcgatctcggtgcggggacccgtcatgtgaacgccgaaccggagacacctaatatggacgtaattggagagaggatcaaacggatcaaggaagagcacaacagcacgtggcactacgacgatgaaaatccatataagacctgggcataccatggctcctatgaggtgaaagctactggctctgcctcaagcatgattaacggggttgtcaagcttctgacaaaaccctgggacgtggtgcctatggtcacccagatggcaatgactgatacaaccccattcggacagcaacgcgtttttaaggaaaaagtggacacacgaactcccagatccatgccgggtaccaggcgggtaatgggcataacggccgagtggttatggcgcaccctggggagaaataagaagcctaggttgtgcacacgagaggaattcactaaaaaggtgcggaccaacgctgccatgggagcggtctttacagaggaaaatcagtgggatagtgcaaaagccgctgtggaggacgaagatttctggaagctcgttgaccgtgagagagagctgcacaaactaggcaagtgtggttcttgcgtgtacaacatgatggggaaacgcgaaaagaagcttggagagtttggcaaagccaagggcagcagggcaatctggtacatgtggctgggggctcggtatctcgaattcgaggccctgggatttttgaatgaggatcattggttctcaagagaaaactcctacagtggtgtcgagggcgaagggctgcacaaactcggatatattcttcgcgacatcagcaagattcccggcggtgctatgtacgccgatgacactgcagggtgggacaccaggatcacggaggatgacctgcataatgaagagaaaataacacagcagatggatccagagcaccgacaattagcgaacgccatctttaagctgacctatcagaataaggtggtaaaagttcagcggcctactcccacaggaaccgtgatggacattatctctagaaaggatcagaggggctccggccaagtcgggacttacggattgaacaccttcacaaatatggaagctcagctcattcgccagatggagggtgaaggcgtgctgtcaaaagccgacctagagaacccacaccttcccgaaaagaaaatcacgcagtggctggagaccaagggggtggagcgtctccggagaatggcaataagcggagatgactgcgtcgttaagcctattgatgacaggtttgctaacgccctgttggcattaaatgatatgggcaaagtgcgcaaggacatcccacaatggcagccgtcgaaaggttggcatgattggcagcaggtacccttctgttctcaccatttccacgaactgatcatgaaggacgggcgaaaactcgtggtcccttgccggccacaagacgagcttattggaagagccaggataagtcagggcgcgggctggtccctgcgcgaaactgcttgtctagggaaggcctatgcacagatgtggagcctgatgtactttcacagacgggatctcaggttggcctcaaacgctatctgctccgccgtgcccgttcattgggtgcctacatctcgtaccacttggagcattcacgcacatcaccaatggatgacaaccgaggacatgctgacggtctggaatcgagtgtggatcgaagataacccatggatggaggacaagacacccgtaaccacttgggagaatgttccttaccttggaaaacgcgaagatcagtggtgtggtagtctgattggcctcacctccagagctacatgggcccagaacatcccgactgcgatacagcaagtgcggagcttaatcgggaatgaggaattcctggactatatgccatctatgaagaggtttcgcaaagaggaggaatcagagggagctatttggtga

SEQ ID NO: 15433 - RNA, 9873 nt, synthetic construct
  misc_feature 1..9873: note = derived and/or modified CDS sequence (opt3) from DENV-3__FJ024470__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgccttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcagaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaaccataggcccgggtatcacacacaaactgctggaccttggcaccttggcaagttggagctggactttaattactgcgaggggaccacagtcgtgattacggaaaactgtggaacccgtggcccaagtttacggactacaaccgtgtctggtaaactcatccatgagtggtgctgtcgaagctgcactctgccccctcttagatatatgggggaagatggatgttggtacggcatggagataaggccaatttccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcacatgatcgctggggtcttctttaccttcgtgctactgctctccggacagattacgtggcgggatatggcccatactctgatcatgattggcagtaatgcaagcgacagaatgggtatgggggttacctatcttgccttgatagctacatttaaaatccagcccttcctggcgttaggatttttcctcaggaagctgacctctcgcgaaaaccttctgctaggcgtgggcctcgccatggcaactacactgcaattgccggaggatattgaacagatggctaatgggatcgccctgggattaatggccctcaaactgattacccagtttgagacataccagctttggactgctctgatctccttgacctgttcaaacacgatattcacactcaccgtcgcatggcgaactgccaccctgatcctagcgggtgtgagtctgcttcctgtttgccaaagctcgtccatgcggaagacagactggctcccaatggctgtggccgcaatgggcgtcccccctctgcccttgtttattttctctctgaaggatactttaaaacgtagaagctggccactcaatgagggggtaatggccgtgggactggtttcaatccttgctagttccctgttgaggaacgacgtgcctatggcaggccccctcgtcgccggtgggctgctaattgcgtgttatgtgatcaccggaacgtctgctgatctgacagtagaaaaggccgcagacataacctgggaggaagaggccgaacagactggcgtgagccacaaccttatgattacagtcgacgatgacggcaccatgcgcatcaaagatgacgagactgagaatatcctcacagttctgttgaagaccgctttactgattgtgtccgggatatttccatactcaatcccggccacgctcctggtgtggcatacttggcagaaacagacccaacggagcggagtcctttgggatgtgcctagtcccccagaaacacagaaggcagagctggaagagggtgtttacagaattaaacagcagggcatcttcgggaagacccaagtaggagtgggcgtccagaaggagggtgtgtttcacacaatgtggcacgttactaggggggctgtgttgacctataacggaaaacgactagaacccaattgggcctctgtcaagaaagacctgatttcctacggcggcgggtggcgcctcagcgcgcagtggcaaaagggagaggaagtgcaggtaatcgccgtcgagcctggtaaaaacccaaagaatttccagacgatgcccggcacattccagactaccacaggggaaataggagcaatcgctctggattttaagcctggcacctcgggttcaccgattatcaaccgggaggggaaagtggttggactttatggcaatggcgtggtcactaagaacgggggatacgtgtctggtattgcccaaaccaatgctgagccagacggccccacacctgaattagaggaagagatgttcaaaaagagaaacctgacgatcatggatctccatccagggagtggaaaaactaggaagtatttgcccgcaatagttcgtgaagccattaagcgccggctgagaaccctcatcctggcccctacaagggtggtcgctgcggagatggaggaagcacttaaaggcctgccgatccgataccagaccactgccacaaagtccgagcacaccggtcgggaaattgtggacttgatgtgccatgctacgtttactatgcgcctactgagccccgtaagagtgccaaattataacctcatcataatggatgaggcccacttcacagaccctgcatctattgccgctagggggtacatcagcacccgggttggaatgggcgaagcggccgcaatttttatgaccgctactcccccaggcacagccgatgcattccctcagtccaatgcccccatccaggacgaggagcgagacataccagaaagatcatggaacagtgggaatgagtggattaccgattttgctggaaaaacagtctggttcgtgccgagcatcaaggccggtaacgacatcgcgaactgtttacgcaaaaatggcaagaaggtgattcaactgtctaggaaaacttttgatacggaataccagaagaccaaacttaacgactgggatttcgtcgtaacaactgacatctccgagatgggggcaaattttaaggccgatcgtgtgattgaccctcggagatgcctgaaacccgttatactcaccgatggaccagagagggtgatcttggctggccccatgcctgtcacagccgcttcagcagcccagcgccgaggtagagtggggcggaacccacagaaggaaaatgaccaatatattttcaccggccagcccctgaacaatgatgaggaccatgctcactggactgaagccaagatgctcctggacaacatcaatacgcctgagggaatcattccggcacttttcgaaccagagagggagaaaagtgcggccatagatggcgaataccgcctaaagggggagagccgtaaaacctttgttgaactgatgagacggggagacttgcccgtgtggttagctcacaaggtcgcctccgagggtatcaaatatacagataggaagtggtgcttcgacggccagcgcaacaatcagattctggaagagaacatggatgtggagatctggactaaagaaggggagaagaagaaactccgacctagatggctggacgcacggacctactctgatccccttgctctgaaggaatttaaagacttcgccgcaggaaggaagtcgattgccctcgatttggtaacagagatcggccgcgtgccaagccatctggctcacagaaccaggaatgcgctagacaacctggttatgctccatacttcagaacacggtgggcgggcctatcgtcacgcagtcgaggagcttcctgaaacaatggagacgctgttattgctgggcctcatgatactgcttaccggaggcgctatgctgtttctcatctccgggaaaggaattggtaagactagtatcggcttgatttgtgtgatcgcctctagcgggatgctgtggatggccgaaatacccttacaatggattgcatccgctatcgtgctagagttctttatgatggtcctgctcattccagagcctgaaaagcagcgcacaccgcaggataatcaacttgcctacgttgtgatcggaatactgaccttggcggctatcattgccgcaaacgagatgggcctgctcgaaaccacaaaacgagacctgggtatgtcaaaggagcccggggtagtgtctccaactagctatcttgatgtcgacctccatcctgccagtgcttggacgctgtacgcagtggccaccacagttatcactcccatgttgagacacaccattgaaaattccacagcgaacgtgagcctggctgccatcgcaaaccaggccgtcgtattaatgggcctagacaaaggatggccaatatctaagatggatctgggcgtgcctctccttgctctggggtgctactcacaggttaatcccttgaccctgactgccgcagtgctcctgcttattacgcattatgctatcatcggaccgggcttacaggccaaagcgacaagggaggcccaaaagcggaccgcagctggtattatgaagaacccaactgtcgacgggatcatgaccatagatctggaccctgtgatttacgattccaaattcgagaagcagctcggacaggtcatgttgctggtgctatgtgccgttcagctgctccttatgcgcacaagttgggcactgtgcgaagctttgactctggccaccggccccatcacaacgctctgggagggtagcccaggcaaattttggaataccactattgccgtgtcgatggcgaacatcttcagagggtcttatctggctggagcaggcttagccttttccataatgaagagcgtagggacaggaaaaaggggcaccggttcacaaggggaaactcttggagagaagtggaagaaaaagctgaatcagctcagtcggaaagaattcgacctatacaagaaatctggcatcacagaggtggatcgaaccgaggctaaggaaggtctgaaaagaggcgagattacgcaccatgccgtctcccgcgggagcgcaaagttgcagtggtttgttgaaaggaacatggtgatccccgagggacgggtcattgacctgggctgtgggcgtggaggctggtcatattactgcgccggtctcaagaaagtgaccgaagtaagagggtatacaaagggaggccctggccacgaggagccggtgcccatgagtacttacgggtggaatatcgttaaacttatgagcggaaaggatgtgttctacctgccacctgaaaaatgtgacaccttgctgtgcgatattggtgagtcctctcccagccctacagtcgaagagtccaggactatccgcgtgctcaagatggtcgagccatggttaaagaacaatcagttctgtataaaagtgctgaacccctatatgcctaccgttattgaacaccttgagcggctgcaacgaaagcatggcgggatgctagtaagaaatccactctcaaggaactctacacacgaaatgtactggatcagtaatggaaccggcaacatcgtggcttcggtcaatatggtgagccgcctgttgctgaaccggtttactatgacgcatagacgtcccacaattgagaaagacgttgatctcggtgcggggaccaggcacgtgaacgccgaaccggagactcctaatatggacgtcataggagagcggatcaagcgcattaaagaagagcacaactccacctggcattatgacgatgaaaatccatacaagacatgggcatatcacggctcttacgaggtgaaggctacgggctcagccagctccatgatcaacggggtagtgaaacttctgaccaagccctgggacgttgtccctatggtgactcagatggcaatgacagataccactccattcggacagcaacgagtgtttaaagaaaaggtcgacacaagaacccccaggagtatgccgggtacacggcgcgttatgggcattactgccgagtggttatggagaaccctggggaggaataaaaagcctcgattgtgcacgcgggaggaattcaccaagaaagtgcgtacaaacgctgccatgggagcggtatttactgaggaaaatcagtgggattctgcaaaggccgctgtggaggacgaagatttctggaaactcgtcgacagagagcgcgagctgcataagctaggcaaatgtggtagctgcgtgtataacatgatggggaagagggaaaaaaagcttggagagtttggcaaggccaaaggctcacgggcaatctggtacatgtggctgggggctagatacctcgaattcgaggccctgggatttttgaatgaggatcactggttctcccgcgaaaacagttatagcggtgttgagggcgaagggctgcataagctcggatacatacttagggacatctctaaaattcccggcggtgctatgtatgccgatgacaccgcagggtgggacacacgaatcactgaggatgacctgcacaatgaagagaagattacccagcagatggatccagagcaccggcaattagcgaacgccatctttaaactgacgtaccagaataaggtggtcaaggtgcagagacctacacccaccggaactgtaatggacataatttccaggaaagatcagcgcggctcaggccaagttgggacatatggattgaacaccttcactaatatggaagctcagctcatccgtcagatggagggtgaaggcgtgctgagcaaggccgacctagagtcgcatcaccttccagaaaaaaagatcacccagtggctggagacaaaaggggtcgagcggctcaagagaatggcaatttctggagatgactgcgtggtgaagcccatagatgacaggtttgctaacgccctgttggcattaaacgatatgggcaaagtccgcaaggacatccctcaatggcagccaagtaaaggttggcatgattggcagcaggttccgttctgttcccaccacttccatgaactgattatgaaggacgggcgaaaactcgtggtaccctgccggcctcaagacgagcttatcggaagagccaggattagccagggcgcgggctggtcactgcgcgaaacggcttgtctagggaaggcctacgcacagatgtggtccctgatgtattttcacagacgggatctcaggttggcctctaatgctatctgcagcgccgtgccagtccattgggtgcccaccagtcgtactacatggtccatacacgcacatcaccaatggatgaccactgaggacatgctgacagtttggaaccgagtgtggatcgaagataatccttggatggaggacaagaccccagtcacgacatgggagaacgtgccctaccttggaaaacgcgaagatcagtggtgtggtagcctgattggcctcacctctagagctacttgggcccagaatatccctaccgcgattcagcaagtacggtcattaatcgggaacgaggaattcctggactacatgccgagtatgaagaggtttcgcaaagaggaggaatccgagggagctatttggtga

SEQ ID NO: 15434 - RNA, 9873 nt, synthetic construct
  misc_feature 1..9873: note = derived and/or modified CDS sequence (opt3) from DENV-3__FJ024471__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgccttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcagaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaaccataggcccgggtatcacacacaaactgctggaccttggcaccttggcaagttggagctggactttaattactgcgaggggaccacagtcgtgattacggaaaactgtggaacccgtggcccaagtttacggactacaaccgtgtctggtaaactcatccatgagtggtgctgtcgaagctgcactctgccccctcttagatatatgggggaagatggatgttggtacggcatggagataaggccaatttccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcacatgatcgctggggtcttctttaccttcgtgctactgctctccggacagattacgtggcgggatatggcccatactctgatcatgattggcagtaatgcaagcgacagaatgggtatgggggttacctatcttgccttgatagctacatttaaaatccagcccttcctggcgttaggatttttcctcaggaagctgacctctcgcgaaaaccttctgctaggcgtgggcctcgccatggcaactacactgcaattgccggaggatattgaacagatggctaatgggatcgccctgggattaatggccctcaaactgattacccagtttgagacataccagctttggactgctctgatctccttgacctgttcaaacacgatattcacactcaccgtcgcatggcgaactgccaccctgatcctagcgggtgtgagtctgcttcctgtttgccaaagctcgtccatgcggaagacagactggctcccaatggctgtggccgcaatgggcgtcccccctctgcccttgtttattttctctctgaaggatactttaaaacgtagaagctggccactcaatgagggggtaatggccgtgggactggtttcaatccttgctagttccctgttgaggaacgacgtgcctatggcaggccccctcgtcgccggtgggctgctaattgcgtgttatgtgatcaccggaacgtctgctgatctgacagtagaaaaggccgcagacataacctgggaggaagaggccgaacagactggcgtgagccacaaccttatgattacagtcgacgatgacggcaccatgcgcatcaaagatgacgagactgagaatatcctcacagttctgttgaagaccgctttactgattgtgtccgggatatttccatactcaatcccggccacgctcctggtgtggcatacttggcagaaacagacccaacggagcggagtcctttgggatgtgcctagtcccccagaaacacagaaggcagagctggaagagggtgtttacagaattaaacagcagggcatcttcgggaagacccaagtaggagtgggcgtccagaaggagggtgtgtttcacacaatgtggcacgttactaggggggctgtgttgacctataacggaaaacgactagaacccaattgggcctctgtcaagaaagacctgatttcctacggcggcgggtggcgcctcagcgcgcagtggcaaaagggagaggaagtgcaggtaatcgccgtcgagcctggtaaaaacccaaagaatttccagacgatgcccggcacattccagactaccacaggggaaataggagcaatcgctctggattttaagcctggcacctcgggttcaccgattatcaaccgggaggggaaagtggttggactttatggcaatggcgtggtcactaagaacgggggatacgtgtctggtattgcccaaaccaatgctgagccagacggccccacacctgaattagaggaagagatgttcaaaaagagaaacctgacgatcatggatctccatccagggagtggaaaaactaggaagtatttgcccgcaatagttcgtgaagccattaagcgccggctgagaaccctcatcctggcccctacaagggtggtcgctgcggagatggaggaagcacttaaaggcctgccgatccgataccagaccactgccacaaagtccgagcacaccggtcgggaaattgtggacttgatgtgccatgctacgtttactatgcgcctactgagccccgtaagagtgccaaattataacctcatcataatggatgaggcccacttcacagaccctgcatctattgccgctagggggtacatcagcacccgggttggaatgggcgaagcggccgcaatttttatgaccgctactcccccaggcacagccgatgcattccctcagtccaatgcccccatccaggacgaggagcgagacataccagaaagatcatggaacagtgggaatgagtggattaccgattttgctggaaaaacagtctggttcgtgccgagcatcaaggccggtaacgacatcgcgaactgtttacgcaaaaatggcaagaaggtgattcaactgtctaggaaaacttttaacacggaataccagaagaccaaacttaatgattgggacttcgtcgtaacaactgatatctccgagatgggggcaaactttaaggccgaccgtgtgattgatcctcggagatgcctgaaacccgttatactcaccgacggaccagagagggtgatcttggctggccccatgcctgtcacagccgcttcagcagcccagcgccgaggtagagtggggcggaatccacagaaggaaaacgatcaatatattttcaccggccagcccctgaataacgacgaggatcatgctcactggactgaagccaagatgctcctggacaatatcaacacgcctgagggaatcattccggcacttttcgaaccagagagggagaaaagtgcggccatagacggcgaataccgcctaaagggggagagccgtaaaacctttgttgaactgatgagacggggagatttgcccgtgtggttagctcacaaggtcgcctccgagggtatcaaatatacagacaggaagtggtgcttcgatggccagcgcaataaccagattctggaagagaatatggacgtggagatctggactaaagaaggggagaagaagaaactccgacctagatggctggatgcacggacctactctgacccccttgctctgaaggaatttaaagatttcgccgcaggaaggaagtcgattgccctcgacttggtaacagagatcggccgcgtgccaagccatctggctcacagaaccaggaacgcgctagataatctggttatgctccatacttcagaacacggtgggcgggcctatcgtcacgcagtcgaggagcttcctgaaacaatggagacgctgttattgctgggcctcatgatactgcttaccggaggcgctatgctgtttctcatctccgggaaaggaattggtaagactagtatcggcttgatttgtgtgatcgcctctagcgggatgctgtggatggccgaaatacccttacaatggattgcatccgctatcgtgctagagttctttatgatggtcctgctcattccagagcctgaaaagcagcgcacaccgcaggacaaccaacttgcctacgttgtgatcggaatactgaccttggcggctatcattgccgcaaatgagatgggcctgctcgaaaccacaaaacgagatctgggtatgtcaaaggagcccggggtagtgtctccaactagctatcttgacgtcgatctccatcctgccagtgcttggacgctgtacgcagtggccaccacagttatcactcccatgttgagacacaccattgaaaactccacagcgaacgtgagcctggctgccatcgcaaatcaggccgtcgtattaatgggcctagacaaaggatggccaatatctaagatggacctgggcgtgcctctccttgctctggggtgctactcacaggttaaccccttgaccctgactgccgcagtgctcctgcttattacgcattatgctatcatcggaccgggcttacaggccaaagcgacaagggaggcccaaaagcggaccgcagctggtattatgaagaatccaactgtcgatgggatcatgaccatagacctggatcctgtgatttacgactccaaattcgagaagcagctcggacaggtcatgttgctggtgctatgtgccgttcagctgctccttatgcgcacaagttgggcactgtgcgaagctttgactctggccaccggccccatcacaacgctctgggagggtagcccaggcaaattttggaacaccactattgccgtgtcgatggcgaatatcttcagagggtcttatctggctggagcaggcttagccttttccataatgaagagcgtagggacaggaaaaaggggcaccggttcacaaggggaaactcttggagagaagtggaagaaaaagctgaaccagctcagtcggaaagaattcgatctatacaagaaatctggcatcacagaggtggaccgaaccgaggctaaggaaggtctgaaaagaggcgagattacgcaccatgccgtctcccgcgggagcgcaaagttgcagtggtttgttgaaaggaatatggtgatccccgagggacgggtcattgatctgggctgtgggcgtggaggctggtcatattactgcgccggtctcaagaaagtgaccgaagtaagagggtatacaaagggaggccctggccacgaggagccggtgcccatgagtacttacgggtggaacatcgttaaacttatgagcggaaaggacgtgttctacctgccacctgaaaaatgtgataccttgctgtgcgacattggtgagtcctctcccagccctacagtcgaagagtccaggactatccgcgtgctcaagatggtcgagccatggttaaagaataaccagttctgtataaaagtgctgaatccctatatgcctaccgttattgaacaccttgagcggctgcaacgaaagcatggcgggatgctagtaagaaacccactctcaaggaattctacacacgaaatgtactggatcagtaacggaaccggcaatatcgtggcttcggtcaacatggtgagccgcctgttgctgaaccggtttactatgacgcatagacgtcccacaattgagaaagatgttgacctcggtgcggggaccaggcacgtgaatgccgaaccggagactcctaacatggatgtcataggagagcggatcaagcgcattaaagaagagcacaattccacctggcattatgacgacgaaaacccatacaagacatgggcatatcacggctcttacgaggtgaaggctacgggctcagccagctccatgatcaatggggtagtgaaacttctgaccaagccctgggatgttgtccctatggtgactcagatggcaatgacagacaccactccattcggacagcaacgagtgtttaaagaaaaggtcgatacaagaacccccaggagtatgccgggtacacggcgcgttatgggcattactgccgagtggttatggagaaccctggggaggaacaaaaagcctcgattgtgcacgcgggaggaattcaccaagaaagtgcgtacaaatgctgccatgggagcggtatttactgaggaaaaccagtgggactctgcaaaggccgctgtggaggatgaagacttctggaaactcgtcgatagagagcgcgagctgcataagctaggcaaatgtggtagctgcgtgtataatatgatggggaagagggaaaaaaagcttggagagtttggcaaggccaaaggctcacgggcaatctggtacatgtggctgggggctagatacctcgaattcgaggccctgggatttttgaacgaggaccactggttctcccgcgaaaatagttatagcggtgttgagggcgaagggctgcataagctcggatacatacttagggatatctctaaaattcccggcggtgctatgtatgccgacgataccgcagggtgggacacacgaatcactgaggacgatctgcacaacgaagagaagattacccagcagatggacccagagcaccggcaattagcgaatgccatctttaaactgacgtaccagaacaaggtggtcaaggtgcagagacctacacccaccggaactgtaatggatataatttccaggaaagaccagcgcggctcaggccaagttgggacatatggattgaataccttcactaacatggaagctcagctcatccgtcagatggagggtgaaggcgtgctgagcaaggccgatctagagtcgcatcacctttctgaaaaaaagatcacccagtggctggagacaaaaggggtcgagcggctcaagagaatggcaattagtggagacgattgcgtggtgaagccaatagacgataggtttgctaacgccctgttggcattaaatgacatgggcaaagtccgcaaggatatcccccaatggcagccttccaaaggttggcatgactggcagcaggttccattctgtagccaccacttccatgaactgattatgaaggatgggcgaaaactcgtggtaccgtgccggccccaagacgagcttatcggaagagccaggatttcacagggcgcgggctggtccctgcgcgaaacggcttgtctagggaaggcctacgcacagatgtggtctctgatgtattttcacagacgggacctcaggttggccagcaacgctatctgcagtgccgtgcctgtccattgggtgccaacctcccgtactacatggagcatacacgcacatcaccaatggatgaccactgaggatatgctgacagtttggaatcgagtgtggatcgaagacaacccctggatggaggataagacccctgtcacgacatgggagaatgtgccataccttggaaaacgcgaagaccagtggtgtggttctctgattggcctcacctcaagagctacttgggcccagaacatccccaccgcgattcagcaagtacggagtttaatcgggaatgaggaattcctggattacatgccttccatgaagaggtttcgcaaagaggaggaaagcgagggagctatttggtga

SEQ ID NO: 15435 - RNA, 9873 nt, synthetic construct
  misc_feature 1..9873: note = derived and/or modified CDS sequence (opt3) from DENV-3__FJ182005__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaagtgcctttctccacagaggacggccaaggtaaggctcattcagggcgtcttatcactgcgaacccagtagtcaccaaaaaggaggaacccgtgaatatagaggcagaaccgcctttcggcgagagcaacattgttatcggaatcggcgataatgccttgaaaattaactggtataagaaggggagttctatcggaaaaatgtttgaagctacagcccgcggtgcaagaaggatggccattctgggcgacactgcttgggatttcgggtccgtgggaggcgtcctcaatagcctgggtaagatggtgcaccagatatttgggtcggcctacaccgcacttttctctggcgtatcctgggtgatgaaaatcggaattggcatcctgttgacgtggatcgggctcaactcaaagaatacaagtatgagcttttcctgcattgttataggaatcattaccctgtatttaggcgcggtcgtgcaggctgacatgggttgtgtgatcaactggaaagggaaggagctgaagtgcggatctggcattttcgtcactaatgaggttcatacatggaccgaacagtacaaatttcaagccgatagccccaagcggctagcaactgccatcgctggtgcctgggagaacggcgtgtgtgggatacgatcaaccacacgcatggaaaatctcctgtggaaacagatcgcaaacgagcttaattatattttgtgggaaaacaatatcaagctgacggtggtagtcggagacattatcggcgtgctcgagcaggggaaaagaaccctgactccacagcctatggagttaaagtacagttggaaagcttggggaaaggccaagatagttacagcggaaacccaaaactccagcttcattatcgatggccccaacacaccagagtgcccctctgcctcaagggcttggaatgtgtgggaagtcgaggactatggttttggggtgttcactaccaacatttggctgaaacttcgggaagtttacacgcagttgtgtgaccaccgcctcatgagtgcagccgtgaaggatgagagagctgtacacgccgacatgggatactggatcgagagccagaaaaatggctcctggaagctggaaaaagcatctctaatagaggtcaagacatgcacctggcctaagtcgcatactctgtggagcaacggtgtgctcgaatccgatatgatcattccaaaatcactggcgggcccgatcagtcagcacaattataggcccgggtaccatacccaaacagccggaccttggcaccttggcaagttggagctggactttaactattgcgaggggactaccgtggtcattacagaaaattgtggaacgcgtggcccatctttacggaccactacagttagcggtaaactcatccacgagtggtgctgtcgatcctgcaccctgccccctcttagatacatgggggaagatggatgttggtatggcatggagataaggccaatttcagaaaaggaggagaacatggtgaaaagcctggtatctgctggttccggcaaggtggacaatttcactatgggggtcttgtgcctcgccatcctgtttgaagaggtgatgcgcggaaagttcggcaaaaagcatatgatcgcaggggttttctttacattcgtgctactgctcagtggacagattacctggcgggatatggctcacacgctgatcatgattggcagcaacgcctctgacagaatgggtatgggggtcacttaccttgcattgatagccacctttaaaatccagcccttcctggctttaggatttttcctcaggaagctgacatcccgcgaaaatcttctgctaggcgtgggcctcgcgatggccaccactctgcaattgccggaggatattgaacagatggcaaacgggatcgctctgggattaatggccctcaaactgattacacagtttgagacctatcagctttggacagccctgatctcattgacttgtagtaataccatattcacgctcacagttgcttggcgaaccgcaactctgatcctagccggtgtgagcctgcttcctgtctgccaatcgtcctctatgcggaagaccgactggctcccaatgacagtagcggctatgggcgtgccccctctgcccttgtttattttcagcctgaaggatactttaaaacgtagatcatggccactcaacgagggggttatggccgtgggactggtcagtatccttgcatcctctctgttgaggaatgacgtgcctatggccggccccctcgtagctggtgggctgctaattgcatgttacgtgatcaccggaacgagcgccgatctgacagtcgaaaaggcggctgacgttacctgggaggaagaggccgaacagactggcgtgtcccataaccttatgataacagtggacgatgacggcaccatgcgcattaaagatgacgagactgagaacatcctcacagtcctgttgaagaccgcattactgatcgtgtcagggatttttccatacagcataccggccacgctcctggtttggcacacttggcagaaacagacccaacggagtggagtactttgggatgtgccttctcccccagaaacacagaaggctgagctggaagagggtgtctatagaatcaaacagcagggcattttcgggaagacccaagtgggagttggcgtgcagaaggagggtgtctttcatacaatgtggcacgtgactaggggggccgtattgacctacaatggaaaacgactagaacccaactgggcatccgtcaagaaagacctgatcagctatggcggcgggtggcgcctctcggctcagtggcaaaagggagaggaagtgcaggttattgccgtggagcctggtaaaaatccaaagaacttccagacgatgcccggcacattccagactaccacaggggaaatcggagcgatagccctggattttaagcctggcacctcaggttctccgatcattaatcgggaggggaaagtcgtgggactttacggcaacggcgttgtgactaagaatgggggatatgtcagtggtatcgcacaaaccaacgctgagccagacggccccacacctgaattagaggaagagatgttcaaaaagagaaatctgacgattatggatctccacccagggtccggaaaaactaggaagtacttgcccgccatcgtgcgtgaagctataaagcgccggctgagaaccctcattctggcacctacaagggtagtggccgccgagatggaggaagctcttaaaggcctgccgatccgatatcagaccactgcgacaaagagcgagcataccggtcgggaaatcgttgacttgatgtgccacgcaacgtttactatgcgcctactgtctcccgtcagagtgccaaactacaatctcattatcatggatgaggcccatttcacagaccctgctagcatagccgcaagggggtacatttccacccgggtgggaatgggcgaagccgctgcgatctttatgaccgccactcccccaggcacagcagatgctttccctcagtcaaacgcccccattcaggacgaggagcgagacatcccagaaagaagttggaatagcgggaacgagtggataaccgattttgcaggaaaaacagtctggttcgtaccgtctattaaggccggtaatgacatcgctaactgtttacgcaaaaacggcaagaaggtgatccaactgtccaggaaaacttttgatacggaatatcagaagaccaaacttaatgactgggatttcgttgtgacaactgacatttcagagatgggggccaactttaaggcggatcgtgtcatcgaccctcggagatgcctgaaacccgtgattctcaccgatggaccagagagggttatattggcaggccccatgcctgtgacagccgctagtgccgctcagcgccgaggtagagtcgggcggaatccacagaaggaaaacgaccaatacatcttcaccggccagcccctgaataacgatgaggaccacgcacattggactgaagccaagatgctcctggacaatattaacacgcctgagggaatcatcccggctcttttcgaaccagagagggagaaaagcgccgcaattgatggcgaatatcgcctaaagggggagtcccgtaaaacctttgtggaactgatgagacggggagacttgcccgtatggttagcgcacaaggtggcctctgagggtataaaatacacagataggaagtggtgcttcgacggccagcgcaataaccagatcctggaagagaatatggatgttgagatttggactaaagaaggggagaagaagaaactccgacctagatggctggacgctcggacctattcggatccccttgccctgaaggaatttaaagacttcgcagctggaaggaagagcatcgccctcgatttggtcacagagattggccgcgtgccatcacacctggcacatagaaccaggaacgccctagacaatctggtgatgctccacacttccgaacatggtgggcgggcttaccgtcacgcggtcgaggagcttcctgaaacaatggagacgctgttattgctgggcctcatgatcctgcttaccggaggcgccatgctgtttctcataagtgggaaaggaatcggtaagacttctattggcttgatctgtgttattgcaagctccgggatgctgtggatggctgaaatccccttacaatggatagcctcagccattgtgctagagttctttatgatggtactgctcatcccagagcctgaaaagcagcgcacaccgcaggataaccaacttgcatatgtggtcattggaatcctgaccttggctgccataatcgcggctaatgagatgggcctgctcgaaaccacaaaacgagacctgggtatgtctaaggagcccggggtggttagcccaactagttaccttgatgtggacctccaccctgcctccgcatggacgctgtacgccgtcgctaccacagtaattactcccatgttgagacataccatcgaaaacagcacagcaaatgtgtctctggccgcgattgctaaccaggccgttgtgttaatgggcctagacaaaggatggccaatctcaaagatggatctgggcgtccctctccttgcactggggtgctattcccaggtgaaccccttgaccctgactgccgctgtcctcctgcttataacgcactacgccattatcggaccgggcttacaggcaaaagctacaagggaggcccaaaagcggaccgcggccggtatcatgaagaatccaactgtggacgggattatgaccatcgatctggaccctgttatatatgatagtaaattcgagaagcagctcggacaggtgatgttgctggtactatgtgcagtgcagctgctccttatgcgcacaagctgggctctgtgcgaagccttgactctggcaaccggccccattacaacgctctgggagggttcgccaggcaaattttggaacaccactatcgctgtctctatggccaatattttcagagggtcctacctggccggagcgggcttagcttttagcatcatgaagtcagttgggacaggaaaaaggggcaccggtagtcaaggggaaactcttggagagaagtggaagaaaaagctgaaccagctctctcggaaagaattcgacctatataagaaatccggcataacagaggtggatcgaaccgaggcaaaggaaggtctgaaaagaggcgagatcacgcatcacgccgtcagccgcgggtcagctaagttgcagtggtttgtggaaaggaatatggtaattcccgagggacgggtgatcgacctgggctgtgggcgtggaggctggagttactattgcgccggtctcaagaaagttaccgaagtgagagggtacacaaagggaggccctggccatgaggagccggtccccatgagcacttacgggtggaacattgtgaaacttatgtccggaaaggatgtcttctatctgccacctgaaaaatgtgacaccttgctgtgcgatatcggtgagtctagcccctcccctacagtggaagagtcaaggactattcgcgttctcaagatggtagagccatggttaaagaataaccagttctgtatcaaagtgctgaatccctacatgcctaccgtcatagaacaccttgagcggctgcaacgaaagcacggcgggatgctagtgagaaacccactctctaggaatagtacacatgaaatgtattggatttcgaacggaaccggcaatatcgttgcaagcgtgaacatggtctcccgcctgttgctgaatcggtttactatgacgcacagacgtcccacaatcgagaaagacgtggatctcggtgccgggaccaggcatgtaaacgctgaaccggagactcctaacatggacgtgattggagagcggataaagcgcatcaaagaagagcacaattctacctggcactacgacgatgaaaacccatataagacatgggcgtaccatggctcatatgaggttaaggccacgggcagcgcatccagtatgattaatggggtcgtgaaacttctgaccaagccctgggacgtggtccctatggttactcagatggctatgacagataccactccattcggacagcaacgagtgtttaaagaaaaggtagacacaagaacccccaggtctatgccgggtacacggcgcgtgatgggcatcactgccgagtggttatggagaaccctggggaggaacaaaaagcctcgattgtgcacgcgggaggaattcaccaagaaagtccgtacaaatgcagccatgggagctgtgtttactgaggaaaaccagtgggatagcgccaaggcggcagttgaggacgaagatttctggattctcgtggacagagagcgcgagctgcacaaactaggcaagtgtggttcatgcgtctacaatatgatggggaaaagggaaaagaaacttggagagtttggcaaggccaagggctcccgggctatctggtacatgtggctgggggccagatatctcgaattcgaggcactgggatttttgaacgaggatcattggttcagtcgcgaaaatagctactctggtgtggagggcgaagggctgcacaaactcggatatatacttagggacatctccaagattcccggcggtgctatgtacgccgatgacaccgctgggtgggacacacgaatcactgaggatgacctgcataacgaagagaaaattacccagcagatggatccagagcaccggcaattagcctcagcaatctttaagctgacgtatcagaataaagtagttaaggtgcagagacctacacccaccggaactgtcatggacataattagcaggaaggatcagcgcggctcgggccaagtggggacatacggattgaacaccttcactaatatggaagcgcagctcatccgtcagatggagggtgaaggcgtgctgtctaaagccgacctagagaacccacaccttcccgaaaagaaaatcacccagtggctggagacaaagggggtcgagcggctcaaaagaatggctattagtggagatgactgcgttgtgaagcctatagatgacaggtttgccaatgcactgttggctttaaacgatatgggcaaggtacgcaaagacatcccacaatggcagccgtccaagggttggcatgattggcagcaggtgcccttctgtagccaccatttccacgaactgattatgaaagacgggcgaaagctcgtcgtgccttgccggccacaagacgagcttatcggaagagccaggatttcacagggcgcaggctggtccctgcgcgaaacggcctgtctagggaaagcgtatgctcagatgtggtctctgatgtactttcacagacgggatctcaggttggccagcaacgcaatctgcagtgccgttcccgtgcattgggtccctacctcccgtactacatggagcatacacgctcatcaccaatggatgaccactgaggacatgctgacagtgtggaatcgagtatggatcgaagataacccatggatggaggacaagacccccgttacgacatgggagaatgtgccttaccttggaaagcgcgaagatcagtggtgtggttctctgattggcctcacctcaagagccacttgggcacagaacatcccgaccgctattcagcaagtccggagtttaatcgggaatgaggaattcctggactatatgccatccatgaaaaggtttcgcaaggaggaggaaagcgagggagccatttggtga

SEQ ID NO: 15436 - RNA, 9873 nt, synthetic construct
  misc_feature 1..9873: note = derived and/or modified CDS sequence (opt3) from DENV-3__FJ373302__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgtcaatgagttttagctgcattgccataggaatcattacactgtatttaggcgcagtggttcaggccgacaccggttgtgtcatcaattggaaagggaaggagctgaagtgcggatccggcattttcgtgactaacgaggtgcatacatggaccgaacagtacaaatttcaagctgattctcccaagcggctagccactgcaatcgctggtgcctgggagaatggcgtctgtgggatacgaagcaccacacgcatggaaaacctcctgtggaaacagatcgcgaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggccaagatagtcaccgctgaaacacaaaacagttccttcattatcgatggccccaatactccagagtgccccagcgcatctagggcctggaacgtgtgggaagttgaggactatggttttggggtgttcaccacgaatatttggctgaaacttcgggaagcttacacacagttgtgtgaccaccgcctcatgtcagccgcagtcaaggatgagagagcggtgcacgccgacatgggatactggatcgagagtcagaaaaagggcagctggaaactggaaaaggcttccctaatagaggttaagacctgcacttggcctaaatctcataccctgtggtcgaacggtgtgctcgaaagcgatatgatcattccaaagtccctggccggcccgatctcacagcacaattataggcccgggtaccatacacaaactgcaggaccttggcaccttggcaaattggagctggactttaactattgcgaggggaccacagtagtcattacggaaaattgtggaacccgtggcccaagtttacggactacaaccgtgtctggtaagctcatccacgagtggtgctgtcgaagctgcactctgccccctcttagatacatgggggaagatggatgttggtatggcatggagataaggccaatttccgaaaaagaggagaacatggtgaagtcactggtcagcgctggttctggcaaggttgacaatttcacaatgggggtgttgtgcctcgccatcctgtttgaagaggtaatgcgcggaaaattcggcaagaaacatatgatcgcaggggtgttctttaccttcgtcctactgctctccggacagattacgtggcgggatatggcccacactctgatcatgattggcagtaacgctagcgacagaatgggtatgggggtgacctaccttgcgttgatagccacatttaagatccagcccttcctggcattaggatttttcctcaggaaactgacctctcgcgaaaatcttctgctaggcgttggcctcgctatggccactacactgcaattgccggaggatattgaacagatggccaacgggatcgctctgggattaatggcactcaagctgattacccagtttgagacatatcagctttggactgccctgatctccttgacctgttcaaatacgatattcacactcaccgtggcgtggcgaactgctaccctgatcctagccggtgtcagtctgcttcctgtgtgccaaagctcgtccatgcggaagtctgactggctcccaatgacagttgcagccatgggcgtgccccctctgcccttgtttattttcagcctgaaagatactttaaagcgtagatcatggccactcaacgagggggtcatggctgtaggactggtgagtatccttgcatcctctctgttgaggaatgacgttcctatggccggccccctcgtggcgggtgggctgctaattgcttgttacgtcatcaccggaacgagcgccgatctgacagtggaaaaagcagccgacgtaacctgggaggaagaggctgaacagactggcgtgtcccataaccttatgataacagtcgacgatgacggcaccatgcgcattaaggatgacgagactgagaacatcctcacagttctgttgaaaaccgccttactgatcgtgtcagggatttttccatacagcataccggcaacgctcctggtgtggcacacttggcagaagcagacccggagaagtggagtcctttgggatgtgccttctcccccagaaacacaaaaagctgagctggaagagggtgtttataggatcaagcagcagggcattttcgggaagacccaggtaggagtgggcgtccaaaaagagggtgtgtttcatacaatgtggcacgttactcgaggggccgtgttgacctacaatggaaagcgcctagaacccaactgggcgtccgtcaaaaaggacctgatcagctatggcggcgggtggcggctctcggcccagtggcagaaaggagaggaagtgcaagtaattgcagtcgagcctggtaagaatccaaagaacttccagacgatgcccggcacattccagactaccacaggggaaatcggagctatagccctggattttaaacctggcacctcaggttctccgatcattaatagagaggggaaggtggttggactttacggcaacggcgtggtcactaaaaatgggggatatgtgagtggtatcgctcagaccaacgcagagccagacggccccacacctgaattagaggaagagatgttcaagaaaaggaatctgacgattatggatctccacccagggtccggaaagactcgtaagtacttgcccgccatcgttcgcgaagccataaaacggagactgaggaccctcattctggctcctacacgagtggtcgcggcagagatggaggaagcccttaagggcctgccgatccggtatcaaaccactgctacaaaaagcgagcataccggtcgcgaaatcgtggacttgatgtgccacgccacgtttactatgagactactgtctcccgtaagggtgccaaactacaatctcattatcatggatgaggcacatttcacagaccctgccagcatagctgcgcgggggtacatttccacccgagttggaatgggcgaagccgcagctatctttatgaccgccactcccccaggcacagcagatgccttccctcagtcaaacgctcccattcaggacgaggagagagacatcccagaacgcagttggaatagcgggaacgagtggataaccgattttgccggaaagacagtctggttcgtgccgtctattaaagcgggtaatgacatcgcaaactgtttaaggaagaacggcaagaaagtgatccagctgtcccgtaagacttttgatacggaatatcaaaaaaccaagcttaatgactgggatttcgtcgtaacaactgacatttcagagatgggggccaactttaaagctgatcgggtgatcgaccctagaaggtgcctgaagcccgttattctcaccgatggaccagagcgcgtgatattggccggccccatgcctgtcacagctgcaagtgccgctcagcgaagaggtcgggtggggaggaatccacagaaggaaaacgaccagtacatcttcaccggccaacccctgaataacgatgaggaccacgcccattggactgaagcaaaaatgctcctggacaatattaacacgcctgagggaatcatcccggcgcttttcgaaccagagcgcgagaagagcgccgctattgatggcgaatatcgtctaaaaggggagtccagaaagacctttgttgaactgatgcggaggggagacttgcccgtgtggttagcccacaaagtcgcatctgagggtataaagtacacagatcgcaaatggtgcttcgacggccagcgaaataaccagatcctggaagagaatatggatgtggagatttggactaaggaaggggagaagaaaaagctcagacctcggtggctggacgctaggacctattcggatccccttgccctgaaagaatttaaggacttcgcagccggacgcaaaagcatcgctctcgatttggtaacagagattggcagagtgccatcacacctggcgcataggacccggaacgccctagacaatctggttatgctccacacttccgaacatggtgggaaggcataccgtcacgctgtcgaggagcttcctgaaacaatggagacgctgttattgctgggcctcatgatcctgcttaccggaggcgccatgctgtttctcataagtgggaagggaatcggtaaaacttctattggcttgatctgtgtgattgccagctccgggatgctgtggatggcagaaatccccttacagtggatagcttcagccattgtgctagagttctttatgatggtcctgctcatcccagagcctgaaaagcaacgcacaccgcaggataaccagcttgcgtatgttgtgattggaatcctgaccttggctgccataatcgcagccaatgagatgggcctgctcgaaaccacaaaacgagacctgggtatgtctaaggagcccggggtagtgagcccaactagttaccttgatgtcgacctccaccctgcttccgcatggacgctgtacgccgtggcgaccacagttattactcccatgttgagacataccatcgaaaacagcacagctaatgtgtctctggccgcaattgccaaccaagctgtcgtattaatgggcctagacaaaggatggccaatctcaaagatggatctgggcgtgcctctccttgccctggggtgctattcccaggttaaccccttgaccctgactgcagctgtgctcctgcttataacgcactacgccattatcggaccgggcttacaggcgaaggccacaagggaggcacagaaacggaccgctgccggtatcatgaagaatccaactgtcgacgggattatgaccatcgatctggaccctgtgatatatgatagtaaattcgagaagcaactcggacaggtcatgttgctggtgctatgtgcagttcagctgctccttatgcgcacaagctgggctctgtgcgaagccttgactctggccaccggccccattacaacgctctgggagggttcgccaggcaaattttggaacaccactatcgcggtgtctatggctaatattttcagagggtcctacctggcaggagccggcttagcttttagcatcatgaagtcagtagggacaggaaagaggggcaccggtagtaaaggggaaactcttggagagaagtggaaaaagaaactgaaccagctctctcggaaggaattcgacctatataaaaagtccggcataacagaggtggatcgaaccgaggccaaggaaggtctgaaaagaggcgagatcacgcatcacgcagtcagccgcgggtcagccaagttgcaatggtttgttgaaaggaatatggtgattcccgagggacgggtcatcgacctgggctgtgggcgtggaggctggagttactattgcgctggtctcaaaaaggtgaccgaagtaagagggtacacaaaaggaggccctggccatgaggagccggtgcccatgagcacttacgggtggaacattgttaagcttatgtccggaaaggatgtgttctatctgccacctgaaaaatgtgacaccttgctgtgcgatatcggtgagtctagcccctcccctacagtcgaagagtcaaggactattcgcgtgctcaagatggtcgagccatggttaaaaaataaccagttctgtatcaaggtgctgaatccctacatgcctaccgttatagaacaccttgagcggctgcagcgaaaacacggcgggatgctagtaagaaacccactctctaggaatagtacacatgaaatgtattggatttcgaacggaaccggcaatatcgtggcgagcgtcaacatggtgtcccgcctgttgctgaatcggtttactatgacgcacagacgtcccacaatcgagaaggacgttgatctcggtgccgggaccaggcatgtgaacgcagaaccggagactcctaacatggacgtcattggagagcggataaagcgcatcaaagaagagcacaattctacctggcactacgacgatgaaaacccatataagacatgggcttaccatggctcatatgaggtgaaagccacgggcagcgcatccagtatgattaatggggtagtgaagcttctgaccaaaccctgggacgttgtccctatggtgactcagatggccatgacagataccactccattcggacaacagcgagtgtttaaggaaaaggtcgacacaagaacccccaggtctatgccgggtacacggcgcgttatgggcatcactgctgagtggttatggagaaccctggggaggaacaaaaagcctcgattgtgcacgcgggaggaattcaccaaaaaggtgcgtacaaatgccgcgatgggagcagtatttactgaggaaaaccagtgggatagcgccaaagctgccgtggaggacgaagatttctggaagctcgtcgacagagagcgcgagctgcacaaactaggcaagtgtggttcatgcgtgtacaatatgatggggaagagggaaaaaaagcttggagagtttggcaaagcaaagggctcccgggctatttggtacatgtggctgggggccagatatctcgaattcgaggctctgggatttttgaacgaggatcattggttcagtcgcgaaaatagctactctggtgttgagggcgaagggctgcacaaactcggatatatccttagggacatatccaagatccccggcggtgccatgtacgcagatgacaccgcggggtgggacacacgaattactgaggatgacctgcataacgaagagaagatcacccaacagatggatccagagcaccggcagttagccaatgctatttttaaactgacgtatcagaacaaggtggtcaaagtgcaaagacctacacccaccggaactgtaatggacatcatatcaaggaaggatcagcgcggcagcggccaggttgggacatacggattgaataccttcactaacatggaagcccagctcattcgtcaaatggagggtgaaggcgtgctgtcgaaagcagacctagagaatccacacctttctgaaaagaagatcacccagtggctggagacaaaaggggtcgagcggctcaagagaatggctatcagtggagatgactgcgtggtgaaacccattgatgacaggtttgccaacgcactgttggccttaaacgatatgggcaaggtccgcaaagacatacctcagtggcagccatccaagggttggcatgattggcaacaggttccgttctgtagccaccatttccacgaactgatcatgaaggacgggcgaaaactcgtggtaccctgccggcctcaggacgagcttattggaagagcgaggatctcacagggcgctggctggtccctgcgcgaaacggcctgtctagggaaggcatatgcccaaatgtggtctctgatgtactttcacagacgggatctcaggttggctagcaatgccatttgcagtgcagtgccagtccattgggtgcccacctcccgtactacatggagcatccacgctcatcaccagtggatgaccactgaggacatgctgacagtttggaaccgagtgtggatagaagataatccttggatggaggacaaaaccccagtcacgacatgggagaacgtgccctaccttggaaagcgcgaagatcagtggtgtggttctctgatcggcctcacctcaagagccacttgggcgcaaaatattcctaccgctatccagcaggtacggagtttaattgggaacgaggaattcctggactatatgccgtccatgaaaaggtttcgcaaggaggaggaaagcgagggagccatctggtga

SEQ ID NO: 15437 - RNA, 9873 nt, synthetic construct
  misc_feature 1..9873: note = derived and/or modified CDS sequence (opt3) from DENV-3__FJ182007__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaaccggcgataacgccttgaaaattaattggtataagaaggggagcagtatcggaaaaatgtttgaagcaacagcccgcggtgctagaaggatggccattctgggcgacactgcatgggatttcgggtctgtgggaggcgttctcaactccctgggtaagatggtgcaccagatatttgggagcgcgtacaccgctcttttctcgggcgtctcttgggtgatgaaaatcggaattggcgtactgttgacgtggatcgggctcaattccaagaacacatcaatgagttttagctgcatcgccattggaataatcaccctgtatttaggcgcagtggttcaggccgacactggttgtgtcattaattggaaagggaaggagctgaagtgcggatccggcatcttcgtgacaaacgaggtgcatacctggactgaacagtacaaatttcaagctgattctcccaagcggctagccaccgcaattgctggtgcctgggagaatggcgtctgtgggatccgaagcacaacgcgcatggaaaacctcctgtggaaacagatagcgaatgagcttaactatatcttgtgggaaaataacattaagctgaccgttgtggtgggagacatcattggcgtactcgagcaggggaaaagaactctgacaccacagcctatggagttaaagtactcatggaaaacctggggaaaggccaagatcgtcacagctgaaactcaaaacagttccttcataattgatggccccaataccccagagtgccccagcgcatctagggcctggaacgtgtgggaagttgaggactatggttttggggtgttcacgacaaatatctggctgaaacttcgggaagtctacacccagttgtgtgaccaccgcctcatgtcagctgccgtgaaggatgagagagcagttcacgcggacatgggatactggattgagagtcagaaaaacggcagctggaagctggaaaaagcctccctaatcgaggtgaagacttgcacctggcctaagtctcatacactgtggtcgaatggtgtactcgaaagcgatatgataatcccaaaatccctggctggcccgatttcacagcacaactataggcccgggtaccatactcaaaccgccggaccttggcaccttggcaagttggagctggactttaattattgcgaggggacaacggtcgtgatcaccgaagattgtggaactcgtggcccaagtttacggacaaccactgtgtctggtaaactcattcacgagtggtgctgtcgaagctgcacactgccccctcttagatacatgggggaagacggatgttggtatggcatggagatcaggccaatatccgaaaaggaggagaacatggtcaaatcactggttagcgcaggttctggcaaggtggataatttcaccatgggggtattgtgcctcgctattctgtttgaagaggtgatgcgcggaaagttcggcaaaaagcatatgatcgccggggtcttctttacgttcgtgctactgctctccggacagatcacttggcgggacatggcacacaccctgattatgatcggcagtaacgccagcgatagaatgggtatgggggttacataccttgctttgattgcgacctttaaaatacagcccttcctggccttaggatttttcctcaggaagctgacttctcgcgaaaatcttctgctaggcgtgggcctcgcaatggctacaaccctgcaattgccggaggacatcgaacagatggccaacgggattgccctgggattaatggctctcaaactgatcacacagtttgagacttatcagctttggaccgcactgatttccttgacgtgttcaaatacaatcttcaccctcactgtcgcctggcgaaccgcgacactgatactagctggtgtgagtctgcttcctgtttgccaaagctcgtccatgcggaagtctgattggctcccaatgactgtggccgcaatgggcgtcccccctctgcccttgtttatcttcagcctgaaggacaccttaaaacgtagatcatggccactcaacgagggggtaatggccgtgggactggttagtattcttgcttcctctctgttgaggaatgatgtgcctatggcaggccccctcgtcgccggtgggctgctaatcgcgtgttacgtgattacgggaacaagcgctgacctgaccgtagaaaaggccgcagacgtgacttgggaggaagaggccgaacagacaggcgtctcccataaccttatgatcaccgttgatgacgatggcactatgcgcataaaagacgatgagacagagaacattctcaccgtgctgttgaagacggctttactgatcgtgtcagggatctttccatacagcattccggccactctcctggtctggcacacctggcagaaacagacacggagaagtggagtgctttgggacgttccttctcccccagaaacccaaaaggcagagctggaagagggtgtatataggataaaacagcagggcatcttcgggaagacacaggtgggagtcggcgtgcaaaaggagggtgtttttcatactatgtggcacgtgacccgaggggctgtcttgacgtacaatggaaaacgcctagaacccaactgggcctccgtgaagaaagatctgattagctatggcggcgggtggcggctctcggcgcagtggcagaagggagaggaagtacaagtcatcgccgtggagcctggtaaaaatccaaagaacttccagacaatgcccggcactttccagaccacaaccggggaaattggagcaatcgctctggactttaagcctggcacttcaggttctccgataatcaatagagaggggaaagttgtgggactttacggcaacggcgtcgtgaccaagaatgggggatatgttagtggtattgcccagacaaacgctgagccagatggccccacgcctgaattagaggaagagatgttcaaaaagaggaatctgactatcatggacctccacccagggtccggaaaaacccgtaagtacttgcccgcaattgtgcgcgaagccatcaagcggagactgaggacactcatactggcccctacccgagtcgtggctgcggagatggaggaagcacttaaaggcctgccgattcggtatcaaactacagccaccaagagcgagcatacgggtcgcgaaatcgtagatttgatgtgccacgctacttttacaatgagactactgtctcccgtgagggttccaaactacaatctcatcattatggacgaggcccatttcaccgatcctgcaagcatcgccgctcgggggtacatatccacccgagtcggaatgggcgaagcggccgcaatttttatgactgctacacccccaggcaccgccgacgcattccctcagtcaaacgcccccatccaggacgaggagagagatattccagaacgcagttggaatagcgggaacgagtggatcacagactttgctggaaaaactgtgtggttcgtgccgtctataaaggccggtaatgatattgcgaactgtttaaggaaaaacggcaagaaggtcatccagctgtcccgtaaaacgtttgacaccgaatatcaaaagacaaaacttaatgattgggacttcgtagtgactaccgatatctcagagatgggggcaaactttaaggccgaccgggttattgatcctagaaggtgcctgaaacccgtgatcctcacagacggaccagagcgcgtcattttggctggccccatgcctgtgaccgccgctagtgcagcccagcgaagaggtcgggttgggaggaatccacagaaggaaaacgatcagtacatattcactggccaacccctgaataacgacgaggaccacgctcattggacggaagccaagatgctcctggataatatcaacacccctgagggaattatcccggcacttttcgaaccagagcgcgagaaaagcgcggccatcgacggcgaatatcgtctaaagggggagtccagaaaaacatttgtggaactgatgcggaggggagatttgcccgtctggttagctcacaaggtggcctctgagggtattaaatacactgaccgcaagtggtgcttcgatggccagcgaaataaccagatactggaagagaatatggacgtagagatctggaccaaagaaggggagaagaagaaactcagacctcggtggctggatgcaaggacatattcggacccccttgctctgaaggaatttaaagatttcgccgcaggacgcaagagcattgccctcgacttggtgaccgagatcggcagagttccatcacacctggctcataggactcggaacgcgctagataatctggtcatgctccacacatccgaacatggtgggaaagcctaccgtcacgcagtggaggagcttcctgaaacgatggagaccctgttattgctgggcctcatgattctgcttactggaggcgctatgctgtttctcatcagtgggaagggaataggtaagacatctatcggcttgatttgtgtgatcgccagctccgggatgctgtggattgccgaaatccccttacagtggatagcatcagctattgtcctagagttctttatgatggttctgctcatcccagagcctgaaaaacaacgcaccccgcaggacaaccagcttgcctatgtggtaattggaatcctgaccttggcggctataatcgccgcaaatgagatgggcctgctcgaaacaactaagcgagatctgggtatgtctaaagagcccggggtggtcagcccaacgagttaccttgacgtggacctccaccctgcctccgcttggaccctgtacgcagttgccacaactgtgattacccccatgttgagacatacaatcgaaaacagcaccgcgaatgtctctctggctgccattgcaaaccaagccgtagtgttaatgggcctagataagggatggccaatctcaaaaatggacctgggcgttcctctccttgctctggggtgctattcccaggtgaaccccttgactctgacggccgcagtcctcctgcttataacacactacgctattatcggaccgggcttacaggccaaggcgaccagggaggcccagaagcggactgcagctggtatcatgaaaaatccaaccgtggatgggattatgacaatcgacctggatcctgtcatatatgacagtaagttcgagaaacaactcggacaggtgatgttgctggttctatgtgccgtgcagctgctccttatgcgcactagctgggcactgtgcgaagctttgaccctggccacaggccccattacgaccctctgggagggttcgccaggcaagttttggaacactacaatcgccgtatctatggcgaatattttcagagggtcctacctggctggagcaggcttagcctttagcatcatgaaatcagtggggaccggaaagaggggcactggtagtcagggggaaacacttggagagaagtggaaacggaagctgaaccaactctctcgaaaagaattcgatctatataagaaatccggcataaccgaggtcgacagaacggaggctaaggaaggtctgaaacgcggcgagatcacccatcacgccgttagcagggggtcagcaaagttgcagtggtttgtggaacggaatatggtcattcccgagggacgtgtgatcgatctgggctgtgggagaggaggctggagttactattgcgccggtctcaagaaagtaacagaagtgagggggtacactaagggaggccctggccatgaggagccggttcccatgagcacctacgggtggaacattgtgaaacttatgtccggaaaggacgtcttctatctgccacctgaaaaatgtgatacattgctgtgcgacatcggtgagtctagcccctcccctactgtggaagagtcacgcaccattcgggtcctcaagatggtggagccatggttaaagaataaccagttctgtatcaaagttctgaatccctacatgcctacagtaatagaacaccttgagcgactgcagagaaagcacggcgggatgctagtgaggaacccactctctcgcaatagtacccatgaaatgtattggatttcgaacggaactggcaatatcgtcgctagcgtgaacatggtttcccggctgttgctgaatagatttacgatgacacaccgtaggcccaccatcgagaaagatgtggacctcggtgcggggactcggcatgtcaacgccgaaccggagacccctaacatggacgtgattggagagcgcataaagcgaatcaaagaagagcacaattctacatggcactacgatgacgaaaacccatataagacgtgggcataccatggctcatatgaggtaaaggctaccggcagcgcctccagtatgattaatggggtggttaaacttctgactaagccctgggatgtcgtgcctatggtgacacaaatggcaatgaccgacactacaccattcggacagcagagagtctttaaagaaaaggttgataccaggacaccccggtctatgccgggtactcgcagagtgatgggcatcaccgccgagtggttatggaggacgctggggcgaaacaaaaagcctcggttgtgcacccgtgaggaattcacaaagaaagtaagaactaatgctgccatgggagcggtgtttaccgaggaaaaccaatgggacagcgcaaaggccgctgtcgaggatgaagacttctggaaactcgtggatcgcgagagggagctgcacaagctaggcaaatgtggttcatgcgtttacaatatgatggggaagcgggaaaaaaagcttggagagtttggcaaggccaaaggctccagagcaatttggtacatgtggctgggggctcgctatctcgaattcgaggccctgggatttttgaacgaggaccattggttcagtagggaaaatagctactctggtgtggagggcgaagggctgcacaagctcggatatatccttcgagatatatccaaaatccccggcggtgctatgtacgccgacgacacagcagggtgggatactcggattaccgaggacgatctgcataacgaagagaagatcacgcagcagatggacccagagcacagacagttagcgaatgccatttttaaactgacatatcaaaacaaggtcgtgaaggtacagaggcctacccccactggaacagttatggatatcatatcacgcaaagaccagcgtggcagcggccaggtggggacctacggattgaatactttcaccaacatggaagctcaactcattcggcagatggagggtgaaggcgtcctgtcgaaggccgatctagagaatccacacctttctgaaaaaaagatcacacagtggctggagacgaaaggggtggagagactcaagaggatggcaatcagtggagacgattgcgtggtcaagcccattgacgatcgctttgctaacgccctgttggcattaaacgacatgggcaaagttcgaaaggatatacctcagtggcaaccatccaaaggttggcatgactggcagcaggtgccgttctgtagccaccatttccacgaactgatcatgaaggacgggcggaaactcgtagtgccctgcagacctcaggatgagcttattggaagggcccgcatctcacaaggcgcgggctggtccctgagagaaaccgcttgtctagggaaggcctatgcacagatgtggtctctgatgtactttcaccggagggacctccgtttggccagcaatgctatttgcagtgccgtcccagtgcattgggttcccacttcccgaacaacctggagcatccacgcacatcaccagtggatgactacagaggatatgctgaccgtgtggaaccgcgtctggatagaagacaatccttggatggaggataagacgccagtgacaacctgggagaacgtaccctaccttggaaaaagagaagaccaatggtgtggttctctgatcggcctcacttcacgggctacctgggcccagaatattcctacagcgatccagcaggttaggagtttaattgggaacgaggaattcctggattatatgccgtccatgaagcgctttagaaaagaggaggaaagcgagggagctatctggtga

SEQ ID NO: 15438 - RNA, 9873 nt, synthetic construct
  misc_feature 1..9873: note = derived and/or modified CDS sequence (opt3) from DENV-3__FJ182008__SS-prME
  source 1..9873: mol_type = other RNA
accagcctgtgcatcatgatgattctccccgccgctcttgcattccacctgacatccagagacggcgagcctaggatgatagtggggaagaacgaacggggaaaatctttgttatttaagactgcctcaggtatcaatatgtgtacgctgattgcgatggatctaggcgagatgtgcgacgataccgtcacatacaaatgtccacatatcactgaagttgagccggaagacattgattgctggtgtaacctcaccagtacatgggtgacctatgggacttgcaatcaggctggagagcaccgccgagacaagcgtagcgtagccctggcaccccatgtgggcatgggtcttgatacaagaacccaaacgtggatgtccgccgagggggcttggaggcaggtcgaaaaagtggagacttgggcactgcggcaccctggattcaccatcttggccctctttctggctcattacataggcacatctctgactcagaaggttgtgatcttcattctcttaatgctggtcaccccatcgatgacaatgcgctgtgtgggcgtagggaacagagactttgttgaaggactttcaggtgccacctgggtggatgtcgtgttggagcacggcgggtgcgtgacgactatggcgaagaataaacccacactggacatcgagctacagaagaccgaagcaactcaactcgccacactgaggaaactttgtattgagggaaagatcaccaacataacgaccgatagccggtgccctacacagggcgaagctgtcctgccagaggaacaggaccagaattatgtttgtaaacacacttacgtggatcgcggttgggggaacggatgcggcttgttcggcaaggggagtctcgtaacctgcgccaagtttcaatgtctggagcccattgagggaaaagtggtccagtatgaaaatttaaagtacacagtgatcattactgttcataccggtgaccagcaccaggtgggcaacgagacacaaggggtcaccgcagaaatcactcctcaggcttccacgacagaggccatcctgccagaatatggaaccctcggccttgagtgctctccgcgaactggtctggacttcaatgagatgattttgctaaccatgaaaaacaaggcgtggatggtgcatagacagtggtttttcgatctgcccctcccttggacaagcggggccaccactgaaacaccaacgtggaataggaaagagctgcttgtaacctttaagaacgcacacgctaaaaagcaagaagttgtggtcctgggctcccaggagggagccatgcacactgctttgacaggcgccaccgaaatacagaattcagggggaacaagtatcttcgcaggtcatctcaagtgtcggctgaaaatggacaagttagagctgaaaggcatgagctacgccatgtgcactaacacctttgtgctaaagaaagaggtctctgaaacgcagcacgggaccattctcatcaaggtggagtacaagggagaagatgctccctgtaaaatacctttctccacagaggacggccaaggtaaggcgcataacgggcgtctgattactgcaaatccagttgtgaccaaaaaggaggaacccgtaaacatcgaggccgaaccgcctttcggcgagtcaaatatcgtcattggaatcggcgataacgctcttaaaattaattggtataagaaggggagcagtataggaaaaatgtttgaagccacagcacgcggtgccagaaggatggctatcttgggcgacactgcctgggatttcgggtctgtgggaggcgttctgaactccctcggtaagatggtgcaccagatttttgggagcgcatacaccgcgctgttctcgggcgtctcttgggtgatgaaaatcggaatcggcgtacttctgacgtggattgggttgaattccaagaacacatcaatgagttttagctgcatagctatcggagtgattaccctctatctgggcgccgttgtccaggcagacatgggttgtgtgatcaattggaaagggaaggagttaaagtgcggatccggcattttcgtgactaacgaggtccatacatggaccgaacagtacaaatttcaagccgattctcccaagcggctggctactgccatcgcaggtgcttgggagaatggcgtttgtgggatacgaagcaccacacgcatggaaaacctactctggaaacagatcgccaatgagctgaactatattctttgggaaaataacatcaagttgacggtggtggtaggagacattatcggcgtcctggagcaggggaaaagaaccctcactccacagcctatggagctgaagtactcatggaaaacatggggaaaggcgaagatagtgaccgccgaaacacaaaacagttccttcattatcgatggccccaatactccagagtgccccagcgcttctagggcatggaacgtttgggaagtggaggactatggttttggggtcttcaccacgaatatttggttaaaactgcgggaagtgtacacacagctttgtgaccaccgcttgatgtcagccgctgttaaggatgagagagccgtgcacgcagacatgggatactggatcgagagtcagaaaaacggcagctggaagctcgaaaaagcgtccctgatagaggtaaagacctgcacttggcctaagtctcataccctatggtcgaatggtgtcctggaaagcgatatgatcattccaaaatccctcgccggcccgatctcacagcacaactataggcccgggtaccatacacaaactgctggaccttggcacctgggcaagcttgagttggactttaattattgcgaggggaccacagtggtgattacggaaaactgtggaacccgtggcccaagtctgcggactacaaccgtctctggtaaattaatccacgagtggtgctgtcgaagctgcactctcccccctctgagatacatgggggaagatggatgttggtatggcatggagataaggccaatttccgaaaaggaggagaatatggttaaatcacttgtgagcgccggttctggcaaggtagacaacttcacaatgggggtgctgtgcttggcaatcctctttgaagaggtcatgcgcggaaagttcggcaaaaagcatatgatcgctggggtgttctttaccttcgttctgctactgtccggacagattacgtggcgggatatggcccacactctcatcatgattggcagtaatgcaagcgacaaaatgggtatgggggtgacctacctggcccttatagctacatttaagatccagcccttcttggcgctgggatttttcttaagaaaactcacctctagggaaaacctgcttctgggcgtcggcctagccatggcaactacactccaactgccggaggatattgaacagatggctaatgggatcgccttgggactgatggccttaaagctcattacccagtttgagacatatcagctgtggactgctcttatctccctgacctgttcaaacacgatgttcacattgaccgtggcatggcgcactgccaccctcatactggcgggtgttagtctactgcctgtgtgccaaagctcgtccatgcgaaagacagactggcttccaatggctgtcgccgcaatgggcgtaccccctctccccctgtttatcttctctttgaaagatactctgaagcggcgtagctggccattaaatgagggggtgatggccgttggactcgtgtcaattctggctagttcccttctgagaaacgacgtccctatggcaggccccttggtggccggtgggctcctgatcgcgtgttacgtaattaccggaacgtctgctgatctaacagtggaaaaagccgcagacatcacctgggaggaagaggccgaacagactggcgtcagccataacctgatgataacagttgacgatgacggcaccatgaggattaaggatgacgagactgagaatatccttacagtgctcctgaaaaccgctttgttaatcatttccggggtgtttccatactcaataccggccacgctgctcgtctggcacacttggcagaagcagacccaacgcagcggagtgctgtgggatgttcctagtcccccagaaacacagaaagcagagcttgaagagggtgtatatcggatcaagcagcagggcattttcgggaagacccaagtgggagtcggcgtgcagaaagagggtgtttttcatacaatgtggcacgtgactagaggggctgtcctgacctacaacggaaagaggttggaacccaattgggcctctgtgaaaaaggacctaatctcctatggcggcgggtggcgactgagcgcgcagtggcaaaaaggagaggaagtacaggtcattgccgtggagcctggtaagaacccaaagaatttccagacgatgcccggcacattccagactaccacaggggaaatcggagcaatagctctcgattttaaacctggcacctcgggttcaccgatcattaaccgcgaggggaaggttgtgggactgtacggcaatggcgtcgtgactaaaaacgggggatatgtttctggtatcgcccaaaccaatgctgagccagacggccccacacctgaacttgaggaagagatgttcaagaaacggaacttaacgattatggatctgcacccagggagtggaaagactagaaagtacctccccgcaatcgtgagggaagccataaaacgtcgcttgcggaccctgattctcgcccctacaagagtcgtggctgcggagatggaggaagcactgaagggccttccgatcaggtatcagaccactgccacaaaatccgagcataccggtcgagaaatcgtagacctgatgtgccacgctacgtttactatgcggttgctaagccccgtgcgcgttccaaattacaacctgattatcatggatgaggcccatttcacagaccctgcatctatagccgctagagggtacattagcaccagggtcggaatgggcgaagcggccgcaatctttatgaccgctactcccccaggcacagccgatgcattccctcagtccaatgcccccattcaggacgaggagcgggacatcccagaacgatcatggaacagtgggaatgagtggataaccgattttgctggaaagacagtgtggttcgtgccgagcattaaagccggtaacgacatcgcgaactgtctcagaaagaatggcaagaaagtcatccaattatctcgcaagacttttgatacggaatatcagaaaaccaagctgaacgactgggatttcgtagtgacaactgacatttccgagatgggggcaaattttaaagccgatagggttatcgaccctcgtcggtgccttaagcccgtgattctgaccgatggaccagagagagtcatactcgctggccccatgcctgtgacagccgcttcagcagcccagaggcgcggtcgagttgggagaaacccacagaaggaaaatgaccaatacatcttcaccggccagcccttgaacaatgatgaggaccacgctcattggactgaagccaaaatgctgctcgacaacattaatacgcctgagggaatcatcccggcactgttcgaaccagagcgggagaagagtgcggccattgatggcgaatataggcttaaaggggagagccgcaagacctttgtggaactaatgcgtagaggagacctgcccgtctggttggctcacaaagtggcctccgagggtataaagtacacagatcggaaatggtgcttcgacggccagaggaacaatcagatcttagaagagaacatggatgtagagatttggactaaggaaggggagaagaaaaagctgcgccctcgatggctcgacgcaagaacctattctgatcccctggctcttaaagaatttaaggacttcgccgcaggacggaaatcgatcgccctggatctcgtgacagagattggcagggttccaagccacttggctcatcgcaccagaaatgcgctggacaacctagtcatgctgcacacttcagaacatggtgggagggcctaccggcacgcagtggaggagctccctgaaacaatggagacgcttctgttattgggcctgatgatcctcctgaccggaggcgctatgctttttctgatatccgggaagggaatcggtaagactagtattggcctcatctgtgtgattgcctctagcgggatgttgtggatggccgaaatccccctgcaatggatagcatccgctattgtcttagagttctttatgatggttctactgatcccagagcctgaaaaacagcgtacaccgcaggataatcaactcgcctatgtggtaattggaatccttaccctggcggctataatcgccgcaaacgagatgggcttgctggaaaccacaaagcgcgacctcggtatgtcaaaagagcccggggtggtctctccaactagctacctggatgtggaccttcaccctgccagtgcttggacgctctacgcagttgccaccacagtgattactcccatgctgcgacataccatcgaaaattccacagcgaacgtcagcttggctgccattgcaaaccaggccgtagtgctgatgggcttagacaagggatggccaatctctaaaatggatctaggcgttcctctgctcgctcttgggtgctattcacaggtgaatcccctgaccttgactgccgcagtcctgctcctgataacgcactacgctattatcggaccgggccttcaggccaaggcgacaagagaggcccaaaagaggaccgcagctggtatcatgaaaaacccaactgtggacgggattatgaccatcgatttagaccctgtcatatatgattccaagttcgagaaacagctgggacaggtgatgctcttggttctgtgtgccgtgcagctactgctcatgcggacaagttgggcactttgcgaagctctgactttggccaccggccccattacaacgctgtgggagggtagcccaggcaagttttggaataccactatcgccgtatcgatggcgaacattttccgcgggtcttacctcgctggagcaggcctggccttttccatcatgaaaagcgtggggacaggaaagagaggcaccggttcacaaggggaaactttaggagagaagtggaaaaagaaacttaatcagctgagtaggaaggaattcgacctctataaaaagtctggcataacagaggtcgatcggaccgaggctaaagaaggtctaaagcgaggcgagacgacccatcacgccgtttccagagggacagcaaagctgcagtggtttgtggaacgcaacatggtcatccccgagggaagggtgattgacttgggctgtgggcggggaggctggagctactattgcgccggtctgaaaaaggtaactgaagtgcgtgggtacaccaaaggaggccctggccatgaggagccggttcccatgtcaacatacgggtggaatatcgtgaagctcatgagtggaaaagatgtcttctatcttccacctgaaaagtgtgacactctgttgtgcgatattggtgagagctccccctctcctaccgtggaagagagcagaacaatcagggtcctgaagatggtggagccatggctcaaaaacaatcagttctgtattaaggttttaaacccctacatgcctaccgtaatcgaacacctggagcgccttcaacggaaacacggcgggatgctggtgcgaaatccactatccagaaactcaactcatgaaatgtattggatatctaatggaacgggcaacattgtcgctagtgtgaatatggtttcgaggctcctgttgaaccgctttacaatgacccaccggagacccactatcgagaaggacgtggatctgggtgcggggacccgtcatgtcaacgccgaaccggagacacctaatatggacgtgatcggagagaggattaaacggataaaggaagagcacaacagcacgtggcactacgacgatgaaaatccatataagacctgggcataccatggctcctatgaggtaaaagctactggctctgcctcaagcatgatcaacggggtggttaagctccttacaaaaccctgggacgtcgtgcctatggtgacccagatggcaatgactgatacaaccccattcggacagcaacgcgtctttaaggaaaaagttgacacacgaactcccagatccatgccgggtaccaggcgggtgatgggcattacggccgagtggctgtggcgcaccttagggagaaataagaagcctaggctgtgcacacgagaggaattcactaaaaaggtacggaccaacgctgccatgggagcggtgtttacagaggaaaatcagtgggatagtgcaaaagccgctgtcgaggacgaagatttctggaagttggtggaccgtgagagagagctccacaaactgggcaagtgtggttcttgcgtttacaacatgatggggaaacgcgaaaagaagctaggagagtttggcaaagccaagggcagcagggcaatctggtacatgtggcttggggctcggtatctggaattcgaggccctcggatttctgaatgaggatcattggttctcaagagaaaactcctacagtggtgtggagggcgaagggttgcacaaactgggatatattctccgcgacatcagcaagatacccggcggtgctatgtacgccgatgacactgcagggtgggacaccaggatcacggaggatgaccttcataatgaagagaaaattacacagcagatggatccagagcaccgacaactggcgaacgccatctttaagttaacctatcagaataaggtcgtgaaagtacagcggcctactcccacaggaaccgttatggacattatctctagaaaggatcagaggggctccggccaagtggggacttacggactgaacaccttcacaaatatggaagctcagttgatacgccagatggagggtgaaggcgtcctctcaaaagccgacctggagaacccacacctacccgaaaagaaaattacgcagtggcttgagaccaagggggtggagcgtctgcggagaatggcaatcagcggagatgactgcgtggtcaagcctatcgatgacaggtttgctaacgccctcctggcattgaatgatatgggcaaagttcgcaaggacattccacaatggcagccgtcgaaaggttggcatgattggcagcaggtgcccttctgttctcaccatttccacgaattaataatgaaggacgggcgaaaactggtagtgccttgccggccacaagacgagctcatcggaagagccaggattagtcagggcgcgggctggtcccttcgcgaaactgcttgtctggggaaggcctatgcacagatgtggagcctaatgtactttcacagacgggatctgaggctcgcctcaaacgctatctgctccgccgtccccgtgcattgggttcctacatctcgtaccacttggagcattcacgcacatcaccaatggatgacaaccgaggacatgttgacggtgtggaatcgagtctggatcgaagataacccatggatggaggacaagacacccgtgaccacttgggagaatgtaccttacctgggaaaacgcgaagatcagtggtgtggtagtcttataggcctgacctccagagctacatgggcccagaacatcccgactgcgattcagcaagttcggagcctcatcgggaatgaggaattcttagactatatgccatctatgaagaggtttcgcaaagaggaggaatcagagggagctatttggtga

SEQ ID NO: 15439 - RNA, 9873 nt, synthetic construct
  misc_feature 1..9873: note = derived and/or modified CDS sequence (opt3) from DENV-3__FJ182010__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcgtcttactgatgcttgtgactccatcgatgaccatgcgctgtgtaggcgttgggaacagagactttgtggaaggattgtcaggtgcgacatgggtcgatgtggtgctggagcacggcgggtgcgtcaccacgatggcaaagaataaacccactctagacatcgagctccagaagacagaagccacccaactggctactcttaggaaactgtgtattgagggaaagatcacaaacattaccacggatagccggtgccctacccagggcgaagccgttttgccagaggaacaggaccagaattatgtgtgtaaacacacatacgtagatcgcggttgggggaacggatgcggcctcttcggcaaggggagtctggtgacttgcgcaaagtttcaatgtttagagcccatcgagggaaaagtcgtgcagtatgaaaatctgaagtacaccgttataattacagtgcatactggtgaccagcaccaggtcggcaacgagacccaaggggtgacagctgaaatcacccctcaggcctccactacggaggcgattctcccagaatatggaacacttggcctggagtgctctccgcgaaccggtttggacttcaatgagatgatcctactgactatgaaaaacaaggcctggatggtacatagacagtggtttttcgatctccccctgccttggaccagcggggcaacaaccgaaactccaacatggaataggaaagagcttctggttacgtttaagaacgctcacgccaaaaagcaagaagtggtcgtgttgggctcccaggagggagctatgcacaccgccctcactggcgcaacagaaatccagaattcagggggaaccagtattttcgccggtcatctgaagtgtcggttaaaaatggacaagctggagctaaaaggcatgagctacgctatgtgcacaaacacttttgtcctcaagaaagaggtgtctgaaacccagcacgggacgatactgatcaaggttgagtacaagggagaagatgcgccctgtaaaattcctttctccaccgaggacggccaaggtaaggcacataacgggcgtcttatcacagccaatccagtggtaactaaaaaggaggaacccgtcaacatagaggctgaaccgcctttcggcgagtcaaatattgtgatcggaatcggcgataacgccttgaaaattaattggtataagaaggggagcagtatcggaaaaatgtttgaagcaaccgcccgcggtgctagaaggatggccattctgggcgacacagcatgggatttcgggtctgttggaggcgtgctcaactccctgggtaagatggtccaccagatatttgggagcgcgtacactgctcttttctcgggcgtgtcttgggtaatgaaaatcggaattggcgtgctgttgacctggatcgggctcaattccaagaacacgtcaatgagttttagctgcatcgccattggaataatcacactgtatttaggcgcagttgtccaggccgacaccggttgtgtgattaattggaaagggaaggagctgaagtgcggatccggcatcttcgtgactaacgaggtccatacatggaccgaacagtacaaatttcaagctgattctcccaagcggctagccactgcaattgctggtgcctgggagaatggcgtttgtgggatccgaagcaccacacgcatggaaaacctcctgtggaaacaggtggcgaatgagcttaactatatattgtgggaaaataacatcaagctgacggtggtagtcggagacattatcggcgtgctcgagcaggggaaaagaaccctgactccacagcctatggagttaaagtactcatggaaaacatggggaaaggccaagattgttaccgctgaaacacaaaacagttccttcatcatagatggccccaatactccagagtgccccagcgcatctagggcctggaacgtgtgggaagtcgaggactatggttttggggtgttcaccacgaatatttggctgaaacttcgggaagtttacacacagttgtgtgaccaccgcctcatgtcagctgccgtgaaggatgagagagcagtacacgcggacatgggatactggatcgagagtcagaaaaacggcagctggaagctggaaaaagcctccctaattgaggtcaagacctgcacttggcctaagtctcataccctgtggtcgaatggtgtgctcgaaagcgatatgatcataccaaaatccctggctggcccgatctcacagcacaactataggcccgggtaccatacacaaactgccggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagattaggccaatctccgaaaaggaggagaatatggtgaaatcactggtaagcgcaggttctggcaaggtggacaacttcacaatgggggtcttgtgcctcgctatactgtttgaagaggtgatgcgcggaaagttcggcaaaaagcatatgattgccggggttttctttaccttcgtgctactgctctccggacagatcacgtggcgggatatggcacacactctgatcatgattggcagtaatgccagcgacagaatgggtatgggggtcacctaccttgctttgatcgcgacatttaaaattcagcccttcctggccttaggatttttcctcaggaagctgacctctcgcgaaaaccttctgctaggcgtgggcctcgcaatggctactacactgcaattgccggaggatatagaacagatggccaatgggatcgccctgggattaatggctctcaaactgattacccagtttgagacatatcagctttggactgcactgatctccttgacctgttcaaacacgattttcacactcaccgttgcctggcgaactgcgaccctgatcctagctggtgtgagtctgcttcctgtctgccaaagctcgtccatgcggaagtctgactggctcccaatgacagtagccgcaatgggcgtgccccctctgcccttgtttatattcagcctgaaggatactttaaaacgtagatcatggccactcaatgagggggttatggccgtgggactggtcagtatccttgcttcctctctgttgaggaacgacgtgcctatggcaggccccctcgtagccggtgggctgctaattgcgtgttacgtgatcaccggaacgagcgctgatctgacagtcgaaaaggccgcagacgttacctgggaggaagaggccgaacagactggcgtgtcccataaccttatgattacagtggacgatgacggcaccatgcgcatcaaagatgacgagactgagaatatactcacagtcctgttgaagaccgctttactgattgtgtcagggatctttccatacagcatcccggccacgctcctggtttggcacacttggcagaaacagacccggagaagtggagtactttgggatgtgccttctcccccagaaacacaaaaggcagagctggaagagggtgtctataggattaaacagcagggcatattcgggaagacccaggtgggagttggcgtgcaaaaggagggtgtctttcatacaatgtggcacgtgactcgaggggctgtattgacctacaacggaaaacgcctagaacccaattgggcctccgtcaagaaagacctgatcagctatggcggcgggtggcggctctcggcgcagtggcagaagggagaggaagtgcaagttattgccgtggagcctggtaaaaacccaaagaatttccagacgatgcccggcacattccagactaccacaggggaaatcggagcaattgctctggattttaagcctggcacctcaggttctccgatcataaacagagaggggaaagtcgtgggactttacggcaatggcgttgtgactaagaacgggggatatgtcagtggtatcgcccagaccaatgctgagccagacggccccacacctgaattagaggaagagatgttcaaaaagaggaacctgacgattatggatctccacccagggtccggaaaaactcgtaagtacttgcccgcaatcgtgcgcgaagccattaagcggagactgaggaccctcatcctggcccctacacgagtagtggctgcggagatggaggaagcacttaaaggcctgccgatacggtatcaaaccactgccacaaagagcgagcataccggtcgcgaaattgttgacttgatgtgccacgctacgtttactatgagactactgtctcccgtcagggtgccaaattacaacctcatcatcatggatgaggcccatttcacagaccctgcaagcattgccgctcgggggtacatctccacccgagtgggaatgggcgaagcggccgcaatatttatgaccgctactcccccaggcacagccgatgcattccctcagtcaaatgcccccattcaggacgaggagagagacatcccagaacgcagttggaacagcgggaatgagtggattaccgattttgctggaaaaacagtctggttcgtaccgtctatcaaggccggtaacgacatagcgaactgtttaaggaaaaatggcaagaaggtgattcagctgtcccgtaaaacttttgatacggaatatcaaaagaccaaacttaacgactgggatttcgttgtgacaactgacatctcagagatgggggcaaattttaaggccgatcgggtcatcgaccctagaaggtgcctgaaacccgtgattctcaccgatggaccagagcgcgttatcttggctggccccatgcctgtgacagccgctagtgcagcccagcgaagaggtcgggtcgggaggaacccacagaaggaaaatgaccagtacattttcaccggccaacccctgaacaatgatgaggaccacgctcattggactgaagccaagatgctcctggacaacataaatacgcctgagggaatcattccggcacttttcgaaccagagcgcgagaaaagcgcggccatcgatggcgaatatcgtctaaagggggagtccagaaaaacctttgtggaactgatgcggaggggagacttgcccgtatggttagctcacaaggtggcctctgagggtatcaaatacacagatcgcaagtggtgcttcgacggccagcgaaacaatcagattctggaagagaacatggatgttgagatatggactaaagaaggggagaagaagaaactcagacctcggtggctggacgcaaggacctattcggatccccttgctctgaaggaatttaaagacttcgccgcaggacgcaagagcatcgccctcgatttggtcacagagattggcagagtgccatcacacctggctcataggacccggaatgcgctagacaacctggtgatgctccacacttccgaacatggtgggaaagcctaccgtcacgcagtcgaggagcttcctgaaacaatggagacgctgttattgctgggcctcatgatcctgcttaccggaggcgctatgctgtttctcattagtgggaagggaatcggtaagacttctataggcttgatctgtgttattgccagctccgggatgctgtggatggccgaaatccccttacagtggattgcatcagctatcgtgctagagttctttatgatggtactgctcataccagagcctgaaaaacaacgcacaccgcaggataatcagcttgcctatgtggtcattggaatcctgaccttggcggctattatcgccgcaaacgagatgggcctgctcgaaaccacaaagcgagacctgggtatgtctaaagagcccggggtggttagcccaactagttaccttgatgtggacctccaccctgcctccgcttggacgctgtacgcagtcgccaccacagtaataactcccatgttgagacataccatcgaaaatagcacagcgaacgtgtctctggctgccattgcaaaccaagccgttgtgttaatgggcctagacaagggatggccaatctcaaaaatggatctgggcgtccctctccttgctctggggtgctattcccaggtgaatcccttgaccctgactgccgcagtcctcctgcttattacgcactacgctatcataggaccgggcttacaggccaaggcgacaagggaggcccagaagcggaccgcagctggtattatgaaaaacccaactgtggacgggatcatgaccatcgatctggaccctgttatttatgatagtaagttcgagaaacaactcggacaggtgatgttgctggtactatgtgccgtgcagctgctccttatgcgcacaagctgggcactgtgcgaagctttgactctggccaccggccccatcacaacgctctgggagggttcgccaggcaagttttggaataccactatagccgtctctatggcgaacattttcagagggtcctacctggctggagcaggcttagcctttagcatcatgaaatcagttgggacaggaaagaggggcaccggtagtcagggggaaactcttggagagaagtggaaaaagaaactgaatcaactctctcggaaggaattcgacctatataaaaagtccggcattacagaggtggatcgaaccgaggctaaagaaggtctgaagagaggcgagatcacgcatcacgccgtcagccgcgggtcagcaaagttgcagtggtttgtggaaaggaacatggtaatacccgagggacgggtgatcgacctgggctgtgggcgtggaggctggagttactattgcgccggtctcaaaaaggttaccgaagtgagagggtacacaaaaggaggccctggccatgaggagccggtccccatgagcacttacgggtggaatattgtgaagcttatgtccggaaaagatgtcttctatctgccacctgaaaagtgtgacaccttgctgtgcgatatcggtgagtctagcccctcccctacagtggaagagtcaaggactattcgcgttctcaagatggtagagccatggttaaaaaacaatcagttctgtatcaaggtgctgaacccctacatgcctaccgtcattgaacaccttgagcggctgcagcgaaaacacggcgggatgctagtgagaaatccactctctaggaacagtacacatgaaatgtattggatctcgaatggaaccggcaacatagttgctagcgtgaatatggtctcccgcctgttgctgaaccggtttactatgacgcacagacgtcccacaattgagaaggacgtggatctcggtgcggggaccaggcatgtaaacgccgaaccggagactcctaatatggacgtgatcggagagcggatcaaacgcattaaggaagagcacaactctacctggcactacgacgatgaaaatccatataagacatgggcataccatggctcatatgaggttaaagctacgggcagcgcctccagtatgataaacggggtcgtgaagcttctgaccaaaccctgggacgtggtccctatggttactcaaatggcaatgacagataccactccattcggacagcagcgagtgtttaaggaaaaagtagacacaagaacccccaggtctatgccgggtacacggcgcgtgatgggcatcactgccgagtggttatggagaaccctggggaggaataagaagcctcgattgtgcacgcgggaggaattcaccaaaaaggtccgtacaaacgctgccatgggagcggtgtttactgaggaaaatcaatgggatagcgcaaaagccgctgttgaggacgaagatttctggaagctcgtggacagagagcgcgagctgcacaaactaggcaagtgtggttcatgcgtctacaacatgatggggaaaagggaaaagaagcttggagagtttggcaaagccaagggctcccgggcaatttggtacatgtggctgggggctagatatctcgaattcgaggccctgggatttttgaatgaggatcattggttcagtcgcgaaaacagctactctggtgtggagggcgaagggctgcacaaactcggatatatccttagggacatttccaagatccccggcggtgctatgtacgccgatgacaccgcagggtgggacacacgaataactgaggatgacctgcataatgaagagaaaatcacccagcagatggatccagagcaccggcagttagcggacgccatttttaagctgacgtatcaaaacaaggtagttaaagtgcagagacctacacccaccggaactgtcatggatatcatttcaaggaaggaccagcgcggcagcggccaggtggggacatacggattgaataccttcactaacatggaagctcaactcatccgtcagatggagggtgaaggcgtgctgaccaaagccgatctagagaatccacacctttcggaaaagaaaataacacagtggctggagacgaagggggtcgagcggctcaagagaatggcaatttctggagacgattgcgttgtgaaacccatcgacgataggtttgctaacgccctgttggcattaaacgacatgggcaaggtacgcaaagatatccctcagtggcaaccaagtaagggttggcatgactggcagcaggtgccgttctgttcccaccatttccacgaactgattatgaaagacgggcgaaagctcgtcgtgccctgccggcctcaggatgagcttataggaagagccaggatcagccaaggcgcgggctggtcactgcgcgaaaccgcttgtctagggaaggcctatgcacagatgtggtccctgatgtactttcacagacgggacctcaggttggcctctaatgctatttgcagcgccgttccagtgcattgggtccccactagtcgtacaacctggtccatccacgcacatcaccagtggatgactacagaggatatgctgaccgtgtggaaccgagtatggattgaagacaatccttggatggaggataaaacgccagttacaacctgggagaacgtgccctaccttggaaagcgcgaagaccaatggtgtggtagcctgatcggcctcacttctagagctacctgggcccagaatatacctacagcgatccagcaggtccggtcattaattgggaacgaggaattcctggattatatgccgagtatgaaaaggtttcgcaaggaggaggaatccgagggagctatctggtga

SEQ ID NO: 15440 - RNA, 9873 nt, synthetic construct
  misc_feature 1..9873: note = derived and/or modified CDS sequence (opt3) from DENV-3__FJ182011__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgtcaatgagttttagctgcattgccataggaatcattacactgtatttaggcgcagtggttcaggccgacaccggttgtgtcatcaattggaaagggaaggagctgaagtgcggatccggcattttcgtgactaacgaggtgcatacatggaccgaacagtacaaatttcaagctgattctcccaagcggctagccactgcaatcgctggtgcctgggagaatggcgtctgtgggatacgaagcaccacacgcatggaaaacctcctgtggaaacagatcgcgaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggccaagatagtcaccgctgaaacacaaaacagttccttcattatcgatggccccaatactccagagtgccccagcgcatctagggcctggaacgtgtgggaagttgaggactatggttttggggtgttcaccacgaatatttggctgaaacttcgggaagtctacacacagttgtgtgaccaccgcctcatgtcagctgccgtgaaggatgagagagcagttcacgcggacatgggatactggatcgagagtcagaaaaacggcagctggaagctggaaaaagcctccctaatagaggtgaagacctgcacttggcctaagtctcataccctgtggtcgaatggtgtactcgaaagcgatatgatcattccaaaatccctggctggcccgatctcacagcacaactataggcccgggtaccatacacaaactgccggaccttggcaccttggcaagttggagctggactttaattattgcgaggggaccacagtcgtgattacggataactgtggaacccgtggcccaagtttacggactacaaccgtgtctggtaaactcatccacgaatggtgctgtcgaagctgcactctgccccctcttagatacatgggggaggacggatgttggtatggcatggaaataaggccaatttccgagaaggaagagaatatggtcaaatcactggttagcgcaggttctggcaaggtggataacttcacaatgggggtattgtgcctcgctatcctgtttgaggaagtgatgcgcggaaagttcggcaaaaagcatatgatcgccggggtcttctttaccttcgtgctactgctctccggacagattacgtggcgggacatggcacacactctgatcatgattggcagtaatgccagcgatagaatgggtatgggggttacctaccttgctttgatagcgacatttaaaatccagcccttcctggccttaggatttttcctcaggaagctgacctctcgcgagaaccttctgctaggcgtgggcctcgcaatggctactacactgcaattgccggaagacattgagcagatggccaatgggatcgccctgggattaatggctctcaaactgattacccagtttgaaacatatcagctttggactgcactgatctccttgacctgttcaaacacgatattcacactcaccgtcgcctggcgaactgcgaccctgatcctagctggtgtgagtctgcttcctgtttgccaaagctcgtccatgcggaagtctgattggctcccaatgacagtggccgcaatgggcgtcccccctctgcccttgtttattttcagcctgaaggacactttaaaacgtagatcatggccactcaatgagggggtaatggccgtgggactggttagtatccttgcttcctctctgttgaggaacgatgtgcctatggcaggccccctcgtcgccggtgggctgctaattgcgtgttacgtgatcaccggaacgagcgctgacctgacagtagagaaggccgcagacgtgacctgggaagaggaagccgagcagactggcgtctcccataaccttatgataacagttgatgacgatggcaccatgcgcattaaagacgatgaaactgagaatatcctcacagtgctgttgaagaccgctttactgatcgtgtcagggatttttccatacagcataccggccacgctcctggtctggcacacttggcagaaacagacccggagaagtggagtgctttgggacgttccttctcccccagagacacaaaaggcagaactggaggaaggtgtatataggatcaaacagcagggcattttcgggaagacccaggtgggagtcggcgtgcaaaaggagggtgtttttcatacaatgtggcacgtgactcgaggggctgtcttgacctacaacggaaaacgcctagagcccaattgggcctccgtgaagaaagatctgatcagctatggcggcgggtggcggctctcggcgcagtggcagaagggagaagaggtacaagtcattgccgtggaacctggtaaaaacccaaagaatttccagacgatgcccggcacattccagactaccacaggggagatcggagcaatagctctggactttaagcctggcacctcaggttctccgatcattaacagagaagggaaagttgtgggactttacggcaatggcgtcgtgactaagaacgggggatatgttagtggtatcgcccagaccaatgctgagccagatggccccacacctgagttagaagaggaaatgttcaaaaagaggaacctgacgattatggacctccacccagggtccggaaaaactcgtaagtacttgcccgcaatcgtgcgcgaggccataaagcggagactgaggaccctcattctggcccctacacgagtcgtggctgcggaaatggaggaggcacttaaaggcctgccgatccggtatcaaaccactgccacaaagagcgaacataccggtcgcgagatcgtagatttgatgtgccacgctacgtttactatgagactactgtctcccgtgagggttccaaattacaacctcattatcatggacgaagcccatttcacagatcctgcaagcatagccgctcgggggtacatttccacccgagtcggaatgggcgaggcggccgcaatctttatgaccgctactcccccaggcacagccgacgcattccctcagtcaaatgcccccattcaggacgaagagagagatatcccagagcgcagttggaacagcgggaatgaatggataaccgactttgctggaaaaacagtgtggttcgtgccgtctattaaggccggtaacgatatcgcgaactgtttaaggaaaaatggcaagaaggtcatccagctgtcccgtaaaacttttgacacggagtatcaaaagaccaaacttaacgattgggacttcgtagtgacaactgatatttcagaaatgggggcaaattttaaggccgaccgggttatcgatcctagaaggtgcctgaaacccgtgattctcaccgacggaccagagcgcgtcatattggctggccccatgcctgtgacagccgctagtgcagcccagcgaagaggtcgggttgggaggaacccacagaaggagaatgatcagtacatcttcaccggccaacccctgaacaatgacgaagaccacgctcattggactgaggccaagatgctcctggataacattaatacgcctgaaggaatcatcccggcacttttcgagccagaacgcgagaaaagcgcggccattgacggcgagtatcgtctaaagggggaatccagaaaaacctttgtggagctgatgcggaggggagatttgcccgtctggttagctcacaaggtggcctctgaaggtataaaatacacagaccgcaagtggtgcttcgatggccagcgaaacaatcagatcctggaggaaaacatggacgtagagatttggactaaagagggggaaaagaagaaactcagacctcggtggctggatgcaaggacctattcggacccccttgctctgaaggagtttaaagatttcgccgcaggacgcaagagcatcgccctcgacttggtgacagaaattggcagagttccatcacacctggctcataggacccggaatgcgctagataacctggtcatgctccacacttccgagcatggtgggaaagcctaccgtcacgcagtggaagagcttcctgagacaatggaaacgctgttattgctgggcctcatgatcctgcttaccggaggcgctatgctgtttctcataagtgggaagggaatcggtaagacttctattggcttgatctgtgtgattgccagctccgggatgctgtggatggccgagatccccttacagtggatagcatcagctattgtcctagaattctttatgatggttctgctcatcccagagcctgagaaacaacgcacaccgcaggacaatcagcttgcctatgtggtaattggaatcctgaccttggcggctataatcgccgcaaacgaaatgggcctgctcgagaccacaaagcgagatctgggtatgtctaaagaacccggggtggtcagcccaactagttaccttgacgtggacctccaccctgcctccgcttggacgctgtacgcagttgccaccacagtgattactcccatgttgagacataccatcgagaatagcacagcgaacgtctctctggctgccattgcaaaccaagccgtagtgttaatgggcctagataagggatggccaatctcaaaaatggacctgggcgttcctctccttgctctggggtgctattcccaggtgaatcccttgaccctgactgccgcagtcctcctgcttataacgcactacgctattatcggaccgggcttacaggccaaggcgacaagggaagcccagaagcggaccgcagctggtatcatgaaaaacccaactgtggatgggattatgaccatcgacctggatcctgtcatatatgacagtaagttcgagaaacaactcggacaggtgatgttgctggttctatgtgccgtgcagctgctccttatgcgcacaagctgggcactgtgcgaggctttgactctggccaccggccccattacaacgctctgggaaggttcgccaggcaagttttggaataccactatcgccgtatctatggcgaacattttcagagggtcctacctggctggagcaggcttagcctttagcatcatgaaatcagtggggacaggaaagaggggcaccggtagtcagggggagactcttggagaaaagtggaaaaagaaactgaatcaactctctcggaaggagttcgatctatataaaaagtccggcataacagaagtcgaccgaaccgaggctaaagagggtctgaagagaggcgaaatcacgcatcacgccgttagccgcgggtcagcaaagttgcagtggtttgtggagaggaacatggtcattcccgaaggacgggtgatcgatctgggctgtgggcgtggaggctggagttactattgcgccggtctcaaaaaggtaaccgaggtgagagggtacacaaaaggaggccctggccatgaagagccggttcccatgagcacttacgggtggaatattgtgaagcttatgtccggaaaagacgtcttctatctgccacctgagaagtgtgataccttgctgtgcgacatcggtgaatctagcccctcccctacagtggaggaatcaaggactattcgcgtcctcaagatggtggagccatggttaaaaaacaatcagttctgtatcaaggttctgaacccctacatgcctaccgtaatagagcaccttgaacggctgcagcgaaaacacggcgggatgctagtgagaaatccactctctaggaacagtacacatgagatgtattggatttcgaatggaaccggcaacatcgtcgctagcgtgaatatggtttcccgcctgttgctgaaccggtttactatgacgcacagacgtcccacaatcgaaaaggatgtggacctcggtgcggggaccaggcatgtcaacgccgagccggaaactcctaatatggacgtgattggagagcggataaaacgcatcaaggaggaacacaactctacctggcactacgatgacgagaatccatataagacatgggcataccatggctcatatgaagtaaaagctacgggcagcgcctccagtatgattaacggggtggttaagcttctgaccaaaccctgggatgtcgtgcctatggtgactcaaatggcaatgacagacaccactccattcggacagcagcgagtctttaaggagaaagttgatacaagaacccccaggtctatgccgggtacacggcgcgtgatgggcatcactgccgaatggttatggagaaccctggggaggaataagaagcctcgattgtgcacgcgggaggagttcaccaaaaaggtacgtacaaacgctgccatgggagcggtgtttactgaagagaatcaatgggacagcgcaaaagccgctgtcgaagatgaggacttctggaagctcgtggatagagaacgcgagctgcacaaactaggcaagtgtggttcatgcgtttacaacatgatggggaaaagggagaagaagcttggagaatttggcaaagccaagggctcccgggcaatttggtacatgtggctgggggctagatatctcgagttcgaagccctgggatttttgaatgaggaccattggttcagtcgcgagaacagctactctggtgtggaaggcgaggggctgcacaaactcggatatatccttagggatatatccaagatccccggcggtgctatgtacgccgacgacaccgcagggtgggatacacgaattactgaagacgatctgcataatgaggaaaaaatcacccaccagatggacccagagcaccggcagttagcgaacgccatttttaagctgacgtatcagaataaggtcgtgaaagtacaaagacctacacccaccggaactgttatggatatcatatcaaggaaggaccagcgcggcagcggccaggtggggacatacggattgaacaccttcactaatatggaggctcagctcattcgtcaaatggaaggtgagggcgtcctgtcgaaagccgatctagaaaacccacatctttctgagaagaaaatcacccagtggctggaaacaaagggggtggagcggctcaagagaatggcaatcagtggagacgattgcgtggtcaaacccattgacgataggtttgctaacgccctgttggcattaaatgacatgggcaaggttcgcaaagatatacctcagtggcagccatccaagggttggcacgactggcaacaggtgccgttctgtagccatcacttccacgagctgatcatgaaagacgggcgaaagctcgtagtgccctgccggcctcaggatgaacttattggaagagccaggatctcacagggcgcgggctggtccctgcgcgagacggcttgtctagggaaggcctatgcacaaatgtggtctctgatgtactttcatagacgggacctcaggttggccagcaacgctatttgcagtgccgtcccagtgcactgggttcccacctcccgtactacatggagcatccatgcacaccatcagtggatgaccactgaagatatgctgacagtgtggaatcgagtctggatagaggacaacccttggatggaagataaaaccccagtgacgacatgggagaatgtaccctaccttggaaagcgcgaggaccagtggtgtggttctctgatcggcctcacctcaagagctacttgggcccaaaacattcctaccgcgatccagcaggttcggagtttaattgggaatgaagagttcctggattatatgccgtccatgaaaaggtttcgcaaggaagaggagagcgaaggagctatctggtga

SEQ ID NO: 15441 - RNA, 9873 nt, synthetic construct
  misc_feature 1..9873: note = derived and/or modified CDS sequence (opt3) from DENV-3__FJ182038__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccacgcttttctcgggcgtctcttgggtgatgaaaattggaatcggcgtactgttgacatggatcgggctcaattccaagaacacctcaatgagttttagctgcattgcgataggagtgatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcaaggtagacaacttcaccatgggggtgttgtgcctcgccattctgtttgaagaggtcatgcgcggaaagttcggcaaaaagcatatgatcgcaggggtgttctttacgttcgttctactgctctccggacagatcacttggcgggatatggctcacaccctgattatgatcggcagtaatgccagcgacaaaatgggtatgggggtgacataccttgcattgattgccacctttaagatacagcccttcctggctttaggatttttcctcagaaaactgacttctagggaaaaccttctgctaggcgtcggcctcgcgatggccacaaccctgcaattgccggaggatatcgaacagatggcaaatgggattgctctgggattaatggccctcaagctgatcacacagtttgagacttatcagctttggaccgccctgatttccttgacgtgttcaaacacaatgttcaccctcactgtggcttggcgcaccgcaacactgatcctagccggtgttagtctgcttcctgtgtgccaaagctcgtccatgcgaaagactgactggctcccaatggcggtcgctgccatgggcgtaccccctctgcccttgtttatattctctctgaaagataccttaaagcggcgtagctggccactcaatgagggggtgatggcagttggactggtgtcaatccttgccagttccctgttgagaaacgacgtccctatggctggccccctcgtggcaggtgggctgctaattgcctgttacgtaatcacgggaacatctgcggatctgaccgtggaaaaagctgccgacattacttgggaggaagaggcagaacagacaggcgtcagccataaccttatgatcaccgttgacgatgacggcactatgaggataaaggatgacgagacagagaatattctcaccgtgctgttgaaaacggccttactgatcgtgtccggggtctttccatactcaatcccggctactctcctggtgtggcacacctggcagaagcagacacaacgcagcggagttctttgggatgtacctagtcccccagaaacccagaaagccgagctggaagagggtgtgtatcggattaagcagcagggcatattcgggaagacacaagtcggagtgggcgttcagaaagagggtgtgtttcatactatgtggcacgtcaccagaggggcagtgttgacgtacaacggaaagaggctagaacccaattgggcttctgtaaaaaaggacctgatctcctatggcggcgggtggcgactcagcgcccagtggcaaaaaggagaggaagtccaggtgattgcggttgagcctggtaagaacccaaagaatttccagacaatgcccggcactttccagaccacaaccggggaaatcggagccattgcactggattttaaacctggcacttcgggttcaccgatcataaaccgcgaggggaaggtggtcggactttacggcaatggcgtggttaccaaaaacgggggatatgtgtctggtatcgctcaaacaaatgccgagccagacggccccacgcctgaattagaggaagagatgttcaagaaacggaacctgactattatggatctccacccagggagtggaaagaccagaaagtacttgcccgctatcgtcagggaagcaattaaacgtcgcctgcggacactcatcctggcccctaccagagtggtagccgctgagatggaggaagcgcttaagggcctgccgataaggtatcagactacagcaaccaaatccgagcatacgggtcgagaaattgtggacttgatgtgccacgccacttttacaatgcggctactgagccccgttcgcgtcccaaattacaacctcatcatcatggatgaggctcatttcaccgaccctgcctctattgcagccagagggtacatcagcaccagggtgggaatgggcgaagctgcggccatatttatgactgcaacacccccaggcaccgctgatgccttccctcagtccaatgcacccattcaggacgaggagcgggacatcccagaacgatcatggaacagtgggaatgagtggattacagattttgccggaaagactgtgtggttcgtcccgagcatcaaagctggtaacgacatagccaactgtttaagaaagaatggcaagaaagtaattcaactgtctcgcaagacgtttgataccgaatatcagaaaacaaagcttaacgactgggatttcgtggttactaccgacatctccgagatgggggcgaattttaaagcagatagggtgatcgaccctcgtcggtgcctgaagcccgtcattctcacagatggaccagagagagtgatcttggccggccccatgcctgttaccgctgcctcagctgcacagaggcgcggtcgagtggggagaaacccacagaaggaaaatgaccaatacattttcatgggccagcccctgaacaatgatgaggaccacgcccattggactgaagctaaaatgctcctggacaacataaatacgcctgagggaatcattccggcccttttcgaaccagagcgggagaagagtgcagcgatcgatggcgaatataggctaaaaggggagagccgcaagacctttgtcgaactgatgcgtagaggagacttgcccgtgtggttagcccacaaagtagcttccgagggtatcaagtacacagatcggaaatggtgcttcgacggccagaggaacaatcagattctggaagagaacatggatgtggagatatggactaaggaaggggagaagaaaaagctccgccctcgatggctggacgccagaacctattctgatccccttgcactgaaagaatttaaggacttcgctgccggacggaaatcgatcgcactcgatttggttacagagattggcagggtcccaagccacctggcccatcgcaccagaaatgctctagacaacctggtgatgctccacacttcagaacatggtgggagggcgtaccggcacgccgtggaggagcttcctgaaacaatggagacgctgttattgctgggcctcatgatcctgcttaccggaggcgcaatgctgtttctcatttccgggaagggaatcggtaagactagtataggcttgatctgtgtcattgcttctagcgggatgctgtggatggccgaaatccccttacaatggattgcctccgcaatcgttctagagttctttatgatggtgctgctcataccagagcctgaaaaacagcgtacaccgcaggataatcaacttgcttatgtagtgattggaatcctgaccttggccgcgaccattgctgccaacgagatgggcctgctcgaaacaactaagcgcgacctgggtatgtcaaaagagcccggggtcgtgtctccaacgagctaccttgatgttgacctccaccctgcaagtgcctggaccctgtacgctgtggcaacaactgtcatcacccccatgttgcgacatacaatagaaaattccaccgccaacgtaagcctggcggctatcgccaaccaggcagtggttttaatgggcctagacaagggatggccaatttctaaaatggatctgggcgtgcctctccttgccctggggtgctattcacaggtcaatcccttgactctgacggctgccgtgctcctgcttatcacacactacgcaattatcggaccgggcttacaggctaaggccaccagagaggcgcaaaagaggactgccgcaggtataatgaaaaacccaaccgtcgacgggattatgacaatcgatctggaccctgtgatctatgattccaagttcgagaaacagctcggacaggttatgttgctggtgctatgtgctgtacagctgctccttatgcggactagttgggccctgtgcgaagcattgaccctggctacaggccccattacgaccctctgggagggtagcccaggcaagttttggaatactacaatcgccgtgtcgatggccaacatattccgcgggtcttacctggcgggagctggcttagcattttccattatgaaaagcgtcgggaccggaaagagaggcactggttcacaaggggaaacacttggagagaagtggaaaaagaaactgaatcagctcagtaggaaggaattcgacctatataaaaagtctggcatcaccgaggttgatcggacggaggccaaagaaggtctgaagcgaggcgagaccacacatcacgctgtgtccagagggactgccaagttgcagtggtttgtcgaacgcaacatggtgattcccgagggaagggtaatcgacctgggctgtgggcggggaggctggagctactattgcgcaggtctcaaaaaggtgaccgaagttcgtgggtacacaaaaggaggccctggccatgaggagccggtgcccatgtcaacttacgggtggaatatagtcaagcttatgagtggaaaagatgtgttctatctgccacctgaaaagtgtgacaccttgctgtgcgatatcggtgagagctccccctctcctacagtcgaagagagcagaaccattagggtgctcaagatggttgagccatggttaaaaaacaatcagttctgtatcaaggtactgaacccctacatgcctactgtgattgaacaccttgagcgcctgcaacggaaacacggcgggatgctagtccgaaatccactctccagaaactcaacgcatgaaatgtattggatctctaatggaacaggcaacattgtggccagtgttaatatggtgtcgaggctgttgctgaaccgctttaccatgactcaccggagacccaccatcgagaaggacgtcgatctcggtgctgggacacgtcatgtgaacgcggaaccggagacgcctaatatggacgtaataggagagaggattaaacggatcaaggaagagcacaacagcacctggcactacgacgatgaaaatccatataagacttgggcctaccatggctcctatgaggtgaaagcaacaggctctgcttcaagcatgatcaacggggttgtcaagcttctgaccaaaccctgggacgtggtgcctatggtcactcagatggccatgacagataccacaccattcggacagcaacgcgtttttaaggaaaaagtggacactcgaacccccagatccatgccgggtacgaggcgggtaatgggcattaccgcagagtggttatggcgcacactggggagaaataagaagcctaggttgtgcactcgagaggaattcaccaaaaaggtgcggacaaacgccgctatgggagccgtctttactgaggaaaatcagtgggatagtgcgaaagcagccgtggaggacgaagatttctggaagctcgttgaccgtgagagagagctgcacaaactaggcaagtgtggttcttgcgtgtacaacatgatggggaaacgcgaaaagaagcttggagagtttggcaaagctaagggcagcagggccatatggtacatgtggctgggggcacggtatctcgaattcgaggctctgggatttttgaatgaggatcattggttctcaagagaaaactcctacagtggtgtcgagggcgaagggctgcacaaactcggatatatccttcgcgacattagcaagatccccggcggtgccatgtacgctgatgacaccgccgggtgggacacgaggattacagaggatgacctgcataatgaagagaaaatcacccagcagatggatccagagcaccgacaattagcaaacgcgatatttaagctgacttatcagaataaggtggtaaaagttcagcggcctacacccaccggaactgtgatggacatcatttctagaaaggatcagaggggctccggccaagtcgggacctacggattgaacacattcacgaatatggaagcccagctcatccgccagatggagggtgaaggcgtgctgtcaaaagctgacctagagaacccacaccttcccgaaaagaaaattacccagtggctggagactaagggggtggagcgtctccggagaatggccatcagcggagatgactgcgtcgttaagcctatagatgacaggtttgcaaacgctctgttggccttaaatgatatgggcaaagtgcgcaaggacattccacaatggcagccgtcgaaaggttggcatgattggcagcaggtacccttctgttctcaccatttccacgaactgatcatgaaggacgggcgaaaactcgtggtcccttgccggccacaagacgagcttatcggaagagcaaggattagtcagggcgccggctggtccctgcgcgaaacagcgtgtctagggaaggcttatgcccagatgtggagcctgatgtactttcacagacgggatctcaggttggcatcaaacgccatatgctccgctgtgcccgttcattgggtgcctacctctcgtactacatggagcatccacgcccatcaccaatggatgaccacggaggacatgctgacagtctggaatcgagtgtggattgaagataacccatggatggaggacaagacccccgtaactacctgggagaatgttccttaccttggaaaacgcgaagatcagtggtgtggtagtctgatcggcctcacatccagagcaacttgggctcagaacattccgaccgccatccagcaagtgcggagcttaatagggaatgaggaattcctggactatatgccatctatgaagaggtttcgcaaagaggaggaatcagagggagcgatctggtga

SEQ ID NO: 15442 - RNA, 9873 nt, synthetic construct
  misc_feature 1..9873: note = derived and/or modified CDS sequence (opt3) from DENV-3__FJ182041__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacaccggttgtgtgatcaattggaaagggaaggagctgaagtgcggatccggcattttcgtgactaacgaggtccatacatggaccgaacagtacaaatttcaagccgattctcccaagcggctagctactgccatcgcaggtgcttgggagaatggcgtttgtgggatacgaagcaccacacgcatggaaaacctcctgtggaaacagatcgccaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggcgaagatagtgaccgccgaaacacaaaacagttccttcattatcgatggccccaatactccagagtgccccagcgcttctagggcatggaacgtttgggaagtggaggactatggttttggggtcttcaccacgaatatttggctgaaacttcgggaagtgtacacacagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacctgcacttggcctaagtctcataccctgtggtcgaatggtgtcctcgaaagcgatatgatcattccaaaatccctggccggcccgatctcacagcacaactataggcccgggtaccatacacaaactgctggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgccggttctggcaaggtagacaacttcacaatgggggtgttgtgcctcgcaatcctgtttgaagaggtcatgcgcggaaagttcggcaaaaagcatatgatcgctggggtgttctttaccttcgttctactgctctccggacagattacgtggcgggatatggcccacactctgatcatgattggcagtaatgcaagcgacagaatgggtatgggggtgacctaccttgccttgatagctacatttaaaatccagcccttcctggcgttaggatttttcctcaggaagctgacctctcgcgaaaaccttctgctaggcgtcggcctcgccatggcaactacactgcaattgccggaggatattgaacagatggctaatgggatcgccctgggattaatggccctcaaactgattacccagtttgagacatatcagctttggactgctctgatctccttgacctgttcaaacacgatattcacactcaccgtggcatggcgaactgccaccctgatcctagcgggtgttagtctgcttcctgtgtgccaaagctcgtccatgcggaagtctgactggctcccaatgacagtcgctgccatgggcgtaccccctctgcccttgtttattttcagcctgaaggatactttaaaacgtagatcatggccactcaatgagggggtgatggcagttggactggtgagtatccttgcctcctctctgttgaggaacgacgtccctatggctggccccctcgtggcaggtgggctgctaattgcctgttacgtaatcaccggaacgagcgcggatctgacagtggaaaaggctgccgacgtcacctgggaggaagaggcagaacagactggcgtttcccataaccttatgataacagtggacgatgacggcaccatgcgcattaaagatgacgagactgagaatatcctcacagtgctgttgaagaccgccttactgatcgtctcagggatttttccatacagcataccggctacgctcctggtgtggcacacttggcagaaacagacccaacggagtggagttctttgggatgtaccttctcccccagaaacacagaaggccgagctggaagagggtgtgtatagaatcaaacagcagggcattttcgggaagacccaagtcggagtgggcgttcagaaggagggtgtgtttcatacaatgtggcacgtcactaggggggcagtgttgacctacaacggaaaacgactagaacccaattgggcttccgtaaagaaagacctgatcagctatggcggcgggtggcgcctctcggcccagtggcaaaagggagaggaagtccaggtgattgcggttgagcctggtaaaaacccaaagaatttccagacgatgcccggcacattccagactaccacaggggaaatcggagccatagcactggattttaagcctggcacctcaggttctccgatcattaaccgggaggggaaagtggtcggactttacggcaatggcgtggttactaagaacgggggatatgtgagtggtatcgctcaaaccaatgccgagccagacggccccacacctgaattagaggaagagatgttcaaaaagagaaacctgacgattatggatctccacccagggtccggaaaaactaggaagtacttgcccgctatcgtccgtgaagcaataaagcgccggctgagaaccctcattctggcccctacaagggtggtagccgctgagatggaggaagcgcttaaaggcctgccgatccgatatcagaccactgcaacaaagagcgagcataccggtcgggaaatcgtggacttgatgtgccacgccacgtttactatgcgcctactgtctcccgttagagtcccaaattacaacctcattatcatggatgaggctcatttcacagaccctgccagcatagcagccagggggtacatttccacccgggtgggaatgggcgaagctgcggccatctttatgaccgcaactcccccaggcacagctgatgccttccctcagtcaaatgcacccattcaggacgaggagcgagacatcccagaaagaagttggaacagcgggaatgagtggataaccgattttgccggaaaaacagtgtggttcgtcccgtctattaaggctggtaacgacatcgccaactgtttacgcaaaaatggcaagaaggtaatccaactgtccaggaaaacttttgatacggaatatcagaagaccaaacttaacgactgggatttcgtggttacaactgacatttcagagatgggggcgaattttaaggcagatcgtgtgatcgaccctcggagatgcctgaaacccgtcattctcaccgatggaccagagagggtgatattggccggccccatgcctgttacagctgccagtgctgcacagcgccgaggtagagtggggcggaacccacagaaggaaaatgaccaatacatcttcaccggccagcccctgaacaatgatgaggaccacgcccattggactgaagctaagatgctcctggacaacattaatacgcctgagggaatcatcccggcccttttcgaaccagagagggagaaaagcgcagcgattgatggcgaatatcgcctaaagggggagtcccgtaaaacctttgtcgaactgatgagacggggagacttgcccgtgtggttagcccacaaggtagcttctgagggtataaaatacacagataggaagtggtgcttcgacggccagcgcaacaatcagatcctggaagagaacatggatgtggagatttggactaaagaaggggagaagaagaaactccgacctagatggctggacgcccggacctattcggatccccttgcactgaaggaatttaaagacttcgctgccggaaggaagagcatcgcactcgatttggttacagagattggccgcgtcccatcacacctggcccatagaaccaggaatgctctagacaacctggtgatgctccacacttccgaacatggtgggaaagcgtaccggcacgccgtggaggagcttcctgaaacaatggagacgctgttattgctgggcctcatgatcctgcttaccggaggcgcaatgctgtttctcataagtgggaagggaatcggtaagacttctattggcttgatctgtgtcattgctagctccgggatgctgtggatggccgaaatccccttacaatggatagcctcagcaattgttctagagttctttatgatggtgctgctcatcccagagcctgaaaaacagcgtacaccgcaggataatcaacttgcttatgtagtgattggaatcctgaccttggccgcgataatcgctgccaacgagatgggcctgctcgaaaccacaaagcgcgacctgggtatgtctaaagagcccggggtcgtgagcccaactagttaccttgatgttgacctccaccctgcatccgcctggacgctgtacgctgtggcaaccacagtcattactcccatgttgcgacataccatcgaaaatagcacagccaacgtatctctggcggctattgccaaccaggcagtggttttaatgggcctagacaagggatggccaatctcaaaaatggatctgggcgtgcctctccttgccctggggtgctattcccaggtcaatcccttgaccctgactgctgccgtgctcctgcttataacgcactacgcaattatcggaccgggcttacaggctaaggccacaagagaggcgcaaaagaggaccgccgcaggtatcatgaaaaacccaactgtcgacgggattatgaccatcgatctggaccctgtgatatatgatagtaagttcgagaaacagctcggacaggttatgttgctggtgctatgtgctgtacagctgctccttatgcggacaagctgggccctgtgcgaagcattgactctggctaccggccccattacaacgctctgggagggttcgccaggcaagttttggaataccactatcgccgtgtctatggccaacattttccgcgggtcctacctggcgggagctggcttagcatttagcatcatgaaatcagtcgggacaggaaagagaggcaccggtactcaaggggaaacacttggagagaagtggaaaaagaaactgaatcagctcagtaggaaggaattcgacctatataaaaagtctggcataaccgaggttgatcggacggaggccaaagaaggtctgaagcgaggcgagatcacccatcacgctgtgtccagagggagcgccaagttgcagtggtttgtcgaacgcaacatggtgattcccgagggaagggtaatcgacctgggctgtgggcggggaggctggtcatactattgcgcaggtctcaaaaaggtgacagaagttcgtgggtacactaaaggaggccctggccatgaggagccggtgcccatgagtacctacgggtggaatattgtcaagcttatgagcggaaaagatgtgttctatctgccacctgaaaagtgtgacacattgctgtgcgatatcggtgagtcctctcccagccctactgtcgaagagtccagaaccattagggtgctcaagatggttgagccatggttaaaaaacaatcagttctgtatcaaggtactgaacccctacatgcctacagtgatagaacaccttgagcgcctgcaacggaaacacggcgggatgctagtccgaaatccactctcaagaaactctacccatgaaatgtattggattagtaatggaactggcaacatcgtggcctcggttaatatggtgagcaggctgttgctgaaccgctttacgatgacacaccggagacccaccatcgagaaggacgtcgatctcggtgctgggactcgtcatgtgaacgcggaaccggagacccctaatatggacgtaattggagagaggataaaacggatcaaggaagagcacaactccacatggcactacgacgatgaaaatccatataagacgtgggcctaccatggctcttatgaggtgaaagcaaccggctcagctagctccatgattaacggggttgtcaagcttctgactaaaccctgggacgtggtgcctatggtcacacagatggccatgaccgatactacaccattcggacagcaacgcgtttttaaggaaaaagtggacacccgaacacccagaagtatgccgggtactaggcgggtaatgggcatcaccgcagagtggttatggcgcacgctggggagaaataagaagcctaggttgtgcacccgagaggaattcacaaaaaaggtgcggactaacgccgctatgggagccgtctttaccgaggaaaatcagtgggattctgcgaaagcagccgtggaggacgaagatttctggaagctcgttgaccgtgagagagagctgcacaaactaggcaagtgtggtagctgcgtgtacaacatgatggggaaacgcgaaaagaagcttggagagtttggcaaagctaagggctcaagggccatttggtacatgtggctgggggcacggtatctcgaattcgaggctctgggatttttgaatgaggatcattggttctccagagaaaacagttacagcggtgtcgagggcgaagggctgcacaaactcggatatatccttcgcgacatatctaagatccccggcggtgccatgtacgctgatgacacagccgggtgggacactaggattaccgaggatgacctgcataatgaagagaaaatcacgcagcagatggatccagagcaccgacaattagcaaacgcgatttttaagctgacatatcagaataaggtggtaaaagttcagcggcctacccccactggaacagtgatggacatcatatccagaaaggatcagaggggctcaggccaagtcgggacctacggattgaacactttcaccaatatggaagcccagctcattcgccagatggagggtgaaggcgtgctgagcaaagctgacctagagaacccacacctttcggaaaagaaaatcacacagtggctggagacgaagggggtggagcgtctcaagcggatggccatctctggagatgactgcgtcgttaaacccattgatgacagatttgcaaacgctctgttggccttaaatgatatgggcaaggtgaggaaagacatacctcaatggcagccaagtaagggttggcatgattggcagcaggtaccgttctgttcccaccatttccacgaactgatcatgaaagacgggcgcaagctcgtggtcccctgccgacctcaagacgagcttattggacgggcaagaatcagccagggcgccggctggtcactgagggaaaccgcgtgtctagggaaggcttatgcccagatgtggtccctgatgtactttcaccgcagagatctccggttggcatctaacgccatttgcagcgctgtgccagttcattgggtgcccactagtaggacaacctggtccatccacgcccatcaccaatggatgactacagaggacatgctgaccgtctggaatcgtgtgtggatagaagataacccttggatggaggacaaaacgccagtaacaacctgggagaatgttccctaccttggaaagcgagaagatcagtggtgtggtagcctgatcggcctcacttctcgcgcaacctgggctcagaacattcctacagccatccagcaagtgagatcattaattgggaatgaggaattcctggactatatgccgagtatgaaacggtttaggaaggaggaggaatccgagggagcgatctggtga

SEQ ID NO: 15443 - RNA, 9873 nt, synthetic construct
  misc_feature 1..9873: note = derived and/or modified CDS sequence (opt3) from DENV-3__FJ390371__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgtcaatgagttttagctgcattgccataggaatcattacactgtatttaggcgcagtggttcaggccgacaccggttgtgtcatcaattggaaagggaaggagctgaagtgcggatccggcattttcgtgactaacgaggtgcatacatggaccgaacagtacaaatttcaagctgattctcccaagcggctagccactgcaatcgctggtgcctgggagaatggcgtctgtgggatacgaagcaccacacgcatggaaaacctcctgtggaaacagatcgcgaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggccaagatagtcaccgctgaaacacaaaacagttccttcattatcgatggccccaatactccagagtgccccagcgcatctagggcctggaacgtgtgggaagttgaggactatggttttggggtgttcaccacgaatatttggctgaaacttcgggaagtctacacacagttgtgtgaccaccgcctcatgtcagctgccgtgaaggatgagagagcagttcacgcggacatgggatactggatcgagagtcagaaaaacggcagctggaagctggaaaaagcctccctaatagaggtgaagacctgcacttggcctaagtctcataccctgtggtcgaatggtgtactcgaaagcgatatgatcattccaaaatccctggctggcccgatctcacagcacaactataggcccgggtaccatacacaaactgccggaccttggcaccttggcaagttggagctggactttaattattgcgaggggaccacagtcgtgattacggaaaactgtggaacccgtggcccaagtttacggactacaaccgtgtctggtaaactcatccacgagtggtgctgtcgaagctgcactctgccccctcttagatacatgggggaagatggatgttggtatggcatggagataaggccaatttccgaaaaggaggagaatatggtcaaatcactggttagcgcaggttctggcaaggtggacaacttcacaatgggggtattgtgcctcgctatcctgtttgaagaggtgatgcgcggaaagttcggcaaaaagcatatgatcgccggggtcttctttaccttcgtgctactgctctccggacagattacgtggcgggatatggcacacactctgatcatgattggcagtaatgccagcgacagaatgggtatgggggttacctaccttgctttgatagcgacatttaaaatccagcccttcctggccttaggatttttcctcaggaagctgacctctcgcgaaaaccttctgctaggcgtgggcctcgcaatggctactacactgcaattgccggaggatattgaacagatggccaatgggatcgccctgggattaatggctctcaaactgattacccagtttgagacatatcagctttggactgcactgatctccttgacctgttcaaacacgatattcacactcaccgtcgcctggcgaactgcgaccctgatcctagctggtgtgagtctgcttcctgtttgccaaagctcgtccatgcggaagtctgactggctcccaatgacagtggccgcaatgggcgtcccccctctgcccttgtttattttcagcctgaaggatactttaaaacgtagatcatggccactcaatgagggggtaatggccgtgggactggttagtatccttgcttcctctctgttgaggaacgacgtgcctatggcaggccccctcgtcgccggtgggctgctaattgcgtgttacgtgatcaccggaacgagcgctgatctgacagtagaaaaggccgcagacgtgacctgggaggaagaggccgaacagactggcgtctcccataaccttatgataacagttgacgatgacggcaccatgcgcattaaagatgacgagactgagaatatcctcacagtgctgttgaagaccgctttactgatcgtgtcagggatttttccatacagcataccggccacgctcctggtctggcacacttggcagaaacagacccggagaagtggagtgctttgggatgttccttctcccccagaaacacaaaaggcagagctggaagagggtgtatataggatcaaacagcagggcattttcgggaagacccaggtgggagtcggcgtgcaaaaggagggtgtttttcatacaatgtggcacgtgactcgaggggctgtcttgacctacaacggaaaacgcctagaacccaattgggcctccgtgaagaaagacctgatcagctatggcggcgggtggcggctctcggcgcagtggcagaagggagaggaagtacaagtcattgccgtggagcctggtaaaaacccaaagaatttccagacgatgcccggcacattccagactaccacaggggaaatcggagcaatagctctggattttaagcctggcacctcaggttctccgatcattaacagagaggggaaagttgtgggactttacggcaatggcgtcgtgactaagaacgggggatatgttagtggtatcgcccagaccaatgctgagccagacggccccacacctgaattagaggaagagatgttcaaaaagaggaacctgacgattatggatctccacccagggtccggaaaaactcgtaagtacttgcccgcaatcgtgcgcgaagccataaagcggagactgaggaccctcattctggcccctacacgagtcgtggctgcggagatggaggaagcacttaaaggcctgccgatccggtatcaaaccactgccacaaagagcgagcataccggtcgcgaaatcgtagacttgatgtgccacgctacgtttactatgagactactgtctcccgtgagggttccaaattacaacctcattatcatggatgaggcccatttcacagaccctgcaagcatagccgctcgggggtacatttccacccgagtcggaatgggcgaagcggccgcaatctttatgaccgctactcccccaggcacagccgatgcattccctcagtcaaatgcccccattcaggacgaggagagagacatcccagaacgcagttggaacagcgggaatgagtggataaccgattttgctggaaaaacagtgtggttcgtgccgtctattaaggccggtaacgacatcgcgaactgtttaaggaaaaatggcaagaaggtcatccagctgtcccgtaaaacttttgatacggaatatcaaaagaccaaacttaacgactgggatttcgtagtgacaactgacatttcagagatgggggcaaattttaaggccgatcgggttatcgaccctagaaggtgcctgaaacccgtgattctcaccgatggaccagagcgcgtcatattggctggccccatgcctgtgacagccgctagtgcagcccagcgaagaggtcgggttgggaggaacccacagaaggaaaatgaccagtacatcttcaccggccaacccctgaacaatgatgaggaccacgctcattggactgaagccaagatgctcctggacaacattaatacgcctgagggaatcatcccggcacttttcgaaccagagcgcgagaaaagcgcggccattgatggcgaatatcgtctaaagggggagtccagaaaaacctttgtggaactgatgcggaggggagacttgcccgtctggttagctcacaaggtggcctctgagggtataaaatacacagatcgcaagtggtgcttcgacggccagcgaaacaatcagatcctggaagagaacatggatgtagagatttggactaaagaaggggagaagaagaaactcagacctcggtggctggacgcaaggacctattcggatccccttgctctgaaggaatttaaagacttcgccgcaggacgcaagagcatcgccctcgatttggtgacagagattggcagagttccatcacacctggctcataggacccggaatgcgctagacaacctggtcatgctccacacttccgaacatggtgggaaagcctaccgtcacgcagtggaggagcttcctgaaacaatggagacgctgttattgctgggcctcatgatcctgcttaccggaggcgctatgctgtttctcataagtgggaagggaatcggtaagacttctattggcttgatctgtgtgattgccagctccgggatgctgtggatggccgaaatccccttacagtggatagcatcagctattgtcctagagttctttatgatggttctgctcatcccagagcctgaaaaacaacgcacaccgcaggataatcagcttgcctatgtggtaattggaatcctgaccttggcggctataatcgccgcaaacgagatgggcctgctcgaaaccacaaagcgagacctgggtatgtctaaagagcccggggtggtcagcccaactagttaccttgatgtggacctccaccctgcctccgcttggacgctgtacgcagttgccaccacagtgattactcccatgttgagacataccatcgaaaatagcacagcgaacgtctctctggctgccattgcaaaccaagccgtagtgttaatgggcctagacaagggatggccaatctcaaaaatggatctgggcgttcctctccttgctctggggtgctattcccaggtgaatcccttgaccctgactgccgcagtcctcctgcttataacgcactacgctattatcggaccgggcttacaggccaaggcgacaagggaggcccagaagcggaccgcagctggtatcatgaaaaacccaactgtggacgggattatgaccatcgatctggaccctgtcatatatgatagtaagttcgagaaacaactcggacaggtgatgttgctggttctatgtgccgtgcagctgctccttatgcgcacaagctgggcactgtgcgaagctttgactctggccaccggccccattacaacgctctgggagggttcgccaggcaagttttggaataccactatcgccgtatctatggcgaacattttcagagggtcctacctggctggagcaggcttagcctttagcatcatgaaatcagtggggacaggaaagaggggcaccggtagtcagggggaaactcttggagagaagtggaaaaagaaactgaatcaactctctcggaaggaattcgacctatataaaaagtccggcataacagaggtcgatcgaaccgaggctaaagaaggtctgaagagaggcgagatcacgcatcacgccgttagccgcgggtcagcaaagttgcagtggtttgtggaaaggaacatggtcattcccgagggacgggtgatcgacctgggctgtgggcgtggaggctggagttactattgcgccggtctcaaaaaggtaaccgaagtgagagggtacacaaaaggaggccctggccatgaggagccggttcccatgagcacttacgggtggaatattgtgaagcttatgtccggaaaagatgtcttctatctgccacctgaaaagtgtgacaccttgctgtgcgatatcggtgagtctagcccctcccctacagtggaagagtcaaggactattcgcgtcctcaagatggtggagccatggttaaaaaacaatcagttctgtatcaaggttctgaacccctacatgcctaccgtaatagaacaccttgagcggctgcagcgaaaacacggcgggatgctagtgagaaatccactctctaggaacagtacacatgaaatgtattggatttcgaatggaaccggcaacatcgtcgctagcgtgaatatggtttcccgcctgttgctgaaccggtttactatgacgcacagacgtcccacaatcgagaaggacgtggatctcggtgcggggaccaggcatgtcaacgccgaaccggagactcctaatatggacgtgattggagagcggataaaacgcatcaaggaagagcacaactctacctggcactacgacgatgaaaatccatataagacatgggcataccatggctcatatgaggtaaaagctacgggcagcgcctccagtatgattaacggggtggttaagcttctgaccaaaccctgggacgtcgtgcctatggtgactcaaatggcaatgacagataccactccattcggacagcagcgagtctttaaggaaaaagttgacacaagaacccccaggtctatgccgggtacacggcgcgtgatgggcatcactgccgagtggttatggagaaccctggggaggaataagaagcctcgattgtgcacgcgggaggaattcaccaaaaaggtacgtacaaacgctgccatgggagcggtgtttactgaggaaaatcaatgggatagcgcaaaagccgctgtcgaggacgaagatttctggaagctcgtggacagagagcgcgagctgcacaaactaggcaagtgtggttcatgcgtttacaacatgatggggaaaagggaaaagaagcttggagagtttggcaaagccaagggctcccgggcaatttggtacatgtggctgggggctagatatctcgaattcgaggccctgggatttttgaatgaggatcattggttcagtcgcgaaaacagctactctggtgtggagggcgaagggctgcacaaactcggatatatccttagggacatatccaagatccccggcggtgctatgtacgccgatgacaccgcagggtgggacacacgaattactgaggatgacctgcataatgaagagaaaatcacccagcagatggatccagagcaccggcagttagcgaacgccatttttaagctgacgtatcaaaataaggtcgtgaaagtacagagacctacacccaccggaactgttatggacatcatatcaaggaaggatcagcgcggcagcggccaggtggggacatacggattgaacaccttcactaatatggaagctcaactcattcgtcagatggagggtgaaggcgtcctgaccaaagccgacctagagaacccacacctttcggaaaagaaaatcacacagtggctggagacgaagggggtggagcggctcaagagaatggcaatctctggagatgactgcgtggtcaaacccattgatgacaggtttgctaacgccctgttggcattaaatgatatgggcaaggttcgcaaagacatacctcagtggcaaccaagtaagggttggcatgattggcagcaggtgccgttctgttcccaccatttccacgaactgatcatgaaagacgggcgaaagctcgtagtgccctgccggcctcaggacgagcttattggaagagccaggatcagccaaggcgcgggctggtcactgcgcgaaaccgcttgtctagggaaggcctatgcacagatgtggtccctgatgtactttcacagacgggatctcaggttggcctctaacgctatttgcagcgccgtcccagtgcattgggttcccactagtcgtacaacctggtccatccacgcacatcaccagtggatgactacagaggacatgctgaccgtgtggaatcgagtctggatagaagataacccttggatggaggacaaaacgccagtgacaacctgggagaatgtaccctaccttggaaagcgcgaagatcaatggtgtggtagcctgatcggcctcacttctagagctacctgggcccagaacattcctacagcgatccagcaggttcggtcattaattgggaatgaggaattcctggactatatgccgagtatgaaaaggtttcgcaaggaggaggaatccgagggagctatctggtga

SEQ ID NO: 15444 - RNA, 9873 nt, synthetic construct
  misc_feature 1..9873: note = derived and/or modified CDS sequence (opt3) from DENV-3__FJ390372__SS-prME
  source 1..9873: mol_type = other RNA
accagcctgtgcctcatgatggtgcttcccgccgctctggcattccacttgacatccagagacggcgagcctaggatgatcgtcgggaagaacgaacggggaaaatctttactgtttaagactgcctcaggtattaatatgtgtacgctaatagcgatggatctcggcgagatgtgcgacgataccgttacatacaaatgtccacatatcactgaagtggagccggaagacattgattgctggtgtaacctgaccagtacatgggtaacctatgggacttgcaatcaggctggagagcaccgccgagacaagcgtagcgtggcccttgcaccccatgtcggcatgggtctggatacaagaacccaaacgtggatgtccgccgagggggcttggaggcaggtggaaaaagttgagacttgggcattgcggcaccctggattcaccatcctcgccctgtttctggctcattacattggcacatctctcactcagaaggtggtcatcttcatattactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatcgagctccagaagaccgaagcaactcaactggccacacttaggaaactgtgtattgagggaaagatcaccaacattacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgctccctgtaaaattcctttctccacagaggacggccaaggtaaggcgcataacgggcgtcttatcactgcaaatccagtggtaaccaaaaaggaggaacccgtcaacatagaggccgaaccgcctttcggcgagtcaaatattgtgatcggaatcggcgataacgctttgaaaattaattggtataagaaggggagcagtatcggaaaaatgtttgaagccacagcacgcggtgccagaaggatggctattctgggcgacactgcctgggatttcgggtctgttggaggcgtgctcaactccctgggtaagatggtccaccagatatttgggagcgcatacaccgcgcttttctcgggcgtgtcttgggtaatgaaaatcggaattggcgtgctgttgacgtggatcgggctcaattccaagaacacatcaatgagttttagctgcatcgctattggagttataaccctgtatttaggcgccgtcgtgcaggcagacatgggttgtgtgatcaattggaaagggaaggagctgaagtgcggatccggcattttcgtcactaacgaggttcatacatggaccgaacagtacaaatttcaagccgattctcccaagcggctagctactgccatcgcaggtgcttgggagaatggcgtgtgtgggattcgaagcaccacacgcatggaaaacctcctgtggaaacagatcgccaatgagcttaactatatattgtgggaaaataacatcaagctgacggtggtagtcggagacattatcggcgtgctcgagcaggggaaaagaaccctgactccacagcctatggagttaaagtactcatggaaaacatggggaaaggcgaagattgttaccgccgaaacacaaaacagttccttcatcatagatggccccaatactccagagtgccccagcgcttctagggcatggaacgtgtgggaagtcgaggactatggttttggggtgttcaccacgaatatttggctgaaacttcgggaagtttacacacagttgtgtgaccaccgcctcatgtcagccgctgtgaaggatgagagagccgtacacgcagacatgggatactggatcgagagtcagaaaaacggcagctggaagctggaaaaagcgtccctaattgaggtcaagacctgcacttggcctaagtctcataccctgtggtcgaatggtgtgctcgaaagcgatatgatcataccaaaatccctggccggcccgatctcacagcacaaccataggcccgggtatcacacacaaactgctggaccttggcaccttggcaagttggagctggactttaattactgcgaggggaccacagtggtcattacggaaaactgtggaacccgtggcccaagtttacggactacaaccgtttctggtaaactcatccatgagtggtgctgtcgaagctgcactctgccccctcttagatatatgggggaagatggatgttggtacggcatggagattaggccaatctccgaaaaggaggagaatatggtgaaatcactggtaagcgccggttctggcaaggtggacaacttcacaatgggggtcttgtgcctcgcaatactgtttgaagaggtgatgcgcggaaagttcggcaaaaagcacatgattgctggggttttctttaccttcgtgctactgctctccggacagatcacgtggcgggatatggcccatactctgatcatgattggcagtaatgcaagcgacagaatgggtatgggggtcacctatcttgccttgatcgctacatttaaaattcagcccttcctggcgttaggatttttcctcaggaagctgacctctcgcgaaaaccttctgctaggcgtgggcctcgccatggcaactacactgcaattgccggaggatatagaacagatggctaatgggatcgccctgggattaatggccctcaaactgattacccagtttgagacataccagctttggactgctctgatctccttgacctgttcaaacacgatgttcacactcaccgttgcatggcgaactgccaccctgattctagcgggtgtgagtctgcttcctgtctgccaaagctcgtccatgcggaagacagactggctcccaatggctgtagccgcaatgggcgtgccccctctgcccttgtttatcttctctctgaaggatactttaaaacgtagaagctggccactcaatgagggggttatggccgtgggactggtctcaatacttgctagttccctgttgaggaacgacgtgcctatggcaggccccctcgtagccggtgggctgctaatcgcgtgttatgtgattaccggaacgtctgctgatctgacagtcgaaaaggccgcagacatcacctgggaggaagaggccgaacagactggcgttagccacaaccttatgattacagtggacgatgacggcaccatgcgcatcaaagatgacgagactgagaatatactcacagtgctgttgaagaccgctttactgattgtctccggggtgtttccatactcaatcccggccacgctcctggtttggcatacttggcagaaacagacccaacggagcggagtactttgggatgtgcctagtcccccagaaacacagaaggcagagctggaagagggtgtctacagaatcaaacagcagggcattttcgggaagacccaagtgggagttggcgtgcagaaggagggtgtctttcacacaatgtggcacgtgactaggggggctgtattgacctataacggaaaacgactagaacccaattgggcctctgtcaagaaagacctgatatcctacggcggcgggtggcgcctcagcgcgcagtggcaaaagggagaggaagtgcaggttatcgccgtggagcctggtaaaaacccaaagaatttccagacgatgcccggcacattccagactaccacaggggaaattggagcaatcgctctggattttaagcctggcacctcgggttcaccgattatcaaccgggaggggaaagtcgtgggactttatggcaatggcgttgtgactaagaacgggggatacgtctctggtatagcccaaaccaatgctgagccagacggccccacacctgaattagaggaagagatgttcaaaaagagaaacctgacgatcatggatctccatccagggagtggaaaaactaggaagtatttgcccgcaattgtgcgtgaagccatcaagcgccggctgagaaccctcattctggcccctacaagggtagtggctgcggagatggaggaagcacttaaaggcctgccgatccgataccagaccactgccacaaagtccgagcacaccggtcgggaaatagttgacttgatgtgccatgctacgtttactatgcgcctactgagccccgtcagagtgccaaattataacctcattatcatggatgaggcccacttcacagaccctgcatctatcgccgctagggggtacattagcacccgggtgggaatgggcgaagcggccgcaatctttatgaccgctactcccccaggcacagccgatgcattccctcagtccaatgcccccatacaggacgaggagaaagacattccagaacgatcatggaacagtgggaatgagtggatcaccgattttgctggaaagacagtctggttcgtaccgagcattaaagccggtaacgacatcgcgaactgtttaagaaagaatggcaagaaagtgatacaactgtctcgcaagacttttgatacggaataccagaaaaccaagcttaacgactgggatttcgttgtgacaactgacatttccgagatgggggcaaattttaaagccgatagggtcatcgaccctcgtcggtgcctgaagcccgtgatcctcaccgatggaccagagagagttattttggctggccccatgcctgtgacagccgcttcagcagcccagaggcgcggtcgagtcgggagaaacccacagaaggaaaatgaccaatatatcttcaccggccagcccctgaacaatgatgaggaccatgctcactggactgaagccaaaatgctcctggacaacattaatacgcctgagggaataatcccggcacttttcgaaccagagcgggagaagagtgcggccattgatggcgaatacaggctaaaaggggagagccgcaagacctttgtggaactgatgcgtagaggagacttgcccgtatggttagctcacaaagtggcctccgagggtatcaagtatacagatcggaaatggtgcttcgacggccagaggaacaatcagatcctggaagagaacatggatgttgagatttggactaaggaaggggagaagaaaaagctccgccctcgatggctggacgcaagaacctactctgatccccttgctctgaaagaatttaaggacttcgccgcaggacggaaatcgatagccctcgatttggtcacagagatcggcagggtgccaagccatctggctcaccgcaccagaaatgcgctagacaacctggtgatgctccatacttcagaacacggtgggagggcctatcggcacgcagtcgaggagcttcctgaaacaatggagacgctgttattgctgggcctcatgattctgcttaccggaggcgctatgctgtttctcatctccgggaagggaattggtaagactagtatcggcttgatatgtgttatcgcctctagcgggatgctgtggatggccgaaattcccttacaatggatcgcatccgctattgtgctagagttctttatgatggtactgctcatcccagagcctgaaaaacagcgtacaccgcaggataatcaacttgcctacgtggtcataggaattctgaccttggcggctatcattgccgcaaacgagatgggcctgctcgaaaccacaaagcgcgacctgggtatgtcaaaagagcccggggtggtttctccaactagctatcttgatgtggacctccatcctgccagtgcttggacgctgtacgcagtcgccaccacagtaatcactcccatgttgcgacacaccatagaaaattccacagcgaacgtgagcctggctgccatcgcaaaccaggccgttgtgttaatgggcctagacaagggatggccaatttctaaaatggatctgggcgtccctctccttgctctggggtgctactcacaggtgaatcccttgaccctgactgccgcagtcctcctgcttatcacgcattatgctattatcggaccgggcttacaggccaaggcgacaagagaggcccaaaagaggaccgcagctggtataatgaaaaacccaactgtggacgggattatgaccatcgatctggaccctgttatctacgattccaagttcgagaaacagctcggacaggtgatgttgctggtactatgtgccgtgcagctgctccttatgcggacaagttgggcactgtgcgaagctttgactctggccaccggccccattacaacgctctgggagggtagcccaggcaagttttggaataccactatcgccgtctcgatggcgaacatattccgcgggtcttatctggctggagcaggcttagccttttccattatgaaaagcgttgggacaggaaagagaggcaccggttcacaaggggaaactcttggagagaagtggaaaaagaaactgaatcagctcagtaggaaggaattcgacctatacaaaaagtctggcatcacagaggtggatcggaccgaggctaaagaaggtctgaagcgaggcgagacgacccaccatgccgtctccagagggacagcaaagttgcagtggtttgtggaacgcaacatggtaattcccgagggaagggtgatcgacctgggctgtgggcggggaggctggagctattactgcgccggtctcaaaaaggttactgaagtgcgtgggtataccaaaggaggccctggccacgaggagccggtccccatgtcaacatacgggtggaatatagtgaagcttatgagtggaaaagatgtcttctacctgccacctgaaaagtgtgacactttgctgtgcgatatcggtgagagctccccctctcctaccgtggaagagagcagaacaattagggttctcaagatggtagagccatggttaaaaaacaatcagttctgtatcaaggtgctgaacccctatatgcctaccgtcattgaacaccttgagcgcctgcaacggaaacatggcgggatgctagtgcgaaatccactctccagaaactcaactcacgaaatgtactggatctctaatggaacgggcaacattgttgctagtgtgaatatggtctcgaggctgttgctgaaccgctttacaatgacccatcggagacccactatcgagaaggacgtggatctcggtgcggggacccgtcacgtaaacgccgaaccggagacacctaatatggacgtgataggagagaggattaaacggatcaaggaagagcacaacagcacgtggcattatgacgatgaaaatccatacaagacctgggcatatcacggctcctacgaggttaaagctactggctctgcctcaagcatgatcaacggggtcgtgaagcttctgacaaaaccctgggacgtggtccctatggttacccagatggcaatgactgatacaaccccattcggacatcagcgcgtgtttaaggaaaaagtagacacacgaactcccagatccatgccgggtcctaggcgggccatgggcattaccgctgagtggttatggcgcacgctggggagaaataagaagcccaggttgtgcacccgagaggaattcacaaaaaagggacggactaacgccgcgatgggcgcagtgtttaccgaggaaaatcaatgggatagtgccaaagctgccgtcgaggacgaagatttctggaagctcgtggaccgtgagagagagctgcacaaactaggtaagtgtgggtcttgcgtttataacatgatgggaaaacgcgaaaagaagcttggcgagtttggcaaagcaaaggggagcagggctatatggtacatgtggctgggagcccggtacctcgaattcgaggctctgggttttttgaatgaggatcattggttctcaagagaaaactcctatagtggcgtggagggggaaggactgcacaaactcggctacatccttcgcgacattagcaagatcccaggtggggccatgtatgcagatgcgacagccggatgggacactaggattaccgaggacgatctgcacaatgaagagaaaatcacgcagcagatggaccctgatcatcgacagttagctacagccatatttaagctgacctaccaaaacaaggtcgtgaaagtacagcggcccactccaacaggcaccgttatggacatcatttctagaaaggatcagaggggctccgggcaggtgggaacttatggtttgaataccttcacaaacatggaggcacaactcatccgccagatggaaggcgagggggtcctgtcaaaagctgacctagaaaatccccaccttcctgagaagaaaattacgcagtggctggaaaccaagggagtggagcgtctccggagaatggccatcagcggcgatgactgcgtggtcaagccaatagatgacaggtttgcaaacgccctgttggcgttaaacgatatgggtaaagttcgcaaggacattccgcagtggcaaccctcgaaagggtggcatgattggcagcaggtgcctttctgttctcaccacttccatgagctgatcatgaaggacggacgaaaactcgtagtgccatgccggccccaggacgaacttatcggcagagctaggattagtcaaggcgccgggtggtccctgcgcgagactgcatgtctaggaaaggcctacgctcagatgtggagcctgatgtattttcacagacgggatctcaggttggcctcaaatgcaatatgctccgctgtccctgtgcattgggttccaacatctcgtaccacttggagcatccacgcccatcaccagtggatgacaaccgaagacatgctgacggtgtggaaccgagtctggattgaggataatccctggatggaagacaagacacctgtgaccacttgggagaacgtaccgtaccttggtaaacgcgaggatcaatggtgtggcagtctgatcgggctcacctccagagcgacatgggctcagaatattccaactgccatccagcaggttcggagcttaataggaaacgaagagttcctggactacatgccctctatgaagaggtttcgcaaagaagaggagtcagaaggcgcaatctggtga

SEQ ID NO: 15445 - RNA, 9873 nt, synthetic construct
  misc_feature 1..9873: note = derived and/or modified CDS sequence (opt3) from DENV-3__FJ205870__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacaccggttgtgtgatcaattggaaagggaaggagctgaagtgcggatccggcattttcgtgactaacgaggtccatacatggaccgaacagtacaaatttcaagccgattctcccaagcggctagctactgccatcgcaggtgcttgggagaatggcgtttgtgggatacgaagcaccacacgcatggaaaacctcctgtggaaacagatcgccaatgagcttaactatattttgtgggaaaataacatcaagctgacggtggtggtaggagacattatcggcatactcgagcaggggaaaagaaccctgactccacagcctatggagttaaagtactcatggaaaacatggggaaaggcgaagattgtcaccgccgaaacacaaaacagttccttcatcattgatggccccaatactccagagtgccccagcgcttctagggcatggaacgtgtgggaagttgaggactatggttttggggtgttcaccacgaatatctggctgaaacttcgggaagtctacacacagttgtgtgaccaccgcctcatgtcagccgctgtgaaggatgagagagccgttcacgcagacatgggatactggatagagagtcagaaaaacggcagctggaagctggaaaaagcgtccctaatcgaggtgaagacctgcacttggcctaagtctcataccctgtggtcgaatggtgtactcgaaagcgatatgattatcccaaaatccctggccggcccgatttcacagcacaactataggcccgggtaccatacacaaactgctggaccttggcaccttggcaagttggagctggactttaattattgcgaggggaccacagtcgtgatcacggaaaactgtggaacccgtggcccaagtttacggactacaaccgtgtctggtaaactcatacacgagtggtgctgtcgaagctgcactctgccccctcttagatacatgggggaagatggatgttggtatggcatggagattaggccaatctccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcatatgattgctggggtcttctttaccttcgtgctactgctctccggacagatcacgtggcgggatatggcccacactctgattatgataggcagtaatgcaagcgacagaatgggtatgggggttacctaccttgccttgatcgctacatttaaaattcagcccttcctggcgttaggatttttcctcaggaagctgacctctcgcgaaaaccttctgctaggcgtgggcctcgccatggcaactacactgcaattgccggaggatatcgaacagatggctaatgggattgccctgggattaatggccctcaaactgatcacccagtttgagacatatcagctttggactgctctgatatccttgacctgttcaaacacgatcttcacactcaccgtcgcatggcgaactgccaccctgattctagcgggtgtgagtatcctgcctgtttgccaaagctcgtccatgcggaagtctgactggcttccaatgacagtggctgccatgggcgtcccccctctccccctgtttattttcagcttgaaggatactctgaaacgtagatcatggccattaaatgagggggtaatggcagtgggactcgttagtatcctggcctcctctcttctgaggaacgacgtgcctatggctggccccttggtcgcaggtgggctcctgatagcctgttacgtgattaccggaacgagcgcggatctaacagtagaaaaggctgccgacgtgacctgggaggaagaggcagaacagactggcgtctcccataacctgatgatcacagttgacgatgacggcaccatgcgcatcaaagatgacgagactgagaatattcttacagtgctcctgaagaccgccttgttaatagtgtcagggatctttccatacagcattccggctacgctgctcgtctggcacacttggcagaaacagacccggagaagtggagtgctgtgggatgttccttctcccccagaaacacaaaaggccgagcttgaagagggtgtatataggatcaaacagcagggcattttcgggaagacccaggtgggagtcggcgtgcaaaaggagggtgtttttcatacaatgtggcacgtgactcgaggggcagtcctgacctacaacggaaaacgcttggaacccaattgggcttccgtgaagaaagacctaatcagctatggcggcgggtggcggctgtcggcccagtggcagaagggagaggaagtacaagtcatagcggtggagcctggtaaaaacccaaagaatttccagacgatgcccggcacattccagactaccacaggggaaatcggagccattgcactcgattttaagcctggcacctcaggttctccgatcattaacagagaggggaaagttgtgggactgtacggcaatggcgtcgtgactaagaacgggggatatgttagtggtatcgctcagaccaatgccgagccagacggccccacacctgaacttgaggaagagatgttcaaaaagaggaacttaacgataatggatctgcacccagggtccggaaaaactcgtaagtacctccccgctattgtgcgcgaagcaatcaagcggagattgaggaccctgatcctcgcccctacacgagtcgtggccgctgagatggaggaagcgctgaaaggccttccgattcggtatcaaaccactgcaacaaagagcgagcataccggtcgcgaaatcgtagacctgatgtgccacgccacgtttactatgagattgctatctcccgtgagggttccaaattacaacctgataattatggatgaggctcatttcacagaccctgccagcatcgcagcccgggggtacatttccacccgagtcggaatgggcgaagctgcggccatctttatgaccgcaactcccccaggcacagctgatgccttccctcagtcaaatgcacccatacaggacgaggagagagacattccagaacgcagttggaacagcgggaatgagtggatcaccgattttgccggaaaaacagtgtggttcgtgccgtctatcaaggctggtaacgacattgccaactgtctcaggaaaaatggcaagaaggtcatccagttatcccgtaaaacttttgatacggaatatcaaaagaccaaactgaacgactgggatttcgtagtgacaactgacatttcagagatgggggcgaattttaaggcagatcgggttatagaccctagaaggtgccttaaacccgtgatcctgaccgatggaccagagcgcgtcattctcgccggccccatgcctgtgacagctgccagtgctgcacagcgaagaggtcgggttgggaggaacccacagaaggaaaatgaccagtacatcttcaccggccaacccttgaacaatgatgaggaccacgcccattggactgaagctaagatgctgctcgacaacatcaatacgcctgagggaattataccggccctgttcgaaccagagcgcgagaaaagcgcagcgatcgatggcgaatatcgtcttaagggggagtccagaaaaacctttgtggaactaatgcggaggggagacctgcccgtctggttggcccacaaggtggcttctgagggtattaaatacacagatcgcaagtggtgcttcgacggccagcgaaacaatcagatcttagaagagaacatggatgtagagatttggactaaagaaggggagaagaagaaactgagacctcggtggctcgacgccaggacctattcggatcccctggcacttaaggaatttaaagacttcgctgccggacgcaagagcatcgcactggatctcgtgacagagataggcagagttccatcacacttggcccataggacccggaatgctctggacaacctagtcatgctgcacacttccgaacatggtgggaaagcgtaccgtcacgccgtggaggagctccctgaaacaatggagacgcttctgttattgggcctgatgatcctcctgaccggaggcgcaatgctttttctgattagtgggaagggaatcggtaagacttctattggcctcatctgtgtgatagctagctccgggatgttgtggatggccgaaattcccctgcagtggatcgcctcagcaattgtcttagagttctttatgatggttctactgatcccagagcctgaaaaacaacgcacaccgcaggataatcagctcgcttatgtggtaataggaatccttaccctggccgcgattatcgctgccaacgagatgggcttgctggaaaccacaaagcgagacctcggtatgtctaaagagcccggggtggtcagcccaactagttacctggatgtggaccttcaccctgcatccgcctggacgctctacgctgttgcaaccacagtgattactcccatgctgagacataccatcgaaaatagcacagccaacgtctctttggcggctatagccaaccaagcagtagtgctgatgggcttagacaagggatggccaatttcaaaaatggatctaggcgttcctctgctcgcccttgggtgctattcccaggtgaatcccctgaccttgactgctgccgtcctgctcctgatcacgcactacgcaatcattggaccgggccttcaggctaaggccacaagggaggcgcagaagcggaccgccgcaggtatcatgaaaaacccaactgtggacgggataatgaccattgatttagaccctgtcatctatgatagtaagttcgagaaacaactgggacaggtgatgctcttggttctgtgtgctgtgcagctactgctcatgcgcacaagctgggccctttgcgaagcactgactttggctaccggccccattacaacgctgtgggagggttcgccaggcaagttttggaataccactatcgccgtatctatggccaacatattcagagggtcctacctcgcgggagctggcctggcatttagcatcatgaaatcagtggggacaggaaagaggggcaccggtagtcagggggaaactttaggagagaagtggaaaaagaaacttaatcaactgtctcggaaggaattcgacctctataaaaagtccggcattacagaggtcgatcgaaccgaggccaaagaaggtctaaagagaggcgagatcacgcatcacgctgttagccgcgggtcagccaagctgcagtggtttgtggaaaggaacatggtcattcccgagggacgggtgatcgacttgggctgtgggcgtggaggctggagttactattgcgcaggtctgaaaaaggtaaccgaagtgagagggtacacaaaaggaggccctggccatgaggagccggttcccatgagcacttacgggtggaatattgtgaagctcatgtccggaaaagatgtcttctatcttccacctgaaaagtgtgacaccctgttgtgcgatatcggtgagtctagcccctcccctacagtggaagagtcaaggactatacgcgtcctgaagatggtggagccatggctcaaaaacaatcagttctgtattaaggttttaaacccctacatgcctaccgtaatcgaacacctggagcggcttcagcgaaaacacggcgggatgctggtgagaaatccactatctaggaacagtacacatgaaatgtattggatctcgaatggaaccggcaacattgtcgccagcgtgaatatggtttcccgcctcctgttgaaccggtttactatgacgcacagacgtcccacaatagagaaggacgtggatctgggtgctgggaccaggcatgtcaacgcggaaccggagactcctaatatggacgtgatcggagagcggattaaacgcatcaaggaagagcacaactctacctggcactacgacgatgaaaatccatataagacatgggcctaccatggctcatatgaggtaaaagcaacgggcagcgcttccagtatgattaacggggtggttaagctccttaccaaaccctgggacgtcgtgcctatggtgactcaaatggccatgacagataccactccattcggacagcagcgagtctttaaggaaaaagttgacacaagaacccccaggtctatgccgggtacacggcgcgtgatgggcatcactgcagagtggctgtggagaaccttagggaggaataagaagcctcgactgtgcacgcgggaggaattcaccaaaaaggtacgtacaaacgccgctatgggagccgtgtttactgaggaaaatcaatgggatagcgcgaaagcagccgtcgaggacgaagatttctggaagttggtggacagagagcgcgagctccacaaactgggcaagtgtggttcatgcgtttacaacatgatggggaaaagggaaaagaagctaggagagtttggcaaagctaagggctcccgggccatatggtacatgtggcttggggcaagatatctggaattcgaggctctcggatttctgaatgaggatcattggttcagtcgcgaaaacagctactctggtgtggagggcgaagggttgcccaaactgggatatatcctcagggacatttccaagatcccaggcggtgccatgtacgctgatgacaccgccgggtgggacacacgaattactgaggatgaccttcacaatgaagagaaaatcacccagcagatggatcctgagcatcggcagctggcaaacgcgatatttaagttaacgtatcaaaataaggtcgtgaaagtacagagacccacaccaaccggaactgttatggacattatctcaaggaaggatcagcgcggcagcggccaggtggggacatacggactgaacaccttcactaatatggaagcccaattgatccgtcagatggagggtgaaggcgtcctctcgaaagctgacctggagaacccccacctatctgaaaagaaaattacccagtggcttgagacaaagggggtggagcggctgaagagaatggccataagtggagatgactgcgtggtcaaacctatcgatgacaggtttgcaaacgctctcctggccttgaatgatatgggcaaggttcgcaaagacattccacagtggcaaccgtccaagggttggcacgattggcagcaggtgcccttctgtagccatcacttccatgaattaatcatgaaagacgggcgaaagctggtagtgccttgccggccacaggacgagctcattggaagagcaaggatctcacaaggcgccggctggtcccttcgcgaaacggcgtgtctggggaaggcttatgcccagatgtggtctctaatgtactttcacagacgggatctgaggctcgcaagcaacgccatatgcagtgctgtccccgtgcactgggttcctacctcccgtactacatggagcatccatgcccaccatcagtggatgaccactgaggacatgttgacagtgtggaatcgagtctggattgaagataacccatggatggaggacaaaacccccgtgacgacatgggagaatgtaccttacctgggaaagcgcgaagatcaatggtgtggttctcttatcggcctgacctcaagagcaacttgggctcagaacattccgaccgccatccagcaggttcggagtctcattgggaatgaggaattcttagactatatgccatccatgaaaaggtttcgcaaggaggaggaaagcgagggagcgatatggtga

SEQ ID NO: 15446 - RNA, 9873 nt, synthetic construct
  misc_feature 1..9873: note = derived and/or modified CDS sequence (opt3) from DENV-3__FJ390373__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccgtggtaaggctcataacgggcgccttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagccagaggtgcaaggcggatggccatactgggcgacactgcttgggatttcgggtctgttggaggcgtgctcaactccctgggtaagatggtccaccaaatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaggcagattctcccaagcgactagccactgctatcgccggtgcatgggagaatggcgtttgtgggatacgcagcaccacaagaatggaaaacctcctgtggaaacaaatcgctaatgagcttaactatattttgtgggaaaataacatcaagctgacggtggtggtaggagacaccattggcgtcctcgagcaggggaaaaggactctgacaccacagcctatggagttaaagtactcatggaaaacctggggaaaggccaagatcgtgacagcggaaactcagaacagttccttcataattgatggccccaataccccagagtgccccagcgcctctcgggcttggaacgtttgggaagtggaggactatggttttggggtcttcacgacaaatatctggctgaaacttcgcgaagtgtacacccaattgtgtgaccacagactcatgtcagcagccgttaaggatgagagggctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactatcgtcccgggtaccatactcagaccgccggaccttggcaccttggcaagttggagctggactttaattattgcgaggggacaacggtggtgatcaccgaaaactgtggaactcggggcccaagtttacgaacaaccactgtctctggtaaactcattcacgagtggtgctgtagaagctgcacactgccccctcttaggtacatgggggaagatggatgttggtatggcatggagatccgcccaatatccgaaaaggaggagaatatggttaaatcactggtgagcgctggttctggcaaggtagacaacttcaccatgggggtgttgtgcctcgccattctgtttgaagaggtcatgcggggaaagttcggcaaaaagcatatgatcgcaggggtgttctttacgttcgttctactgctctccggacaaatcacttggagagatatggctcacaccctgattatgatcggcagtaatgccagcgacaggatgggtatgggggtgacataccttgcattgattgccacctttaaaatacagcccttcctggctttaggatttttcctccgcaagctgacttctcgagaaaaccttctgctaggcgtcggcctcgcgatggccacaaccctgcagttgccggaggatatcgaacaaatggcaaatgggattgctctgggattaatggccctcaaactgacaactcagtttgagacctatcagctttggacggccctgatctccttgacatgttcaaacaccattttcactctcaccgtggcttggcggacagcaactctgatcctagccggtgttagtctgcttcctgtgtgccagagctcgtccatgcgtaagaccgactggctcccaatgacggtcgcggctatgggcgtaccccctctgcccttgtttatattctctctgaaggatacattaaaaagaaggagctggccactcaatgagggggtgatggccgttggactggtgtcaatccttgcaagttccctgttgcgcaacgacgtccctatggccggccccctcgtggctggtgggctgctaattgcatgttacgtaatcaccggaacttctgccgatctgacagtggaaaaggcggctgacgtcacctgggaggaagaggccgaacaaactggcgttagccataaccttatgattacagtggacgatgacggcaccatgcggatcaaagatgacgagacggagaatatactcactgtgctgttgaagaccgcattactgattgtctccgggatctttccatactcaatcccggccacactcctggtgtggcacacctggcagaaacagacacagagaagcggagttctttgggatgtacctagtcccccagaaactcaaaaggctgagctggaagagggtgtgtataggattaaacagcagggcatattcgggaagacccaggtcggagtgggcgttcaaaaggagggtgtgtttcatacgatgtggcacgtcacacgaggggccgtgttgacttacaacggaaaacgcctagaacccaattgggcatctgtaaagaaagacctgatctcctatggcggcgggtggcggctcagcgctcagtggcagaagggagaggaagtccaagtgattgccgttgagcctggtaaaaacccaaagaatttccagaccatgcccggcacattccagaccactaccggggaaatcggagcgattgccctggattttaagcctggcacatcgggttcaccgatcataaacagagaggggaaagtggtcggactttacggcaatggcgtggttacgaagaacgggggatatgtgtctggtatcgcacagactaatgctgagccagacggccccacccctgaattagaggaagagatgttcaaaaagaggaacctgacaattatggatctccacccagggagtggaaaaacccgtaagtacttgcccgccatcgtccgcgaagctattaagcggagactgaggactctcatcctggcacctacacgagtggtagccgccgagatggaggaagctcttaaaggcctgccgatacggtatcaaaccacggcgactaagtccgagcatacaggtcgcgaaattgtggacttgatgtgccacgcaacctttaccatgagactactgagccccgttagggtcccaaattacaacctcatcatcatggatgaggcccatttcactgaccctgcttctattgccgcacgggggtacatcagcacacgagtgggaatgggcgaagccgctgcgatatttatgaccgccacacccccaggcactgcagatgctttccctcagtccaatgcccccattcaggacgaggagagagacatcccagaacgctcatggaacagtgggaatgagtggattacggattttgcaggaaaaaccgtgtggttcgtcccgagcatcaaggccggtaacgacatagctaactgtttaaggaaaaatggcaagaaggtaattcagctgtctcgtaaaacatttgatactgaatatcaaaagaccaaacttaacgactgggatttcgtggttacaaccgacatctccgagatgggggccaattttaaggcggatcgggtgatcgaccctagaaggtgcctgaaacccgtcattctcactgatggaccagagcgcgtgatcttggcaggccccatgcctgttacggccgcttcagccgctcagcgaagaggtcgggtggggaggaacccacagaaggaaaatgaccagtacattttcaccggccaacccctgaacaatgatgaggaccacgcacattggacagaagccaagatgctcctggacaacataaatactcctgagggaatcattccggctcttttcgaaccagagcgcgagaaaagtgccgcaatcgatggcgaatatcgtctaaagggggagagcagaaaaacctttgtcgaactgatgcggaggggagcgttgcccgtgtggttagcccacaaggtagcttccgagggtatcaaatacacagaccgcaagtggtgcttcgatggccagcgaaacaatcagattctggaagagaacatggacgtggagatatggaccaaagaaggggagaagaagaaactcagacctcggtggctggatgccaggacttattctgacccccttgcactgaaggaatttaaagatttcgctgccggacgcaagtcgatcgcactcgacttggttacagagattggcagagtcccaagccacctggcccataggacgcggaatgctctagataacctggtgatgctccacacctcagaacatggtgggaaagcgtaccgtcacgccgtggaggagcttcctgaaactatggagacactgttattgctgggcctcatgatcctgcttaccggaggcgcaatgctgtttctcatttccgggaagggaatcggtaagaccagtataggcttgatctgtgtcattgcttctagcgggatgctgtggatggccgaaatccccttacagtggattgcctccgcaatcgttctagagttctttatgatggtgctgctcataccagagcctgaaaaacaacgcacaccgcaggacaatcagcttgcttatgtagtgattggaatcctgactttggccgcgattatcgctgccaacgagatgggcctgctcgaaacgaccaagcgagatctgggtatgtcaaaagagcccggggtcgtgtctccaacaagctaccttgacgttgatctccaccctgcaagtgcctggactctgtacgctgtggcaaccacagtcataacccccatgttgagacatactatcgaaaattccacggccaacgtaagcctggcggctattgccaaccaagcagtggttttaatgggcctagacaagggatggccaatctctaaaatggacctgggcgtgcctctccttgccctggggtgctattcacaggtcaatcccttgacactgaccgctgccgtgctcctgcttattactcactacgcaatcataggaccgggcttacaggctaaggccaccagggaggcgcagaagcggacagccgcaggtattatgaaaaacccaactgtcgatgggatcatgaccatcgacctggatcctgtgatttatgactccaagttcgagaaacaactcggacaggttatgttgctggtgctatgtgctgtacagctgctccttatgcgcacaagttgggccctgtgcgaagcattgacgctggctaccggccccatcactacactctgggagggtagcccaggcaagttttggaataccactatagccgtgtcgatggccaacattttcagagggtcttacctggcgggagctggcttagcattttccatcatgaaaagcgtcgggacaggaaagaggggcaccggttcacagggggaaacgcttggagagaagtggaaaaagaaactgaatcaactcagtcggaaggaattcgatctatataaaaagtctggcattaccgaggttgaccgaacagaggccaaagaaggtctgaagagaggcgagatcactcatcacgctgtgtcccgcgggagcgccaagttgcagtggtttgtcgaaaggaacatggtgatacccgagggacgggtaatcgatctgggctgtgggcgtggaggctggtcatactattgcgcaggtctcaaaaaggtgaccgaagttagagggtacacaaaaggaggccctggccatgaggagccggtgcccatgagtacttacgggtggaatattgtcaagcttatgagcggaaaagacgtgttctatctgccacctgaaaagtgtgataccttgctgtgcgacatcggtgagtcctctcccagccctacagtcgaagagtccaggaccattcgcgtgctcaagatggttgagccatggttaaaaaacaatcagttctgtatcaaggtactgaacccctacatgcctactgtgattgaacaccttgagcggctgcagcgaaaacacggcgggatgctagtcagaaatccactctcaaggaactctacgcatgaaatgtattggatcagtaatggaacaggcaacatagtggcctcggttaatatggtgagccgcctgttgctgaaccggtttaccatgactcacagacgtcccaccattgagaaggatgtcgacctcggtgctgggacaaggcatgtgaacgcggaaccggagacgcctaatatggatgtaatcggagagcggatcaaacgcattaaggaagagcacaactccacctggcactacgacgacgaaaatccatataagacttgggcctaccatggctcttatgaggtgaaagcaacaggctcagctagctccatgataaacggggttgtcaagcttctgaccaaaccctgggatgtggtgcctatggtcactcaaatggccatgacagacaccacaccattcggacagcagcgagtttttaaggaaaaagtggatactagaacccccaggagtatgccgggtacgcggcgcgtaatgggcatcaccgcagagtggttatggagaacactggggaggaataagaagcctcgattgtgcactcgggaggaattcaccaaaaaggtgcgtacaaacgccgctatgggagccgtctttactgaggaaaatcaatgggactctgcgaaagcagccgtggaggatgaagacttctggaagctcgttgatagagagcgcgagctgcacaaactaggcaagtgtggtagctgcgtgtacaacatgatggggaaaagggaaaagaagcttggagagtttggcaaagctaagggctcacgggccatttggtacatgtggctgggggcaagatatctcgaattcgaggctctgggatttttgaatgaggaccattggttctcccgcgaaaacagttacagcggtgtcgagggcgaagggctgcacaaactcggatatatccttagggatatttctaagatccccggcggtgccatgtacgctgacgataccgccgggtgggacacgcgaataacagaggacgatctgcataatgaagagaaaatcacccagcagatggacccagagcaccggcagttagcaaacgcgatttttaagctgacttatcaaaataaggtggtaaaagttcagagacctacacccaccggaactgtgatggatatcatttccaggaaggaccagcgcggctcaggccaggtcgggacctacggattgaacacattcacgaatatggaagcccaactcatccgtcagatggagggtgaaggcgtgctgagcaaagctgatctagagaacccacaccttcccgaaaagaaaataacccagtggctggagactaagggggtggagcggctcaagagaatggccatttcgggagacgattgcgtcgttaaacctatcgacgataggtttgcaaacgctctgttggccttaaatgacatgggcaaggtgcgcaaagatatcccacagtggcaaccgtctaagggttggcatgactggcagcaggtacccttctgtagtcaccatttccacgaactgattatgaaagatgggcgaaagctcgtggtcccttgccggccacaggacgagcttataggaagagcaaggatctcccaaggcgccggctggagcctgcgcgaaacagcgtgtctagggaaggcttatgcccagatgtggtcactgatgtactttcacagacgggacctcaggttggcatccaacgccatttgctctgctgtgcccgttcattgggtgcctaccagccgtactacatggagtatccacgcccatcaccagtggatgaccacggaggatatgctgacagtctggaatcgagtgtggattgaagacaacccatggatggaggataaaacccccgtaactacctgggagaatgttccttaccttggaaagcgcgaagaccaatggtgtggttccctgatcggcctcacaagcagagcaacttgggctcagaacataccgaccgccatccagcaggtgcggtctttaattgggaatgaggaattcctggattatatgccatcaatgaaaaggtttcgcaaggaggaggaaagtgagggagcgatctggtga

SEQ ID NO: 15447 - RNA, 9873 nt, synthetic construct
  misc_feature 1..9873: note = derived and/or modified CDS sequence (opt3) from DENV-3__FJ205871__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagcatacacccagttgtgtgaccaccgcctcatgtcagccgctgtgaaggatgagagagccgttcacgcagacatgggatactggattgagagtcagaaaaacggcagctggaagctggaaaaagcgtccctaatcgaggtgaagacttgcacctggcctaagtctcatacactgtggtcgaatggtgtactcgaaagcgatatgataatcccaaaatccctggccggcccgatttcacagcacaactataggcccgggtaccatactcaaaccgctggaccttggcaccttggcaagttggagctggactttaattattgcgaggggacaacggtcgtgatcaccgaaaactgtggaactcgtggcccaagtttacggacaaccactgtgtctggtaaactcattcacgagtggtgctgtcgaagctgcacactgccccctcttagatacatgggggaagatggatgttggtatggcatggagatcaggccaatatccgaaaaggaggagaatatggtcaaatcactggttagcgccggttctggcaaggtggacaacttcaccatgggggtattgtgcctcgcaattctgtttgaagaggtgatgcgcggaaagttcggcaaaaagcatatgatcgctggggtcttctttacgttcgtgctactgctctccggacagatcacttggcgggatatggcccacaccctgattatgatcggcagtaatgcaagcgacagaatgggtatgggggttacataccttgccttgattgctacctttaaaatacagcccttcctggcgttaggatttttcctcaggaagctgacttctcgcgaaaaccttctgctaggcgtgggcctcgccatggcaacaaccctgcaattgccggaggatatcgaacagatggctaatgggattgccctgggattaatggccctcaaactgacaactcagtttgagacctatcagctttggacggctctgatctccttgacatgttcaaacaccattttcactctcaccgtcgcatggcgaacagccactctgatcctagcgggtgtgagtctgcttcctgtttgccaaagctcgtccatgcggaagaccgactggctcccaatgacggtggctgccatgggcgtcccccctctgcccttgtttatattctctctgaaggatacattaaaacgtagaagctggccactcaatgagggggtaatggcagtgggactggtttcaatccttgccagttccctgttgaggaacgacgtgcctatggctggccccctcgtcgcaggtgggctgctaattgcctgttacgtgatcaccggaacttctgcggatctgacagtagaaaaggctgccgacgtgacctgggaggaagaggcagaacagactggcgtcagccataaccttatgattacagttgacgatgacggcaccatgcgcatcaaagatgacgagacggagaatatactcactgtgctgttgaagaccgccttactgattgtgtccgggatctttccatactcaatcccggctacactcctggtctggcacacctggcagaaacagacacaacggagcggagtgctttgggatgttcctagtcccccagaaactcagaaggccgagctggaagagggtgtatatagaattaaacagcagggcatattcgggaagacccaagtgggagtcggcgtgcagaaggagggtgtttttcatacgatgtggcacgtgacaaggggggcagtcttgacttacaacggaaaacgactagaacccaattgggcttctgtgaagaaagacctgatctcctatggcggcgggtggcgcctcagcgcccagtggcaaaagggagaggaagtacaggtcattgcggtggagcctggtaaaaacccaaagaatttccagaccatgcccggcacattccagaccactaccggggaaatcggagccattgcactggattttaagcctggcacatcgggttcaccgatcataaaccgggaggggaaagttgtgggactttacggcaatggcgtcgtgacgaagaacgggggatatgtttctggtatcgctcaaactaatgccgagccagacggccccacccctgaattagaggaagagatgttcaaaaagagaaacctgacaattatggatctccacccagggagtggaaaaaccaggaagtacttgcccgctatcgtgcgtgaagcaattaagcgccggctgagaactctcatcctggcccctacaagggtcgtggccgctgagatggaggaagcgcttaaaggcctgccgatacgatatcagaccacggcaactaagtccgagcatacaggtcgggaaattgtagacttgatgtgccacgccacctttaccatgcgcctactgagccccgtgagagttccaaattacaacctcatcatcatggatgaggctcatttcactgaccctgcctctattgcagccagggggtacatcagcacacgggtcggaatgggcgaagctgcggccatatttatgaccgcaacacccccaggcactgctgatgccttccctcagtccaatgcacccattcaggacgaggagcgagacatcccagaaagatcatggaacagtgggaatgagtggattacggattttgccggaaaaaccgtgtggttcgtgccgagcatcaaggctggtaacgacatagccaactgtttacgcaaaaatggcaagaaggtcattcaactgtctaggaaaacatttgatactgaatatcagaagaccaaacttaacgactgggatttcgtagtgacaaccgacatctccgagatgggggcgaattttaaggcagatcgtgttatcgaccctcggagatgcctgaaacccgtgattctcactgatggaccagagagggtcatcttggccggccccatgcctgtgacggctgcctcagctgcacagcgccgaggtagagttgggcggaacccacagaaggaaaatgaccaatacattttcaccggccagcccctgaacaatgatgaggaccacgcccattggacagaagctaagatgctcctggacaacataaatactcctgagggaatcattccggcccttttcgaaccagagagggagaaaagtgcagcgatcgatggcgaatatcgcctaaagggggagagccgtaaaacctttgtggaactgatgagacggggagacttgcccgtctggttagcccacaaggtggcttccgagggtatcaaatacacagataggaagtggtgcttcgacggccagcgcaacaatcagattctggaagagaacatggatgtagagatatggaccaaagaaggggagaagaagaaactccgacctagatggctggacgcccggacttattctgatccccttgcactgaaggaatttaaagacttcgctgccggaaggaagtcgatcgcactcgatttggtgacagagattggccgcgttccaagccacctggcccatagaacgaggaatgctctagacaacctggtcatgctccacacctcagaacatggtgggaaagcgtaccggcacgccgtggaggagcttcctgaaactatggagacactgttattgctgggcctcatgatcctgcttaccggaggcgcaatgctgtttctcatttccgggaagggaatcggtaagaccagtataggcttgatctgtgtgattgcttctagcgggatgctgtggatggccgaaatccccttacaatggattgcctccgcaatcgtcctagagttctttatgatggttctgctcataccagagcctgaaaaacagcgtacaccgcaggataatcaacttgcttatgtggtaattggaatcctgactttggccgcgattatcgctgccaacgagatgggcctgctcgaaacgaccaagcgcgacctgggtatgtcaaaagagcccggggtggtctctccaacaagctaccttgatgtggacctccaccctgcaagtgcctggactctgtacgctgttgcaaccacagtgataacccccatgttgcgacatactatcgaaaattccacggccaacgtcagcctggcggctattgccaaccaggcagtagtgttaatgggcctagacaagggatggccaatctctaaaatggatctgggcgttcctctccttgccctggggtgctattcacaggtgaatcccttgacactgaccgctgccgtcctcctgcttattactcactacgcaatcataggaccgggcttacaggctaaggccaccagagaggcgcaaaagaggacagccgcaggtattatgaaaaacccaactgtggacgggatcatgaccatcgatctggaccctgtcatttatgattccaagttcgagaaacagctcggacaggtgatgttgctggttctatgtgctgtgcagctgctccttatgcggacaagttgggccctgtgcgaagcattgacgctggctaccggccccatcactacactctgggagggtagcccaggcaagttttggaataccactatagccgtatcgatggccaacattttccgcgggtcttacctggcgggagctggcttagcattttccatcatgaaaagcgtggggacaggaaagagaggcaccggttcacaaggggaaacgcttggagagaagtggaaaaagaaactgaatcagctcagtaggaaggaattcgacctatataaaaagtctggcattaccgaggtcgatcggacagaggccaaagaaggtctgaagcgaggcgagatcactcatcacgctgtttccagagggagcgccaagttgcagtggtttgtggaacgcaacatggtcatacccgagggaagggtgatcgacctgggctgtgggcggggaggctggtcatactattgcgcaggtctcaaaaaggtaaccgaagtgcgtgggtacacaaaaggaggccctggccatgaggagccggttcccatgagtacttacgggtggaatattgtgaagcttatgagcggaaaagatgtcttctatctgccacctgaaaagtgtgacaccttgctgtgcgatatcggtgagtcctctcccagccctacagtggaagagtccagaaccattagggtcctcaagatggtggagccatggttaaaaaacaatcagttctgtatcaaggttctgaacccctacatgcctactgtaattgaacaccttgagcgcctgcaacggaaacacggcgggatgctagtgcgaaatccactctcaagaaactctacgcatgaaatgtattggatcagtaatggaacaggcaacatagtcgcctcggtgaatatggttagcaggctgttgctgaaccgctttaccatgactcaccggagacccaccattgagaaggacgtggatctcggtgctgggacacgtcatgtcaacgcggaaccggagacgcctaatatggacgtgatcggagagaggatcaaacggattaaggaagagcacaactccacctggcactacgacgatgaaaatccatataagacttgggcctaccatggctcttatgaggtaaaagcaacaggctcagctagctccatgataaacggggtggttaagcttctgaccaaaccctgggacgtcgtgcctatggtgactcagatggccatgacagataccacaccattcggacagcaacgcgtctttaaggaaaaagttgacactcgaacccccagaagtatgccgggtacgaggcgggtgatgggcatcaccgcagagtggttatggcgcacactggggagaaataagaagcctaggttgtgcactcgagaggaattcaccaaaaaggtacggacaaacgccgctatgggagccgtgtttactgaggaaaatcagtgggattctgcgaaagcagccgtcgaggacgaagatttctggaagctcgtggaccgtgagagagagctgcacaaactaggcaagtgtggtagctgcgtttacaacatgatggggaaacgcgaaaagaagcttggagagtttggcaaagctaagggctcaagggccatttggtacatgtggctgggggcacggtatctcgaattcgaggctctgggatttttgaatgaggatcattggttctccagagaaaacagttacagcggtgtggagggcgaagggctgcacaaactcggatatatccttcgcgacatttctaagatccccggcggtgccatgtacgctgatgacaccgccgggtgggacacgaggataacagaggatgacctgcataatgaagagaaaatcacccagcagatggatccagagcaccgacaattagcaaacgcgatttttaagctgacttatcagaataaggtcgtgaaagtacagcggcctacacccaccggaactgttatggacatcatttccagaaaggatcagaggggctcaggccaagtggggacctacggattgaacacattcacgaatatggaagcccagctcatccgccagatggagggtgaaggcgtcctgagcaaagctgacctagagaacccacaccttcccgaaaagaaaataacccagtggctggagactaagggggtggagcgtctcaagcggatggccatttcgggagatgactgcgtggtcaaacctatcgatgacagatttgcaaacgctctgttggccttaaatgatatgggcaaggttaggaaagacatcccacaatggcagccgtctaagggttggcatgattggcagcaggtgcccttctgtagtcaccatttccacgaactgattatgaaagacgggcgcaagctcgtagtgccttgccgaccacaagacgagcttataggacgggcaagaatctcccagggcgccggctggagcctgagggaaacagcgtgtctagggaaggcttatgcccagatgtggtcactgatgtactttcaccgcagagatctccggttggcatccaacgccatttgctctgctgtccccgtgcattgggttcctaccagcaggactacatggagtatccacgcccatcaccaatggatgaccacggaggacatgctgacagtgtggaatcgtgtctggattgaagataacccatggatggaggacaaaacccccgtgactacctgggagaatgtaccttaccttggaaagcgagaagatcagtggtgtggttccctgatcggcctcacaagccgcgcaacttgggctcagaacataccgaccgccatccagcaagttagatctttaattgggaatgaggaattcctggactatatgccatcaatgaaacggtttaggaaggaggaggaaagtgagggagcgatctggtga

SEQ ID NO: 15448 - RNA, 9873 nt, synthetic construct
  misc_feature 1..9873: note = derived and/or modified CDS sequence (opt3) from DENV-3__FJ390375__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcaaggtagacaacttcaccatgggggtgttgtgcctcgccattctgtttgaagaggtcatgcgcggaaagttcggcaaaaagcatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaaaatacagcccttcctggctttaggatttttcctcaggaagctgacttctcgcgaaaaccttctgctaggcgtcggcctcgcgatggccacaaccctgcaattgccggaggatatcgaacagatggcaaatgggattgctctgggattaatggccctcaaactgacaactcagtttgagacctatcagctttggacggccctgatctccttgacatgttcaaacaccattttcactctcaccgtggcttggcgaacagcaactctgatcctagccggtgttagtctgcttcctgtgtgccaaagctcgtccatgcggaagaccgactggctcccaatgacggtcgcggctatgggcgtaccccctctgcccttgtttatattctctctgaaggatacattaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcaccggaacttctgccgatctgacagtggaaaaggcggctgacgtcacctgggaggaagaggccgaacagactggcgttagccataaccttatgattacagtggacgatgacggcaccatgcgcatcaaagatgacgagacggagaatatactcactgtgctgttgaagaccgcattactgattgtctccgggatctttccatactcaatcccggccacactcctggtgtggcacacctggcagaaacagacacaacggagcggagttctttgggatgtacctagtcccccagaaactcagaaggctgagctggaagagggtgtgtatagaattaaacagcagggcatattcgggaagacccaagtcggagtgggcgttcagaaggagggtgtgtttcatacgatgtggcacgtcacaaggggggccgtgttgacttacaacggaaaacgactagaacccaattgggcatctgtaaagaaagacctgatctcctatggcggcgggtggcgcctcagcgctcagtggcaaaagggagaggaagtccaggtgattgccgttgagcctggtaaaaacccaaagaatttccagaccatgcccggcacattccagaccactaccggggaaatcggagcgattgccctggattttaagcctggcacatcgggttcaccgatcataaaccgggaggggaaagtggtcggactttacggcaatggcgtggttacgaagaacgggggatatgtgtctggtatcgcacaaactaatgctgagccagacggccccacccctgaattagaggaagagatgttcaaaaagagaaacctgacaattatggatctccacccagggagtggaaaaaccaggaagtacttgcccgccatcgtccgtgaagctattaagcgccggctgagaactctcatcctggcacctacaagggtggtagccgccgagatggaggaagctcttaaaggcctgccgatacgatatcagaccacggcgactaagtccgagcatacaggtcgggaaattgtggacttgatgtgccacgcaacctttaccatgcgcctactgagccccgttagagtcccaaattacaacctcatcatcatggatgaggcccatttcactgaccctgcttctattgccgcaagggggtacatcagcacacgggtgggaatgggcgaagccgctgcgatatttatgaccgccacacccccaggcactgcagatgctttccctcagtccaatgcccccattcaggacgaggagcgagacatcccagaaagatcatggaacagtgggaatgagtggattacggattttgcaggaaaaaccgtgtggttcgtcccgagcatcaaggccggtaacgacatagctaactgtttacgcaaaaatggcaagaaggtaattcaactgtctaggaaaacatttgatactgaatatcagaagaccaaacttaacgactgggatttcgtggttacaaccgacatctccgagatgggggccaattttaaggcggatcgtgtgatcgaccctcggagatgcctgaaacccgtcattctcactgatggaccagagagggtgatcttggcaggccccatgcctgttacggccgcttcagccgctcagcgccgaggtagagtggggcggaacccacagaaggaaaatgaccaatacattttcaccggccagcccctgaacaatgatgaggaccacgcacattggacagaagccaagatgctcctggacaacataaatactcctgagggaatcattccggctcttttcgaaccagagagggagaaaagtgccgcaatcgatggcgaatatcgcctaaagggggagagccgtaaaacctttgtcgaactgatgagacggggagacttgcccgtgtggttagcgcacaaggtagcctccgagggtatcaaatacacagataggaagtggtgcttcgacggccagcgcaacaatcagattctggaagagaacatggatgtggagatatggaccaaagaaggggagaagaagaaactccgacctagatggctggacgctcggacttattctgatccccttgccctgaaggaatttaaagacttcgcagctggaaggaagtcgatcgccctcgatttggttacagagattggccgcgtcccaagccacctggcacatagaacgaggaatgccctagacaacctggtgatgctccacacctcagaacatggtgggaaagcttaccggcacgcggtggaggagcttcctgaaactatggagacactgttattgctgggcctcatgatcctgcttaccggaggcgccatgctgtttctcatttccgggaagggaatcggtaagaccagtataggcttgatctgtgtcattgcatctagcgggatgctgtggatggctgaaatccccttacaatggattgcctccgccatcgttctagagttctttatgatggtgctgctcataccagagcctgaaaaacagcgtacaccgcaggataatcaacttgcatatgtagtgattggaatcctgactttggctgccattatcgcggctaacgagatgggcctgctcgaaacgaccaagcgcgacctgggtatgtcaaaagagcccggggtcgtgtctccaacaagctaccttgatgttgacctccaccctgccagtgcatggactctgtacgccgtggctaccacagtcataacccccatgttgcgacatactatcgaaaattccacggcaaacgtaagcctggccgcgattgctaaccaggccgtggttttaatgggcctagacaagggatggccaatctctaaaatggatctgggcgtgcctctccttgcactggggtgctattcacaggtcaatcccttgacactgaccgccgctgtgctcctgcttattactcactacgccatcataggaccgggcttacaggcaaaggctaccagagaggcccaaaagaggacagcggccggtattatgaaaaacccaactgtcgacgggatcatgaccatcgatctggaccctgtgatttatgattccaagttcgagaaacagctcggacaggttatgttgctggtgctatgtgcagtacagctgctccttatgcggacaagttgggctctgtgcgaagccttgacgctggcaaccggccccatcactacactctgggagggtagcccaggcaagttttggaataccactatagctgtgtcgatggccaacattttccgcgggtcttacctggccggagcgggcttagctttttccatcatgaaaagcgtcgggacaggaaagagaggcaccggttcacaaggggaaacgcttggagagaagtggaaaaagaaactgaatcagctcagtaggaaggaattcgacctatataaaaagtctggcattaccgaggttgatcggacagaggcaaaagaaggtctgaagcgaggcgagatcactcatcacgccgtgtccagagggagcgctaagttgcagtggtttgtcgaacgcaacatggtgatacccgagggaagggtaatcgacctgggctgtgggcggggaggctggtcatactattgcgccggtctcaaaaaggtgaccgaagttcgtgggtacacaaaaggaggccctggccatgaggagccggtgcccatgagtacttacgggtggaatattgtcaagcttatgagcggaaaagatgtgttctatctgccacctgaaaagtgtgacaccttgctgtgcgatatcggtgagtcctctcccagccctacagtcgaagagtccagaaccattagggtgctcaagatggttgagccatggttaaaaaacaatcagttctgtatcaaggtactgaacccctacatgcctactgtgattgaacaccttgagcgcctgcaacggaaacacggcgggatgctagtccgaaatccactctcaagaaactctacgcatgaaatgtattggatcagtaatggaacaggcaacatagtggcatcggttaatatggtgagcaggctgttgctgaaccgctttaccatgactcaccggagacccaccattgagaaggacgtcgatctcggtgccgggacacgtcatgtgaacgctgaaccggagacgcctaatatggacgtaatcggagagaggatcaaacggattaaggaagagcacaactccacctggcactacgacgatgaaaatccatataagacttgggcgtaccatggctcttatgaggtgaaagccacaggctcagcaagctccatgataaacggggttgtcaagcttctgaccaaaccctgggacgtggtgcctatggtcactcagatggctatgacagataccacaccattcggacagcaacgcgtttttaaggaaaaagtggacactcgaacccccagaagtatgccgggtacgaggcgggtaatgggcatcaccgccgagtggttatggcgcacactggggagaaataagaagcctaggttgtgcactcgagaggaattcaccaaaaaggtgcggacaaacgcagccatgggagctgtctttactgaggaaaatcagtgggattctgccaaagcggcagtggaggacgaagatttctggaagctcgttgaccgtgagagagagctgcacaaactaggcaagtgtggtagctgcgtgtacaacatgatggggaaacgcgaaaagaagcttggagagtttggcaaagccaagggctcaagggctatttggtacatgtggctgggggcccggtatctcgaattcgaggcactgggatttttgaatgaggatcattggttctccagagaaaacagttacagcggtgtcgagggcgaagggctgcacaaactcggatatatccttcgcgacatttctaagatccccggcggtgctatgtacgccgatgacaccgctgggtgggacacgaggataacagaggatgacctgcataatgaagagaaaatcacccagcagatggatccagagcaccgacaattagccaacgcaatttttaagctgacttatcagaataaggtggtaaaagttcagcggcctacacccaccggaactgtgatggacatcatttccagaaaggatcagaggggctcaggccaagtcgggacctacggattgaacacattcacgaatatggaagcgcagctcatccgccagatggagggtgaaggcgtgctgagcaaagccgacctagagaacccacaccttcccgaaaagaaaataacccagtggctggagactaagggggtggagcgtctcaagcggatggctatttcgggagatgactgcgtcgttaaacctatcgatgacagatttgccaacgcactgttggctttaaatgatatgggcaaggtgaggaaagacatcccacaatggcagccgtctaagggttggcatgattggcagcaggtacccttctgtagtcaccatttccacgaactgattatgaaagacgggcgcaagctcgtggtcccttgccgaccacaagacgagcttataggacgggccagaatctcccagggcgcaggctggagcctgagggaaacagcctgtctagggaaggcgtatgctcagatgtggtcactgatgtactttcaccgcagagatctccggttggcctccaacgcaatttgctctgccgtgcccgttcattgggtgcctaccagcaggactacatggagtatccacgctcatcaccaatggatgaccacggaggacatgctgacagtctggaatcgtgtgtggattgaagataacccatggatggaggacaaaacccccgtaactacctgggagaatgttccttaccttggaaagcgagaagatcagtggtgtggttccctgatcggcctcacaagccgcgccacttgggcacagaacataccgaccgctatccagcaagtgagatctttaattgggaatgaggaattcctggactatatgccatcaatgaaacggtttaggaaggaggaggaaagtgagggagccatctggtga

SEQ ID NO: 15449 - RNA, 9873 nt, synthetic construct
  misc_feature 1..9873: note = derived and/or modified CDS sequence (opt3) from DENV-3__FJ390376__SS-prME
  source 1..9873: mol_type = other RNA
accagcctgtgcctcatgatgatccttccagccgctctggcattccacttgacttccagagacggagaacctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgaaggggcttggaggcaggtcgaaaaagtggagacttgggcattgcggcaccctggattcaccattctcgccctgtttctggctcattacatcggcacatctctcactcagaaggttgtgatattcaccttactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccaaaattcagggggaacaagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaactaagaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccaccagatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaacgcgaggagaatatggttaagtcactggtgagcgctggttctggcaaagtagacaacttcaccatgggggtgttgtgcctcgccattctgtttgaagaggtcatgcggggaaagttcggcaagaaacatatgatcgcaggggtgttctttacgttcgttctactgctctccggacagatcatttggagagatatggctcacactctgatcatgattggcagtaatgccagcgacaggatgggtatgggggtgacctaccttgcattgatagccacatttaagatccagcccttcctggctttaggatttttcctccgcaaactgacctctcgagaaaaccttctgctaggcgtcggcctcgcgatggccactacactgcaattgccggaggatattgaacagatggcaaatgggatcgctctgggattaatggccctcaagctgattacccagtttgagacatatcagctttggactgccctgatctccttgacctgttcaaacacgatattcacactcaccgtggcttggcggactgcaaccctgatcctagccggtgttagtctgcttcctgtgtgccaaagctcgtccatgcgtaaaacagactggctcccaatgactgtcgcggctatgggcgtaccccctctgcccttgtttattttctctctgaaggataccttaaagagaaggagctggccactcaatgagggggtgatggccgttggactggtgtcaatccttgcaagttccctgttgcgcaacgacgtccctatggccggccccctcgtggctggtgggctgctaattgcatgttacgtaatcacgggaacatctgccgatctgaccgtggaaaaagcggctgacgtcacttgggaggaagaggccgaacagacaggcgttagccataaccttatgataaccgtggacgatgacggcactatgcggattaaggatgacgagacagagaatatcctcaccgtgctgttgaaaacggcattactgatcgtctccgggatttttccatactcaataccggccactctcctggtgtggcacacctggcagaagcagacacaaagaagcggagttctttgggatgtacctagtcccccagaaacccagaaagctgagctggaagagggtgtgtataggatcaagcagcagggcattttcgggaaaacacaagtcggagtgggcgttcagaaggagggtgtgtttcatactatgtggcacgtcacccgaggggccgtgttgacgtacaacggaaagcgcctagaacccaattgggcatctgtcaagaaggacctgatctcctatggcggcgggtggcggctcagcgctcagtggcaaaaaggagaggaagtccaggtgattgccgttgagcctggtaagaaccccaagaatttccagacaatgcccggcactttccagaccacaaccggggaaatcggagcgatagccctggattttaagcctggcacttcgggttcaccgatcattaacagagaggggaaggtggtcggactttacggcaatggcgtggttaccaaaaacgggggatatgtgtctggtatcgcacaaacaaatgctgagccagacggccccacgcctgaattagaggaagagatgttcaagaaaaggaacctgactattatggatctccacccagggagtggaaagacccgtaaatacttgcccgccatcgtccgcgaagctataaagcggagactgaggacactcattctggcacctacccgagtggtagccgccgagatggaggaagctcttaagggcctgccgatccggtatcagactacagcgaccaaatccgagcatacgggtcgcgaaatcgtggacttgatgtgccacgcaacttttacaatgagactactgagccccgttagggtcccaaattacaacctcattatcatggatgaggcccatttcaccgaccctgcttctatagccgcacgggggtacattagcacccgagtgggaatgggcgaagccgctgcgatctttatgactgccacacccccaggcaccgcagatgctttccctcagtccaatgcccccattcaggacgaggagagagacatcccagaacgctcatggaacagtgggaatgagtggataacagattttgcaggaaagactgtgtggttcgtcccgagcattaaagccggtaacgacatcgctaactgtttaaggaagaatggcaaaaaggtaatccaactgtctcgtaagacgtttgataccgaatatcagaaaacaaaacttaacgactgggatttcgtggttactaccgacatttccgagatgggggccaattttaaagcggatcgggtgatcgaccctagaaggtgcctgaagcccgtcattctcacagatggaccagagcgcgtgatattggcaggccccatgcctgttaccgccgcttcagccgctcagcgaagaggtcgggtggggaggaacccacagaaagaaaatgaccaatacatcttcactggccagcccctgaacaatgatgaggaccacgcacattggacggaagccaagatgctcctggacaacattaatacccctgagggaatcatcccggctcttttcgaaccagagcgcgagaagagtgccgcaattgatggcgaatatcgtctaaaaggggagagcagaaagacatttgtcgaactgatgcggaggggagacttgcccgtgtggttagcgcacaaagtagcctccgagggtataaagtacactgatcgcaaatggtgcttcgacggccagcgaaacaatcagatcctggaagagaacatggatgtggagatttggaccaaggaaggggagaaaaagaagctcagacctcggtggctggacgctaggacatattctgatccccttgccctgaaagaatttaaggacttcgcagctggacgcaaatcgatcgccctcgatttggttaccgagattggcagagtcccaagccacctggcacataggactcggaatgccctagacaacctggtgatgctccacacatcagaacatggtgggaaggcttaccgtcacgcggtggaggagcttcctgaaacgatggagaccctgttattgctgggcctcatgatcctgcttactggaggcgccatgctgtttctcatatccgggaaaggaatcggtaagacaagtattggcttgatctgtgtcattgcatctagcgggatgctgtggatggctgaaatccccttacaatggatagcctccgccattgttctagagttctttatgatggtgctgctcatcccagagcctgaaaagcagcgcaccccgcaggataatcaacttgcatatgtagtgattggaatcctgaccttggctgccataatcgcggctaacgagatgggcctgctcgaaacaactaaacgagacctgggtatgtcaaaggagcccggggtcgtgtctccaacgagctaccttgatgttgacctccaccctgccagtgcatggaccctgtacgccgtggctacaactgtcattacccccatgttgagacatacaatcgaaaattccaccgcaaacgtaagcctggccgcgattgctaaccaggccgtggttttaatgggcctagacaaaggatggccaatctctaagatggatctgggcgtgcctctccttgcactggggtgctattcacaggtcaatcccttgactctgacggccgctgtgctcctgcttataacacactacgccattatcggaccgggcttacaggcaaaagctaccagggaggcccaaaagcggactgcggccggtatcatgaagaacccaaccgtcgacgggattatgacaatcgatctggaccctgtgatatatgattccaaattcgagaagcagctcggacaggttatgttgctggtgctatgtgcagtacagctgctccttatgcgcacaagttgggctctgtgcgaagccttgaccctggcaacaggccccattacgaccctctgggagggtagcccaggcaaattttggaatactacaatcgctgtgtcgatggccaacattttcagagggtcttacctggccggagcgggcttagctttttccatcatgaaaagcgtcgggaccggaaaaaggggcactggttcacaaggggaaacacttggagagaagtggaagaaaaagctgaatcagctcagtcggaaagagttcgacctatataagaaatctggcataaccgaggttgatcgaacggaggcaaaggaaggtctgaaaagaggcgagatcacccatcacgccgtgtcccgcgggagcgctaagttgcagtggtttgtcgaaaggaacatggtgattcccgagggacgggtaatcgacctgggctgtgggcgtggaggctggtcatactattgcgccggtctcaagaaagtgacagaagttagagggtacactaagggaggccctggccatgaggagccggtgcccatgagtacctacgggtggaatattgtcaaacttatgagcggaaaggatgtgttctatctgccacctgaaaaatgtgacacattgctgtgcgatatcggtgagtcctctcccagccctactgtcgaagagtccaggaccattcgcgtgctcaagatggttgagccatggttaaagaacaatcagttctgtatcaaagtactgaacccctacatgcctacagtgatagaacaccttgagcggctgcaacgaaagcacggcgggatgctagtcagaaatccactctcaaggaactctacccatgaaatgtattggattagtaatggaactggcaacatcgtggcatcggttaatatggtgagccgcctgttgctgaaccggtttacgatgacacacagacgtcccaccatcgagaaagacgtcgatctcggtgccgggactaggcatgtgaacgctgaaccggagacccctaatatggacgtaattggagagcggataaagcgcatcaaagaagaacacaactccacatggcactacgacgatgaaaatccatataagacgtgggcgtaccatggctcttatgaggtgaaggccaccggctcagcaagctccatgattaacggggttgtcaaacttctgactaagccctgggacgtggtgcctatggtcacacagatggctatgaccgatactacaccattcggacagcaacgagtttttaaagaaaaggtggacaccagaacacccaggagtatgccgggtactcggcgcgtaatgggcatcaccgccgagtggttatggagaacgctggggaggaataaaaagcctcgattgtgcacccgggaggagttcacaaagaaagtgcgtactaacgcagccatgggagctgtctttaccgaggaaaatcagtgggattctgccaaggcggcagtggaggacgaagatttctggaaactcgttgacagagagcgcgagctgcacaagctaggcaaatgtggtagctgcgtgtacaacatgatggggaagagggagaagaaacttggagagtttggcaaagccaaaggctcacgggctatttggtacatgtggctgggggccagatatctcgagttcgaggcactgggatttttgaatgaggatcattggttctcccgcgaaaacagttacagcggtgtcgagggcgaagggctgcacaagctcggatatatccttagggacatatctaaaatccccggcggtgctatgtacgccgatgacacagctgggtgggacactcgaattaccgaggatgacctgcataatgaagagaagatcacgcagcagatggatccagagcaccggcaattagccaacgcaatttttaaactgacatatcagaataaggtggtaaaggttcagagacctacccccactggaacagtgatggacatcatatccaggaaagatcagcgcggctcaggccaagtcgggacctacggattgaacactttcaccaatatggaagcgcagctcattcgtcagatggagggtgaaggcgtgctgagcaaggccgacctagagaacccacaccttcccgagaaaaagatcacacagtggctggagacgaaaggggtggagcggctcaagagaatggctatctcgggagatgactgcgtcgttaagcctattgatgacaggtttgccaacgcactgttggctttaaatgatatgggcaaagtgcgcaaggacataccacaatggcagccgtctaaaggttggcatgattggcagcaggtacccttctgtagtcaccatttccacgaactgatcatgaaggacgggcgaaaactcgtggtcccttgccggccacaagacgagcttattggcagagccaggatctcccagggcgcaggctggagcctgcgcgaaaccgcctgtctagggaaggcgtatgctcagatgtggtcactgatgtactttcacagacgggatctcaggttggcctccaacgcaatttgctctgccgtgcccgttcattgggtgcctactagccgtacaacctggagtatccacgctcatcaccaatggatgactacagaggacatgctgaccgtctggaatcgagtgtggatagaagataacccatggatggaggacaagacgcccgtaacaacctgggagaatgttccttaccttggaaaacgcgaagatcagtggtgtggttccctgatcggcctcactagcagagccacctgggcacagaacattccgacagctatccagcaagtgcggtctttaattgggaatgaggagttcctggactatatgccatcaatgaagaggtttcgcaaagaggaggaaagtgagggagccatctggtga

SEQ ID NO: 15450 - RNA, 9873 nt, synthetic construct
  misc_feature 1..9873: note = derived and/or modified CDS sequence (opt3) from DENV-3__FJ390377__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcaccttactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccaccagatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcaaggtagacaacttcaccatgggggtgttgtgcctcgccattctgtttgaagaggtcatgcgcggaaagttcggcaaaaagcatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaaaatacagcccttcctggctttaggatttttcctcaggaagctgacttctcgcgaaaaccttctgctaggcgtcggcctcgcgatggccacaaccctgcaattgccggaggatatcgaacagatggcaaatgggattgctctgggattaatggccctcaaactgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaagactgactggctcccaatgaccgtcgcggctatgggcgtaccccctctgcccttgtttatcttctctctgaaggatacgttaaaacgtagaagctggccactcaatgagggggtgatggccgttggactggtgtcaattcttgcaagttccctgttgaggaacgacgtccctatggccggccccctcgtggctggtgggctgctaatcgcatgttacgtaattacaggaacctctgccgatctgactgtggaaaaggcggctgacgtcacatgggaggaagaggccgaacagaccggcgttagccataaccttatgatcactgtggacgatgacggcacaatgcgcataaaagatgacgagaccgagaatattctcacggtgctgttgaagactgcattactgatcgtctccgggatctttccatactcaattccggccaccctcctggtgtggcacacatggcagaaacagacccaacggagcggagttctttgggatgtacctagtcccccagaaacacagaaggctgagctggaagagggtgtgtatagaataaaacagcagggcatcttcgggaagactcaagtcggagtgggcgttcagaaggagggtgtgtttcataccatgtggcacgtcacgaggggggccgtgttgacatacaacggaaaacgactagaacccaattgggcatctgtaaagaaagacctgatttcctatggcggcgggtggcgcctcagcgctcagtggcaaaagggagaggaagtccaggtgatcgccgttgagcctggtaaaaacccaaagaatttccagactatgcccggcaccttccagacaaccactggggaaattggagcgatcgccctggattttaagcctggcacctcgggttcaccgataatcaaccgggaggggaaagtggtcggactttacggcaatggcgtggttacaaagaacgggggatatgtgtctggtattgcacaaacgaatgctgagccagacggccccactcctgaattagaggaagagatgttcaaaaagagaaacctgaccatcatggatctccacccagggagtggaaaaacaaggaagtacttgcccgccattgtccgtgaagctatcaagcgccggctgagaaccctcatactggcacctactagggtggtagccgccgagatggaggaagctcttaaaggcctgccgattcgatatcagacaaccgcgacgaagtccgagcatactggtcgggaaatcgtggacttgatgtgccacgcaacatttaccatgcgcctactgagccccgttagagtcccaaattacaacctcatcattatggatgaggcccatttcaccgaccctgcttctatcgccgcaagggggtacataagcactcgggtgggaatgggcgaagccgctgcgatttttatgacagccacccccccaggcacagcagatgctttccctcagtccaatgcccccatccaggacgaggagcgagacattccagaaagatcatggaacagtgggaatgagtggatcactgattttgcaggaaaaacggtgtggttcgtcccgagcataaaggccggtaacgacattgctaactgtttacgcaaaaatggcaagaaggtaatccaactgtctaggaaaacctttgatacagaatatcagaagactaaacttaacgactgggatttcgtggttaccacagacatctccgagatgggggccaattttaaggcggatcgtgtgattgaccctcggagatgcctgaaacccgtcatcctcaccgatggaccagagagggtgattttggcaggccccatgcctgttactgccgcttcagccgctcagcgccgaggtagagtggggcggaacccacagaaggaaaatgaccaatacatattcacgggccagcccctgaacaatgatgaggaccacgcacattggaccgaagccaagatgctcctggacaacatcaatacacctgagggaattatcccggctcttttcgaaccagagagggagaaaagtgccgcaatcgatggcgaatatcgcctaaagggggagagccgtaaaacttttgtcgaactgatgagacggggagacttgcccgtgtggttagcgcacaaggtagcctccgagggtattaaatacaccgataggaagtggtgcttcgacggccagcgcaacaatcagatactggaagagaacatggatgtggagatctggacaaaagaaggggagaagaagaaactccgacctagatggctggacgctcggacctattctgatccccttgccctgaaggaatttaaagacttcgcagctggaaggaagtcgattgccctcgatttggttactgagatcggccgcgtcccaagccacctggcacatagaacaaggaatgccctagacaacctggtgatgctccacacgtcagaacatggtgggaaagcttaccggcacgcggtggaggagcttcctgaaaccatggagactctgttattgctgggcctcatgattctgcttacaggaggcgccatgctgtttctcatctccgggaagggaataggtaagaccagtatcggcttgatttgtgtcatcgcatctagcgggatgctgtggatggctgaaattcccttacaatggatcgcctccgccatagttctagagttctttatgatggtgctgctcattccagagcctgaaaaacagcgtaccccgcaggataatcaacttgcatatgtagtgatcggaattctgacattggctgccatcatagcggctaacgagatgggcctgctcgaaactacgaagcgcgacctgggtatgtcaaaagagcccggggtcgtgtctccaaccagctaccttgatgttgacctccaccctgccagtgcatggacactgtacgccgtggctactaccgtcatcacacccatgttgcgacataccattgaaaattccactgcaaacgtaagcctggccgcgatcgctaaccaggccgtggttttaatgggcctagacaagggatggccaatttctaaaatggatctgggcgtgcctctccttgcactggggtgctattcacaggtcaatcccttgacgctgacagccgctgtgctcctgcttatcacccactacgccataattggaccgggcttacaggcaaaggctactagagaggcccaaaagaggaccgcggccggtatcatgaaaaacccaacagtcgacgggatcatgactattgatctggaccctgtgatctatgattccaagttcgagaaacagctcggacaggttatgttgctggtgctatgtgcagtacagctgctccttatgcggaccagttgggctctgtgcgaagccttgacactggcaacgggccccataaccactctctgggagggtagcccaggcaagttttggaatacaaccattgctgtgtcgatggccaacatcttccgcgggtcttacctggccggagcgggcttagctttttccattatgaaaagcgtcgggactggaaagagaggcacaggttcacaaggggaaacccttggagagaagtggaaaaagaaactgaatcagctcagtaggaaggaattcgacctatataaaaagtctggcatcacggaggttgatcggaccgaggcaaaagaaggtctgaagcgaggcgagataacacatcacgccgtgtccagagggagcgctaagttgcagtggtttgtcgaacgcaacatggtgatccccgagggaagggtaattgacctgggctgtgggcggggaggctggtcatactattgcgccggtctcaaaaaggtgactgaagttcgtgggtacaccaaaggaggccctggccatgaggagccggtgcccatgagtacatacgggtggaatatcgtcaagcttatgagcggaaaagatgtgttctatctgccacctgaaaagtgtgacactttgctgtgcgatattggtgagtcctctcccagccctaccgtcgaagagtccagaacaatcagggtgctcaagatggttgagccatggttaaaaaacaatcagttctgtattaaggtactgaacccctacatgcctaccgtgatcgaacaccttgagcgcctgcaacggaaacacggcgggatgctagtccgaaatccactctcaagaaactctactcatgaaatgtattggataagtaatggaacgggcaacattgtggcatcggttaatatggtgagcaggctgttgctgaaccgctttacaatgacccaccggagacccactatcgagaaggacgtcgatctcggtgccgggacccgtcatgtgaacgctgaaccggagacacctaatatggacgtaatcggagagaggattaaacggataaaggaagagcacaactccacgtggcactacgacgatgaaaatccatataagacctgggcgtaccatggctcttatgaggtgaaagccactggctcagcaagctccatgatcaacggggttgtcaagcttctgacaaaaccctgggacgtggtgcctatggtcacccagatggctatgactgatacaaccccattcggacagcaacgcgtttttaaggaaaaagtggacacacgaactcccagaagtatgccgggtaccaggcgggtaatgggcattacggccgagtggttatggcgcaccctggggagaaataagaagcctaggttgtgcacacgagaggaattcactaaaaaggtgcggaccaacgcagccatgggagctgtctttacagaggaaaatcagtgggattctgccaaagcggcagtggaggacgaagatttctggaagctcgttgaccgtgagagagagctgcacaaactaggcaagtgtggtagctgcgtgtacaacatgatggggaaacgcgaaaagaagcttggagagtttggcaaagccaagggctcaagggctatctggtacatgtggctgggggcccggtatctcgaattcgaggcactgggatttttgaatgaggatcattggttctccagagaaaacagttacagcggtgtcgagggcgaagggctgcacaaactcggatatattcttcgcgacatctctaagatacccggcggtgctatgtacgccgatgacactgctgggtgggacaccaggatcacggaggatgacctgcataatgaagagaaaattacacagcagatggatccagagcaccgacaattagccaacgcaatctttaagctgacctatcagaataaggtggtaaaagttcagcggcctactcccacaggaaccgtgatggacattatctccagaaaggatcagaggggctcaggccaagtcgggacttacggattgaacaccttcacaaatatggaagcgcagctcatacgccagatggagggtgaaggcgtgctgagcaaagccgacctagagaacccacaccttcccgaaaagaaaattacgcagtggctggagaccaagggggtggagcgtctcaagcggatggctatctcgggagatgactgcgtcgttaaacctatcgatgacagatttgccaacgcactgttggctttaaatgatatgggcaaggtgaggaaagacattccacaatggcagccgtctaagggttggcatgattggcagcaggtacccttctgtagtcaccatttccacgaactgataatgaaagacgggcgcaagctcgtggtcccttgccgaccacaagacgagcttatcggacgggccagaatttcccagggcgcaggctggagcctgagggaaactgcctgtctagggaaggcgtatgctcagatgtggtcactgatgtactttcaccgcagagatctccggttggcctccaacgcaatctgctctgccgtgcccgttcattgggtgcctacaagcaggaccacttggagtattcacgctcatcaccaatggatgacaaccgaggacatgctgacggtctggaatcgtgtgtggatcgaagataacccatggatggaggacaaaacacccgtaaccacttgggagaatgttccttaccttggaaagcgagaagatcagtggtgtggttccctgataggcctcaccagccgcgccacatgggcacagaacatcccgactgctattcagcaagtgagatctttaatcgggaatgaggaattcctggactatatgccatcaatgaaacggtttaggaaggaggaggaaagtgagggagccatttggtga

SEQ ID NO: 15451 - RNA, 9873 nt, synthetic construct
  misc_feature 1..9873: note = derived and/or modified CDS sequence (opt3) from DENV-3__FJ547069__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaatctggggggaacatcaatattcgcaggtcatttaaagtgtcggctgaaaatggacaagctagagctcaaaggcatgagttacgccatgtgcactaacacctttgtgctgaagaaagaggtcagcgaaacgcagcacgggaccatccttattaaggtggagtacaagggagaagatgttccctgtaaaatccctttctctacagaggacggccaaggtaaggctcataacgggcgtttgataactgcgaatccagtggtaaccaaaaaggaggaacccgtcaacattgaggcagaaccgcctttcggcgagtccaatatcgtgatcggaattggcgataacgccctgaaaatcaattggtataagaaggggtcaagcattggaaaaatgtttgaagctacagcccgcggtgcaagaaggatggccatactcggcgacactgcttgggatttcgggagtgttggaggcgtgctgaactctcttggtaagatggtccaccagatctttgggtccgcctacaccgcactgttcagcggcgtgtcgtgggtaatgaaaattggaatcggcgtgttgctcacgtggatcgggctgaattctaagaacacatccatgtcatttagttgcattgcgataggaatcattaccttatatctgggcgctgttgtccaggccgacatgggttgtgtgatcaattggaaagggaaggagctaaagtgcggaagcggcattttcgtgactaacgaggtccatacatggaccgaacagtacaaatttcaagcagattcccccaagcggctcgccactgctatcgccggtgcatgggagaatggcgtttgtgggatacgatctaccacacgcatggaaaacctgctttggaaacagatcgctaatgagttgaactatattctgtgggaaaataacatcaagctcacggtggtggtaggagacattatcggcgtcctggagcaggggaaaagaaccttaactccacagcctatggagctgaagtacagctggaaaacatggggaaaggccaagatagtgaccgcggaaacacaaaactcaagtttcattatcgatggccccaatactccagagtgcccctccgccagcagggcttggaacgtttgggaagtggaggactatggttttggggtcttcaccacgaatatttggcttaaattgcgggaagtgtacacacagctctgtgaccaccgcctgatgtctgcagccgttaaggatgagagagctgtgcacgccgacatgggatactggatcgagtcacagaaaaacggcagttggaagctagaaaaagcaagcctgatagaggtaaagacctgcacttggcctaagtcccataccctctggtctaatggtgtcctggaatcggatatgatcattccaaaaagccttgcgggcccgatctcccagcacaactataggcccgggtaccatacacaaactgccggaccttggcacttgggcaagctggagttagactttaattattgcgaggggaccacagtggtgattacggaaaactgtggaacccgtggcccatcactccggactacaaccgtcagtggtaaactgatccacgagtggtgctgtcgatcttgcactcttccccctctgagatacatgggggaagatggatgttggtatggcatggagataaggccaattagcgaaaaggaggagaatatggttaaatccttggtgtcagctggtagcggcaaggtagacaacttcacaatgggggtgctctgcctggccatcctatttgaagaggtcatgcgcggaaagttcggcaaaaagcatatgatcgcaggggtgttctttaccttcgttctgctcctgtctggacagattacgtggcgggatatggctcacactcttatcatgattggctccaatgccagtgacagaatgggtatgggggtgacctacttggcactgatagccacatttaaaatccagcccttcttagctctcggatttttcctgaggaagcttaccagccgcgaaaacctgctactcggcgtcggcctggcgatggccactacattgcaactgccggaggatattgaacagatggcaaatgggatcgctttaggactcatggccctgaaacttattacccagtttgagacatatcagctgtggactgccttgatctctctcacctgttccaacacgatattcacactgaccgtggcttggcgaactgcaaccctaatcctggccggtgtttcacttctccctgtgtgccaaagtagctcgatgcggaagacagactggctgccaatgactgtcgcggctatgggcgtaccccctttgcccctgtttattttctccttaaaggataccctcaaacgtagatcttggccactgaatgagggggtgatggccgttggacttgtgagcatcctggcatcaagtttgctcaggaacgacgtccctatggccggccccctggtggctggtgggctactgattgcatgttacgtaatcacgggaacatccgccgatcttaccgtggaaaaggcggctgacgtcacttgggaggaagaggccgaacagacaggcgtttctcataacctcatgataaccgtggacgatgacggcactatgcgcattaaagatgacgagacagagaatatcctgaccgtgttgttaaagacggcactgctcatcgtcagcgggatttttccatactccataccggccactctgcttgtgtggcacacctggcagaaacagacacaacggtcaggagttctgtgggatgtacctagccccccagaaacccagaaggctgagttggaagagggtgtgtatagaatcaaacagcagggcattttcgggaagacacaagtcggagtgggcgttcagaaggagggtgtgtttcatactatgtggcacgtcaccaggggggccgtgctaacgtacaacggaaaacgactggaacccaattgggcaagtgtaaagaaagacctcatctcttatggcggcgggtggcgcctgtccgctcagtggcaaaagggagaggaagtccaggtgattgccgttgagcctggtaaaaacccaaagaatttccagacaatgcccggcactttccagaccacaaccggggaaatcggagcgatagcccttgattttaagcctggcactagcggttcgccgatcattaaccgggaggggaaagtggtcggattatacggcaatggcgtggttaccaagaacgggggatatgtgtcaggtatcgcacaaacaaatgctgagccagacggccccacgcctgaactggaggaagagatgttcaaaaagagaaacctcactattatggatttgcacccagggtctggaaaaaccaggaagtacctgcccgccatcgtccgtgaagctataaagcgccggctcagaacactgattcttgcacctaccagggtggtagccgccgagatggaggaagctctgaaaggcttgccgatccgatatcagactacagcgaccaagagtgagcatacgggtcgggaaatcgtggacctaatgtgccacgcaacttttacaatgcgcctgctctcccccgttagagtcccaaattacaacttaattatcatggatgaggcccatttcaccgaccctgctagcatagccgcaagggggtacatttctacccgggtgggaatgggcgaagccgctgcgatctttatgactgccacacccccaggcaccgcagatgctttccctcagagcaatgcccccattcaggacgaggagcgagacatcccagaaagatcctggaactcagggaatgagtggataacagattttgcaggaaaaactgtgtggttcgtcccgagtattaaggccggtaacgacatcgctaactgtctgcgcaaaaatggcaagaaggtaatccaacttagcaggaaaacgtttgataccgaatatcagaagacaaaactgaacgactgggatttcgtggttactaccgacatttctgagatgggggccaattttaaggcggatcgtgtgatcgaccctcggagatgcctcaaacccgtcattttgacagatggaccagagagggtgatactggcaggccccatgcctgttaccgccgcttccgccgctcagcgccgaggtagagtggggcggaacccacagaaggaaaatgaccaatacatcttcactggccagcccctcaacaatgatgaggaccacgcacattggacggaagccaagatgctgcttgacaacattaatacccctgagggaatcatcccggctctattcgaaccagagagggagaaatcagccgcaattgatggcgaatatcgcctgaagggggagagtcgtaaaacatttgtcgaattgatgagacggggagacttacccgtgtggctggcgcacaaggtagccagcgagggtataaaatacactgataggaagtggtgcttcgacggccagcgcaacaatcagatcctcgaagagaacatggatgtggagatttggaccaaagaaggggagaagaagaaactgcgacctagatggcttgacgctcggacatattccgatcccctggccctcaaggaatttaaagacttcgcagctggaaggaagtctatcgccttggatctggttaccgagattggccgcgtcccatcgcacctagcacatagaactaggaatgccctggacaacctcgtgatgcttcacacaagcgaacatggtgggaaagcttaccggcacgcggtggaggagctgcctgaaacgatggagaccttattgctgctcggcctgatgatccttctgactggaggcgccatgctctttttgatatcagggaagggaatcggtaagacatccattggcctgatctgtgtcattgcaagttctgggatgttatggatggctgaaatccccctacaatggatagccagcgccattgttctggagttctttatgatggtgctccttatcccagagcctgaaaaacagcgtaccccgcaggataatcaactggcatatgtagtgattggaatcttgaccctggctgccataatcgcggctaacgagatgggcctcctggaaacaactaagcgcgaccttggtatgtccaaagagcccggggtcgtgtcaccaacgtcttacctcgatgttgacctgcaccctgccagcgcatggaccttgtacgccgtggctacaactgtcattacccccatgctgcgacatacaatcgaaaatagtaccgcaaacgtatccttagccgcgattgctaaccaggccgtggttctaatgggcctggacaagggatggccaatcagcaaaatggatctcggcgtgcctcttctggcattggggtgctattctcaggtcaatcccctgactctcacggccgctgtgctgcttttaataacacactacgccattatcggaccgggcctgcaggcaaaggctaccagagaggcccaaaagaggactgcggccggtatcatgaaaaacccaaccgtcgacgggattatgacaatcgatctcgaccctgtgatatatgattcaaagttcgagaaacagttgggacaggttatgctgctagtgctgtgtgcagtacagctccttctgatgcggacttcctgggctttgtgcgaagccctgaccctcgcaacaggccccattacgaccctgtgggagggtagtccaggcaagttttggaatactacaatcgctgtgagcatggccaacattttccgcgggtcgtacttagccggagcgggccttgctttttctatcatgaaatccgtcgggaccggaaagagaggcactggtagccaaggggaaacactgggagagaagtggaaaaagaaactcaatcagctatcaaggaaggaattcgacctgtataaaaagagtggcataaccgaggttgatcggacggaggcaaaagaaggtttgaagcgaggcgagatcacccatcacgccgtgtctagagggtccgctaagctgcagtggtttgtcgaacgcaacatggtgattcccgagggaagggtaatcgacctcggctgtgggcggggaggctggagctactattgcgccggtcttaaaaaggtgacagaagttcgtgggtacactaaaggaggccctggccatgaggagccggtgcccatgtcaacctacgggtggaatattgtcaagctgatgagtggaaaagatgtgttctatttgccacctgaaaagtgtgacacactgctctgcgatatcggtgagagctccccctctcctactgtcgaagagagcagaaccattagggtgttaaagatggttgagccatggctgaaaaacaatcagttctgtatcaaggtacttaacccctacatgcctacagtgatagaacacctggagcgcctacaacggaaacacggcgggatgctcgtccgaaatccactgtccagaaactcaacccatgaaatgtattggatttctaatggaactggcaacatcgtggcaagtgttaatatggtgtcgaggttgctgctcaaccgctttacgatgacacaccggagacccaccatcgagaaggacgtcgatcttggtgccgggactcgtcatgtgaacgctgaaccggagacccctaatatggacgtaattggagagaggataaaacggatcaaggaagagcacaacagcacatggcactacgacgatgaaaatccatataagacgtgggcgtaccatggctcctatgaggtgaaagccaccggctctgcatcaagcatgattaacggggttgtcaagctgttaactaaaccctgggacgtggtgcctatggtcacacagatggctatgaccgatactacaccattcggacagcaacgcgtttttaaggaaaaagtggacacccgaacacccagatccatgccgggtactaggcgggtaatgggcatcaccgccgagtggctgtggcgcacgttggggagaaataagaagcctaggctctgcacccgagaggaattcacaaaaaaggtgcggactaacgcagccatgggagctgtctttaccgaggaaaatcagtgggatagtgccaaagcggcagtggaggacgaagatttctggaagctggttgaccgtgagagagagctacacaaacttggcaagtgtggttcttgcgtgtacaacatgatggggaaacgcgaaaagaagctgggagagtttggcaaagccaagggcagcagggctatttggtacatgtggctcggggcccggtatctggaattcgaggcattgggatttctgaatgaggatcattggttctcaagagaaaactcctacagtggtgtcgagggcgaagggctccacaaacttggatatatcctgcgcgacataagcaagatccccggcggtgctatgtacgccgatgacacagctgggtgggacactaggattaccgaggatgacttacataatgaagagaaaatcacgcagcagatggatccagagcaccgacaactggccaacgcaatttttaagttgacatatcagaataaggtggtaaaagttcagcggcctacccccactggaacagtgatggacatcatatctagaaaggatcagaggggctccggccaagtcgggacctacggactcaacactttcaccaatatggaagcgcagctgattcgccagatggagggtgaaggcgtgctatcaaaagccgaccttgagaacccacacctgcccgaaaagaaaatcacacagtggctcgagacgaagggggtggagcgtctgaagcggatggctatcagcggagatgactgcgtcgttaaacctattgatgacagatttgccaacgcattgttagctctgaatgatatgggcaaggtgaggaaagacataccacaatggcagccgtcgaagggttggcatgattggcagcaggtacccttctgttctcaccatttccacgaactcatcatgaaagacgggcgcaagcttgtggtcccttgccgaccacaagacgagctgattggacgggccagaatcagtcagggcgcaggctggtccctaagggaaaccgcctgtctggggaaggcgtatgctcagatgtggagcctcatgtactttcaccgcagagatttgcggctggcctcaaacgcaatttgctccgccgtgcccgttcattgggtgcctacttctaggacaacctggagcatccacgctcatcaccaatggatgactacagaggacatgcttaccgtctggaatcgtgtgtggatagaagataacccatggatggaggacaaaacgcccgtaacaacctgggagaatgttccttacctgggaaagcgagaagatcagtggtgtggtagtctcatcggcttaacttcccgcgccacctgggcacagaacattccgacagctatccagcaagtgagaagcctgattgggaatgaggaattcttggactatatgccatctatgaaacggtttaggaaggaggaggaatcagagggagccatctggtga

SEQ ID NO: 15452 - RNA, 9873 nt, synthetic construct
  misc_feature 1..9873: note = derived and/or modified CDS sequence (opt3) from DENV-3__FJ562107__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttacgtgatcacgggaacatctgcagatctgaccgtcgaaaaggccgcggacgttacttgggaggaagaggctgaacagacaggcgtgagccataaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcacacctggcagaaacagacacaacggagcggagtactttgggatgtgcctagtcccccagaaacccagaaggccgagctggaagagggtgtctatagaatcaaacagcagggcattttcgggaagacacaagtgggagttggcgtgcagaaggagggtgtctttcatactatgtggcacgtgaccaggggggctgtattgacgtacaacggaaaacgactagaacccaattgggcctctgtcaagaaagacctgatctcctatggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttacggcaatggcgttgtgaccaagaacgggggatatgtctctggtatcgcccaaacaaatgcagagccagacggccccacgcctgaattagaggaagagatgttcaaaaagagaaacctgactattatggatctccacccagggagtggaaaaaccaggaagtacttgcccgctatcgtgcgtgaagccataaagcgccggctgagaacactcattctggctcctaccagggtagtggcagccgagatggaggaagcccttaaaggcctgccgatccgatatcagactacagctaccaagtccgagcatacgggtcgggaaatcgttgacttgatgtgccacgcgacttttacaatgcgcctactgagccccgtcagagtgccaaattacaacctcattatcatggatgaggcacatttcaccgaccctgcctctatagctgccagggggtacattagcacccgggtgggaatgggcgaagcagccgctatctttatgactgcgacacccccaggcaccgccgatgcattccctcagtccaatgctcccattcaggacgaggagcgagacatcccagaaagatcatggaacagtgggaatgagtggataacagattttgccggaaaaactgtctggttcgtaccgagcattaaggcaggtaacgacatcgccaactgtttacgcaaaaatggcaagaaggtgatccaactgtctaggaaaacgtttgataccgaatatcagaagacaaaacttaacgactgggatttcgttgtgactaccgacatttccgagatgggggctaattttaaggccgatcgtgtcatcgaccctcggagatgcctgaaacccgtgattctcacagatggaccagagagggttatattggcgggccccatgcctgtgaccgcagcctcagctgcccagcgccgaggtagagtcgggcggaacccacagaaggaaaatgaccaatacatcttcactggccagcccctgaacaatgatgaggaccacgctcattggacggaagcaaagatgctcctggacaacattaatacccctgagggaatcatcccggcccttttcgaaccagagagggagaaaagtgctgccattgatggcgaatatcgcctaaagggggagagccgtaaaacatttgtggaactgatgagacggggagacttgcccgtatggttagcatacaaggtggcgtccgagggtataaaatatactgataggaagtggtgcttcgacggccagcgcaacaatcagatcctggaagagaacatggatgttgagatttggaccaaagaaggggagaagaagaaactccgacctagatggctggacgcccggacatactctgatccccttgctctgaaggaatttaaagacttcgccgcaggaaggaagtcgatcgctctcgatttggtcaccgagattggccgcgtgccaagccacctggcccacagaactaggaatgcactagacaacctggtgatgctccatacatcagaacacggtgggaaagcctatcggcatgctgtcgaggagcttcctgaaacgatggagaccctgttattgctgggcctcatgatcctgcttactggaggcgcgatgctgtttctcatatccgggaagggaatcggtaagacaagtattggcttgatctgtgttattgcctctagcgggatgctgtggatggcagaaatccccttacaatggatagcttccgccattgtgctagagttctttatgatggtactgctcatcccagagcctgaaaaacagcgtaccccgcaggataatcaacttgcctacgtggtcattggaatcctgaccttggcagctataatcgccgcgaacgagatgggcctgctcgaaacaactaagcgcgacctgggtatgtcaaaagagcccggggtggtttctccaacgagctaccttgatgtggacctccaccctgctagtgcctggaccctgtatgcagtcgccacaactgtaattacccccatgttgcgacacacaatcgaaaattccaccgctaacgtgagcctggcagccattgcgaaccaggctgttgtgttaatgggcctagacaagggatggccaatctctaaaatggatctgggcgtccctctccttgccctggggtgctactcacaggtgaatcccttgactctgacggcagccgtcctcctgcttataacacattatgctattatcggaccgggcttacaggccaaggcaaccagagaggctcaaaagaggactgccgcgggtatcatgaaaaacccaaccgtggacgggattatgacaatcgatctggaccctgttatatacgattccaagttcgagaaacagctcggacaggtgatgttgctggtactatgtgccgtgcagctgctccttatgcggactagttgggcactgtgcgaagctttgaccctggccacaggccccattacgaccctctgggagggtagcccaggcaagttttggaatactacaatcgcagtctcgatggctaacattttccgcgggtcttatctggccggagccggcttagcgttttccatcatgaaaagcgttgggaccggaaagagaggcactggttcacaaggggaaacacttggagagaagtggaaaaagaaactgaatcagctcagtaggaaggaattcgacctatacaaaaagtctggcataaccgaggtggatcggacggaggctaaagaaggtctgaagcgaggcgagatcacccaccatgcagtctccagagggagcgccaagttgcagtggtttgtggaacgcaacatggtaattcccgagggaagggtgatcgacctgggctgtgggcggggaggctggtcatattactgcgctggtctcaaaaaggttacagaagtgcgtgggtacactaaaggaggccctggccacgaggagccggtccccatgagtacctatgggtggaatattgtgaagcttatgagcggaaaagatgtcttctacctgccacctgaaaagtgtgacacattgctgtgcgatatcggtgagtcctctcccagccctactgtggaagagtccagaaccattagggttctcaagatggtagagccatggttaaaaaacaatcagttctgtatcaaggtgctgaacccctatatgcctacagtcatagaacatcttgagcgcctgcaacggaaacacggcgggatgctagtgcgaaatccactctcaagaaactctacccacgaaatgtactggattagtaatggaactggcaacatcgttgcctcggtgaatatggtcagcaggctgttgctgaaccgctttacgatgacacatcggagacccaccatcgagaaggacgtggatctcggtgcagggactcgtcacgtaaacgccgaaccggagacccctaatatggacgtgattggagagaggataaaacggatcaaggaagagcataactccacatggcactatgacgatgaaaatccatacaagacgtgggcttatcacggctcttacgaggttaaagcgaccggctcagccagctccatgattaacggggtcgtgaagcttctgactaaaccctgggacgtggtccctatggttacacagatggcaatgaccgatactacaccattcggacagcaacgcgtgtttaaggaaaaagtagacacccgaacacccagaagtatgccgggtactaggcgggtgatgggcatcaccgctgagtggttatggcgcacgctggggagaaataagaagcctaggttgtgcacccgagaggaattcacaaaaaaggtccggactaacgccgcaatgggagccgtgtttaccgaggaaaatcagtgggattctgctaaagccgcggttgaggacgaagatttctggattctcgtggaccgtgagagagagctgcataagctaggcaaatgtggtagctgcgtctacaacatgatggggaagcgcgaaaaaaagcttggagagtttggcaaggcaaaaggctcaagggccatctggtatatgtggctgggggctcggtacctcgaattcgaggccctgggatttttgaatgaggatcactggttctccagagaaaacagttatagcggtgtggagggcgaagggctgcataagctcggatacatacttcgcgacatctctaaaattcccggcggtgcaatgtatgctgatgacacagccgggtgggacactaggatcaccgaggatgacctgcacaatgaagagaagattacgcagcagatggatccagagcatcgacaattagctaacgccatctttaaactgacataccagaataaggtagttaaggtgcagcggcctacccccactggaacagtcatggacataatttccagaaaagatcagaggggctcaggccaagtggggacctatggattgaacactttcaccaatatggaagcacagctcatccgccagatggagggtgaaggcgtgctgagcaaggcggacctagagaacccacaccttcccgaaaaaaagatcacacagtggctggagacgaaaggggtcgagcgtctcaagcggatggccatttcgggagatgactgcgttgtgaagcctatagatgacagatttgctaacgccctgttggcattaaatgatatgggcaaagtaaggaaggacatcccacaatggcagccgtctaaaggttggcacgattggcagcaggtgcccttctgtagtcatcacttccatgaactgattatgaaggacgggcgcaaactcgtcgtgccttgccgaccacaagacgagcttatcggacgggctagaatttcccagggcgccggctggagcctgagggaaaccgcatgtctagggaaggcctacgcgcagatgtggtcactgatgtactttcaccgcagagatctccggttggcttccaacgccatctgctctgcagttcccgtgcactgggtccctactagcaggacaacctggagtatacatgcccaccatcaatggatgactacagaggacatgctgaccgtgtggaatcgtgtatggatcgaagataacccatggatggaggacaagacgcccgttacaacctgggagaatgtgccttatcttggaaaacgagaagatcagtggtgtggttccctgattggcctcactagccgcgctacctgggcccagaacatcccgacagcaattcagcaagtcagatctttaatcgggaatgaggaattcctggactacatgccatcaatgaagcggtttaggaaagaggaggaaagtgagggagctatttggtga

SEQ ID NO: 15453 - RNA, 9873 nt, synthetic construct
  misc_feature 1..9873: note = derived and/or modified CDS sequence (opt3) from DENV-3__FJ547071__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatgactgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggaaaagactgcggacgtcacatgggaggaagaggctgaacagaccggcgttagccataaccttatgataactgtggacgatgacggcacaatgcgcattaaagatgacgagaccgagaatatcctcacggtgctgttgaagactgccttactgatcgtctccgggatttttccatactcaataccggcaaccctcctggtgtggcacacatggcagaaacagacccaacggagcggagttctttgggatgtacctagtcccccagaaacacagaaggccgagctggaagagggtgtgtatagaatcaaacagcagggcattttcgggaagactcaagtcggagtgggcgttcagaaggagggtgtgtttcataccatgtggcacgtcacgaggggggctgtgttgacatacaacggaaaacgactagaacccaattgggcctctgtaaagaaagacctgatctcctatggcggcgggtggcgcctcagcgcacagtggcaaaagggagaggaagtccaggtgattgctgttgagcctggtaaaaacccaaagaatttccagactatgcccggcaccttccagacaaccactggggaaatcggagccatagcgctggattttaagcctggcacctcgggttcaccgatcattaaccgggaggggaaagtggtcggactttacggcaatggcgtggttacaaagaacgggggatatgtgtctggtatcgcccaaacgaatgcagagccagacggccccactcctgaattagaggaagagatgttcaaaaagagaaacctgaccattatggatctccacccagggagtggaaaaacaaggaagtacttgcccgctatcgtccgtgaagccataaagcgccggctgagaaccctcattctggctcctactagggtggtagcagccgagatggaggaagcccttaaaggcctgccgatccgatatcagacaaccgctacgaagtccgagcatactggtcgggaaatcgtggacttgatgtgccacgcgacatttaccatgcgcctactgagccccgttagagtcccaaattacaacctcattatcatggatgaggcacatttcaccgaccctgcctctatagctgccagggggtacattagcactcgggtgggaatgggcgaagcagccgctatctttatgacagcgacccccccaggcacagccgatgcattccctcagtccaatgctcccattcaggacgaggagcgagacatcccagaaagatcatggaacagtgggaatgagtggataactgattttgccggaaaaacggtgtggttcgtcccgagcattaaggcaggtaacgacatcgccaactgtttacgcaaaaatggcaagaaggtaatccaactgtctaggaaaacctttgatacagaatatcagaagactaaacttaacgactgggatttcgtggttaccacagacatttccgagatgggggctaattttaaggccgatcgtgtgatcgaccctcggagatgcctgaaacccgtcattctcaccgatggaccagagagggtgatattggcgggccccatgcctgttactgcagcctcagctgcccagcgccgaggtagagtggggcggaacccacagaaggaaaatgaccaatacatcttcacgggccagcccctgaacaatgatgaggaccacgctcattggaccgaagcaaagatgctcctggacaacattaatacacctgagggaatcatcccggcccttttcgaaccagagagggagaaaagtgctgccattgatggcgaatatcgcctaaagggggagagccgtaaaacttttgtcgaactgatgagacggggagacttgcccgtgtggttagcacacaaggtagcgtccgagggtataaaatacaccgataggaagtggtgcttcgacggccagcgcaacaatcagatcctggaagagaacatggatgtggagatttggacaaaagaaggggagaagaagaaactccgacctagatggctggacgcccggacctattctgatccccttgctctgaaggaatttaaagacttcgccgcaggaaggaagtcgatcgctctcgatttggttactgagattggccgcgtcccaagccacctggcccatagaacaaggaatgcactagacaacctggtgatgctccacacgtcagaacatggtgggaaagcctaccggcacgctgtggaggagcttcctgaaaccatggagactctgttattgctgggcctcatgatcctgcttacaggaggcgcgatgctgtttctcatatccgggaagggaatcggtaagaccagtattggcttgatctgtgtcattgcctctagcgggatgctgtggatggcagaaatccccttacaatggatagcttccgccattgttctagagttctttatgatggtgctgctcatcccagagcctgaaaaacagcgtaccccgcaggataatcaacttgcctatgtagtgattggaatcctgacattggcagctataatcgccgcgaacgagatgggcctgctcgaaactacgaagcgcgacctgggtatgtcaaaagagcccggggtcgtgtctccaaccagctaccttgatgttgacctccaccctgctagtgcctggacactgtacgcagtggccactaccgtcattacacccatgttgcgacataccatcgaaaattccactgctaacgtaagcctggcagccattgcgaaccaggctgtggttttaatgggcctagacaagggatggccaatctctaaaatggatctgggcgtgcctctccttgccctggggtgctattcacaggtcaatcccttgacgctgacagcagccgtgctcctgcttataacccactacgctattatcggaccgggcttacaggccaaggcaactagagaggctcaaaagaggaccgccgcgggtatcatgaaaaacccaacagtcgacgggattatgactatcgatctggaccctgtgatatatgattccaagttcgagaaacagctcggacaggttatgttgctgattctatgtgccgtgcagctgctccttatgcggaccagttgggcactgtgcgaagctttgacactggccacgggccccatcaccactctctgggagggtagcccaggcaagttttggaatacaaccattgcagtatcgatggctaacatcttccgcgggtcttacctggccggagccggcttagcgttttccataatgaaaagcgtggggactggaaagagaggcacaggttcacaaggggaaacccttggagagaagtggaaaaagaaactgaatcagctcagtaggaaggaattcgacctatataaaaagtctggcatcacggaggtcgatcggaccgaggctaaagaaggtctgaagcgaggcgagattacacatcacgcagtttccagagggagcgccaagttgcagtggtttgtggaacgcaacatggtcatccccgagggaagggtgattgacctgggctgtgggcggggaggctggtcatactattgcgctggtctcaaaaaggtaactgaagtgcgtgggtacaccaaaggaggccctggccatgaggagccggttcccatgagtacatacgggtggaatatcgtgaagcttatgagcggaaaagatgtcttctatctgccacctgaaaagtgtgacactttgctgtgcgatattggtgagtcctctcccagccctaccgtggaagagtccagaacaatcagggtcctcaagatggtggagccatggttaaaaaacaatcagttctgtataaaggttctgaacccctacatgcctaccgtaattgaacaccttgagcgcctgcaacggaaacacggcgggatgctagtgcgaaatccactctcaagaaactctactcatgaaatgtattggatcagtaatggaacgggcaacatcgtcgcctcggtgaatatggttagcaggctgttgctgaaccgctttacaatgacccaccggagacccactattgagaaggacgtggatctcggtgcagggacccgtcatgtcaacgccgaaccggagacacctaatatggacgtgataggagagaggatcaaacggattaaggaagagcacaactccacgtggcactacgacgatgaaaatccatataagacctgggcttaccatggctcttatgaggtaaaagcgactggctcagccagctccatgatcaacggggtggttaagcttctgacaaaaccctgggacgtcgtgcctatggtgacccagatggcaatgactgatacaaccccattcggacagcaacgcgtctttaaggaaaaagttgacacacgaactcccagaagtatgccgggtaccaggcgggtgatgggcattacggctgagtggttatggcgcaccctggggagaaataagaagcctaggttgtgcacacgagaggaattcactaaaaaggtacggaccaacgccgcaatgggagccgtgtttacagaggaaaatcagtgggattctgctaaagccgcggtcgaggacgaagatttctggaagctcgtggaccgtgagagagagctgcacaaactaggcaagtgtggtagctgcgtttacaacatgatggggaaacgcgaaaagaagcttggagagtttggcaaagcaaagggctcaagggccatctggtacatgtggctgggggctcggtatctcgaattcgaggccctgggatttttgaatgaggatcattggttctccagagaaaacagttacagcggtgtggagggcgaagggctgcacaaactcggatatatacttcgcgacatctctaagattcccggcggtgcaatgtacgctgatgacactgccgggtgggacaccaggatcacggaggatgacctgcataatgaagagaaaattacacagcagatggatccagagcaccgacaattagctaacgccatctttaagctgacctatcagaataaggtcgtgaaagtacagcggcctactcccacaggaaccgttatggacataatttccagaaaggatcagaggggctcaggccaagtggggacttacggattgaacaccttcacaaatatggaagcacagctcatccgccagatggagggtgaaggcgtcctgagcaaagcggacctagagaacccacaccttcccgaaaagaaaatcacgcagtggctggagaccaagggggtggagcgtctcaagcggatggccatttcgggagatgactgcgtggtcaaacctatagatgacagatttgctaacgccctgttggcattaaatgatatgggcaaggttaggaaagacatcccacaatggcagccgtctaagggttggcatgattggcagcaggtgcccttctgtagtcaccatttccacgaactgattatgaaagacgggcgcaagctcgtagtgccttgccgaccacaagacgagcttatcggacgggctagaatttcccagggcgccggctggagcctgagggaaactgcatgtctagggaaggcctatgcgcagatgtggtcactgatgtactttcaccgcagagatctccggttggcttccaacgccatctgctctgcagtccccgtgcattgggttcctacaagcaggaccacttggagtatacacgcccatcaccaatggatgacaaccgaggacatgctgacggtgtggaatcgtgtctggatcgaagataacccatggatggaggacaaaacacccgtgaccacttgggagaatgtaccttaccttggaaagcgagaagatcagtggtgtggttccctgattggcctcaccagccgcgctacatgggcccagaacatcccgactgcaattcagcaagttagatctttaatcgggaatgaggaattcctggactatatgccatcaatgaaacggtttaggaaggaggaggaaagtgagggagctatttggtga

SEQ ID NO: 15454 - RNA, 9873 nt, synthetic construct
  misc_feature 1..9873: note = derived and/or modified CDS sequence (opt3) from DENV-3__FJ410176__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcagttctttacggacaaccactgtcagcggtaaactcattcacgagtggtgctgtcgatcctgcacactgccaccccttagatacatgggggaagatggatgttggtatggcatggagatcaggcctatatcagaaaaggaggagaatatggttaaaagcctggtgtctgctggttccggcaaggtagacaacttcaccatgggggtgttgtgcctcgccattctgtttgaagaggtcatgcgcggaaagttcggcaaaaagcatatgatcgcaggggtgctattcacgtttgttctgctcctgagtggacagatcacttggcgggatatggctcacacccttattatgatcggcagcaatgcctctgacagaatgggtatgggggtgacatacttggcactgattgccaccttcaaaatacagccatttttagctctcggattctttctgaggaagcttacttcccgcgaaaacctgctactcggcgtcggcctggcgatggccacaaccttgcaactgcccgaggatatcgaacagatggcaaatgggattgctttaggactcatggccctgaaacttacaactcagttcgagacctatcagctgtggacggccttgatctcactcacatgtagtaacaccatttttactctgaccgtggcttggcgaacagcaactctaatcctggccggtgttagccttctcccggtgtgccaatcgtcctctatgcggaagaccgactggctgcctatgacggtcgcggctatgggcgtaccacccttgcctctgttcatatttagcttaaaggatacactcaaacgtagatcatggcccctgaatgagggggtgatggccgttggacttgtgagtatcctggcatcctctttgctcaggaacgacgtcccaatggccggccctctggtggctggtgggctactgattgcatgttacgtaatcaccggaactagcgccgatcttacagtggaaaaggcggctgacgtcacctgggaggaagaggccgaacagactggcgtttcccataacctcatgattacagtggacgatgacggcaccatgcgcatcaaagatgacgagacggagaatatactgactgtgttgttaaagaccgcactgctcattgtctcagggatcttcccctacagcatcccagccacactgcttgtgtggcacacctggcagaaacagacacaacggagtggagttctgtgggatgtaccgtctcctcccgaaactcagaaggctgagttggaagagggtgtgtatagaattaaacagcagggcatatttgggaagacccaagtcggagtgggcgttcagaaggagggtgtgttccatacgatgtggcacgtcacaaggggggccgtgctaacttacaacggaaaacgactggaaccaaattgggcatccgtaaagaaagacctcatcagctatggcggcgggtggcgcctgtcggctcagtggcaaaagggagaggaagtccaggtgattgccgttgagcccggtaaaaaccctaagaattttcagaccatgccaggcacattccagaccactaccggggaaatcggagcgattgcccttgatttcaagcccggcacatcaggttctcctatcataaaccgggaggggaaagtggtcggattatacggcaatggcgtggttacgaagaacgggggatatgtgagtggtatcgcacaaactaatgctgagccggacggcccaacccccgaactggaggaagagatgtttaaaaagagaaacctcacaattatggatttgcaccctgggtccggaaaaaccaggaagtacctgccagccatcgtccgtgaagctattaagcgccggctcagaactctgatccttgcacccacaagggtggtagccgccgagatggaggaagctctgaaaggcttgcctatacgatatcagaccacggcgactaagagcgagcatacaggtcgggaaattgtggacctaatgtgccacgcaaccttcaccatgcgcctgctctctccggttagagtccccaattacaacttaatcatcatggatgaggcccattttactgacccagctagcattgccgcaagggggtacatctccacacgggtgggaatgggcgaagccgctgcgatattcatgaccgccacacctcccggcactgcagatgcttttccacagtcaaatgcccctattcaggacgaggagcgagacatccccgaaagaagttggaacagcgggaatgagtggattacggatttcgcaggaaaaaccgtgtggtttgtcccatctatcaaggccggtaacgacatagctaactgtctgcgcaaaaatggcaagaaggtaattcaactttccaggaaaacattcgatactgaatatcagaagaccaaactgaacgactgggattttgtggttacaaccgacatctcagagatgggggccaatttcaaggcggatcgtgtgatcgacccgcggagatgcctcaaacctgtcattttgactgatggacccgagagggtgatcctggcaggcccaatgcccgttacggccgctagtgccgctcagcgccgaggtagagtggggcggaaccctcagaaggaaaatgaccaatacatttttaccggccagccactcaacaatgatgaggaccacgcacattggacagaagccaagatgctgcttgacaacataaatactcccgagggaatcattcctgctctattcgaaccggagagggagaaaagcgccgcaatcgatggcgaatatcgcctgaagggggagtcccgtaaaaccttcgtcgaattgatgagacggggagacttaccagtgtggctggcgcacaaggtagcctctgagggtatcaaatacacagataggaagtggtgctttgacggccagcgcaacaatcagattctcgaagagaacatggatgtggagatatggaccaaagaaggggagaagaagaaactgcgacccagatggcttgacgctcggacttattcggatcctctggccctcaaggaattcaaagactttgcagctggaaggaagagcatcgccttggatctggttacagagattggccgcgtcccctcacacctagcacatagaacgaggaatgccctggacaacctcgtgatgcttcacacctccgaacatggtgggaaagcttaccggcacgcggtggaggagctgccagaaactatggagacattattgctgctcggcctgatgatccttctgaccggaggcgccatgctcttcttgattagtgggaagggaatcggtaagacctctataggcctgatctgtgtcattgcaagctccgggatgttatggatggctgaaatccctctacaatggattgcctcagccatcgttctggagtttttcatgatggtgctccttatacccgagccagaaaaacagcgtacacctcaggataatcaactggcatatgtagtgattggaatcttgactctggctgccattatcgcggctaacgagatgggcctcctggaaacgaccaagcgcgaccttggtatgtctaaagagccgggggtcgtgagccccacaagttacctcgatgttgacctgcacccagcctccgcatggactttgtacgccgtggctaccacagtcataacccctatgctgcgacatactatcgaaaatagcacggcaaacgtatctttagccgcgattgctaaccaggccgtggttctaatgggcctggacaagggatggcccatctcaaaaatggatctcggcgtgccacttctggcattggggtgctattcccaggtcaatcctctgacactcaccgccgctgtgctgcttttaattactcactacgccatcataggacccggcctgcaggcaaaggctaccagagaggcccaaaagaggacagcggccggtattatgaaaaacccgactgtcgacgggatcatgaccatcgatctcgacccagtgatttatgatagtaagtttgagaaacagttgggacaggttatgctgctagtgctgtgtgcagtacagctccttctgatgcggacaagctgggctttgtgcgaagccctgacgctcgcaaccggccctatcactacactgtgggagggttcgcccggcaagttctggaataccactatagctgtgtctatggccaacatttttcgcgggtcctacttagccggagcgggccttgctttcagcatcatgaaatcagtcgggacaggaaagagaggcaccggtagtcaaggggaaacgctgggagagaagtggaaaaagaaactcaatcagctatctaggaaggaatttgacctgtataaaaagtccggcattaccgaggttgatcggacagaggcaaaagaaggtttgaagcgaggcgagatcactcatcacgccgtgagcagagggtcagctaagctgcagtggttcgtcgaacgcaacatggtgataccagagggaagggtaatcgacctcggctgtgggcggggaggctggagttactattgcgccggtcttaaaaaggtgaccgaagttcgtgggtacacaaaaggaggccccggccatgaggagcctgtgccgatgagcacttacgggtggaatattgtcaagctgatgtccggaaaagatgtgttttatttgcccccagaaaagtgtgacaccctgctctgcgatatcggtgagtctagcccttcccccacagtcgaagagtcaagaaccattagggtgttaaagatggttgagccttggctgaaaaacaatcagttctgtatcaaggtacttaacccatacatgcccactgtgattgaacacctggagcgcctacaacggaaacacggcgggatgctcgtccgaaatcctctgtctagaaacagtacgcatgaaatgtattggatctcgaatggaacaggcaacatagtggcaagcgttaatatggtgtccaggttgctgctcaaccgcttcaccatgactcaccggagaccaaccattgagaaggacgtcgatcttggtgccgggacacgtcatgtgaacgctgaacccgagacgccgaatatggacgtaatcggagagaggatcaaacggattaaggaagagcacaactctacctggcactacgacgatgaaaatccttataagacttgggcgtaccatggctcatatgaggtgaaagccacaggcagcgcatccagtatgataaacggggttgtcaagctgttaaccaaaccatgggacgtggtgcccatggtcactcagatggctatgacagataccacaccttttggacagcaacgcgttttcaaggaaaaagtggacactcgaaccccaagatctatgcccggtacgaggcgggtaatgggcatcaccgccgagtggctgtggcgcacattggggagaaataagaagccgaggctctgcactcgagaggaatttaccaaaaaggtgcggacaaacgcagccatgggagctgtcttcactgaggaaaatcagtgggatagcgccaaagcggcagtggaggacgaagatttttggaagctggttgaccgtgagagagagctacacaaacttggcaagtgtggttcatgcgtgtacaacatgatggggaaacgcgaaaagaagctgggagagttcggcaaagccaagggctccagggctatttggtacatgtggctcggggcccggtatctggaatttgaggcattgggattcctgaatgaggatcattggtttagtagagaaaacagctactctggtgtcgagggcgaagggctccacaaacttggatatatcctgcgcgacatttccaagatccctggcggtgctatgtacgccgatgacaccgctgggtgggacacgaggataacagaggatgacttacataatgaagagaaaatcacccagcagatggatcccgagcaccgacaactggccaacgcaattttcaagttgacttatcagaataaggtggtaaaagttcagcggccaacacctaccggaactgtgatggacatcatttcaagaaaggatcagaggggcagcggccaagtcgggacctacggactcaacacatttacgaatatggaagcgcagctgatccgccagatggagggtgaaggcgtgctatcgaaagccgaccttgagaacccccacctgccagaaaagaaaataacccagtggctcgagactaagggggtggagcgtctgaagcggatggctatttctggagatgactgcgtcgttaaacccatcgatgacagattcgccaacgcattgttagctctgaatgatatgggcaaggtgaggaaagacatccctcaatggcagccaagtaagggttggcatgattggcagcaggtaccgttttgttcccaccatttccacgaactcattatgaaagacgggcgcaagcttgtggtcccctgccgacctcaagacgagctgataggacgggccagaatcagccagggcgcaggctggtcactaagggaaacagcctgtctggggaaggcgtatgctcagatgtggtccctcatgtacttccaccgcagagatttgcggctggcctctaacgcaatttgcagcgccgtgccagttcattgggtgcccaccagtaggactacatggtccatccacgctcatcaccaatggatgaccacggaggacatgcttacagtctggaatcgtgtgtggattgaagataacccttggatggaggacaaaaccccagtaactacctgggagaatgttccctacctgggaaagcgagaagatcagtggtgtggtagcctcatcggcttaacatctcgcgccacttgggcacagaacatacctaccgctatccagcaagtgagatcactgattgggaatgaggaatttttggactatatgccgagtatgaaacggttcaggaaggaggaggaatccgagggagccatctggtga

SEQ ID NO: 15455 - RNA, 9873 nt, synthetic construct
  misc_feature 1..9873: note = derived and/or modified CDS sequence (opt3) from DENV-3__FJ410177__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactggcggtccaagtttacgtacaaccactgtctctgggaaactcattcacgagtggtgctgtcggagctgcacactgccccctcttcgatacatgggagaagatggctgttggtatggtatggagatcagaccaatatccgaaaaggaggagaatatggttaaatcactggtgagcgctggctctgggaaggtagacaacttcaccatgggagtgttgtgcctcgccattctgtttgaagaggtcatgaggggcaagttcgggaaaaagcatatgatcgcaggagtgttctttacgttcgttctactgctctccggccagatcacttggcgcgatatggctcacaccctgattatgatcggtagtaatgccagcgaccggatggggatgggagtgacataccttgcattgattgccacctttaaaatacagcccttcctggctttaggctttttcctcagaaagctgacttctagggaaaaccttctgctaggcgtcgggctcgcgatggccacaaccctgcaattgccggaggatatcgaacagatggcaaatggaattgctctgggtttaatggccctcaaactgacaactcagtttgagacctatcagctttggacggccctgatctccttgacatgttcaaacaccattttcactctcaccgtggcttggcgcacagcaactctgatcctagccggcgttagtctgcttcctgtgtgccaaagctcgtccatgcgaaagaccgactggctcccaatgacggtcgcggctatgggggtaccccctctgcccttgtttatattctctctgaaggatacattaaaacggcgtagctggccactcaatgagggagtgatggccgttggcctggtgtcaatccttgcaagttccctgttgagaaacgacgtccctatggccggtcccctcgtggctgggggactgctaattgcatgttacgtaatcaccggcacttctgccgatctgacagtggaaaaggcggctgacgtcacctgggaggaagaggccgaacagactggcgttagccataaccttatgattacagtggacgatgacgggaccatgaggatcaaagatgacgagacggagaatatactcactgtgctgttgaagaccgcattactgattgtctccggaatctttccatactcaatcccggccacactcctggtgtggcacacctggcagaaacagacacaacgcagcggtgttctttgggatgtacctagtcccccagaaactcagaaggctgagctggaagagggcgtgtatcggattaaacagcaggggatattcggaaagacccaagtcggcgtgggtgttcagaaggagggggtgtttcatacgatgtggcacgtcacaagaggagccgtgttgacttacaacggcaaaaggctagaacccaattgggcatctgtaaagaaagacctgatctcctatggcgggggatggcgactcagcgctcagtggcaaaagggtgaggaagtccaggtgattgccgttgagcctggcaaaaacccaaagaatttccagaccatgcccgggacattccagaccactaccggagaaatcggcgcgattgccctggattttaagcctggtacatcggggtcaccgatcataaaccgcgagggaaaagtggtcggcctttacggcaatggggtggttacgaagaacggaggttatgtgtctggcatcgcacaaactaatgctgagccagacgggcccacccctgaattagaggaagagatgttcaaaaagcggaacctgacaattatggatctccacccaggaagtggcaaaaccagaaagtacttgcccgccatcgtcagggaagctattaagcgtcgcctgcggactctcatcctggcacctacaagagtggtagccgccgagatggaggaagctcttaaaggtctgccgataaggtatcagaccacggcgactaagtccgagcatacagggcgagaaattgtggacttgatgtgccacgcaacctttaccatgcggctactgagccccgttcgcgtcccaaattacaacctcatcatcatggatgaggcccatttcactgaccctgcttctattgccgcaagaggatacatcagcacaagggtgggcatgggcgaagccgctgcgatatttatgaccgccacacccccagggactgcagatgctttccctcagtccaatgcccccattcaggacgaggagcgggacatcccagaacgatcatggaacagtggaaatgagtggattacggattttgcaggtaaaaccgtgtggttcgtcccgagcatcaaggccggcaacgacatagctaactgtttaagaaaaaatgggaagaaggtaattcaactgtctcgcaaaacatttgatactgaatatcagaagaccaaacttaacgactgggatttcgtggttacaaccgacatctccgagatgggagccaattttaaggcggatagggtgatcgaccctcgtcggtgcctgaaacccgtcattctcactgatggcccagagagagtgatcttggcaggtcccatgcctgttacggccgcttcagccgctcagaggcgcgggcgagtgggcagaaacccacagaaggaaaatgaccaatacattttcaccggacagcccctgaacaatgatgaggaccacgcacattggacagaagccaagatgctcctggacaacataaatactcctgagggcatcattccggctcttttcgaaccagagcgggagaaaagtgccgcaatcgatggggaatataggctaaagggagagagccgcaaaacctttgtcgaactgatgcgtagaggtgacttgcccgtgtggttagcgcacaaggtagcctccgagggcatcaaatacacagatcggaagtggtgcttcgacgggcagaggaacaatcagattctggaagagaacatggatgtggagatatggaccaaagaaggagagaagaagaaactccgccctcgatggctggacgctagaacttattctgatccccttgccctgaaggaatttaaagacttcgcagctggccggaagtcgatcgccctcgatttggttacagagattggtagggtcccaagccacctggcacatcgcacgagaaatgccctagacaacctggtgatgctccacacctcagaacatgggggcaaagcttacaggcacgcggtggaggagcttcctgaaactatggagacactgttattgctgggactcatgatcctgcttaccggcggggccatgctgtttctcatttccggaaagggtatcggcaagaccagtatagggttgatctgtgtcattgcatctagcggaatgctgtggatggctgaaatccccttacaatggattgcctccgccatcgttctagagttctttatgatggtgctgctcataccagagcctgaaaaacagcggacaccgcaggataatcaacttgcatatgtagtgattggcatcctgactttggctgccattatcgcggctaacgagatgggtctgctcgaaacgaccaagcgtgacctggggatgtcaaaagagcccggcgtcgtgtctccaacaagctaccttgatgttgacctccaccctgccagtgcatggactctgtacgccgtggctaccacagtcataacccccatgttgcgccatactatcgaaaattccacggcaaacgtaagcctggccgcgattgctaaccaggccgtggttttaatgggactagacaagggctggccaatctctaaaatggatctgggggtgcctctccttgcactgggatgctattcacaggtcaatcccttgacactgaccgccgctgtgctcctgcttattactcactacgccatcataggcccgggtttacaggcaaaggctacccgagaggcccaaaagagaacagcggccgggattatgaaaaacccaactgtcgacggaatcatgaccatcgatctggaccctgtgatttatgattccaagttcgagaaacagctcggccaggttatgttgctggtgctatgtgcagtacagctgctccttatgaggacaagttgggctctgtgcgaagccttgacgctggcaaccggtcccatcactacactctgggagggcagcccagggaagttttggaataccactatagctgtgtcgatggccaacattttccggggatcttacctggccggcgcggggttagctttttccatcatgaaaagcgtcggaacaggcaagcgcggtaccgggtcacaaggagaaacgcttggcgagaagtggaaaaagaaactgaatcagctcagtagaaaggaattcgacctatataaaaagtctggtattaccgaggttgataggacagaggcaaaagaaggcctgaagcggggggagatcactcatcacgccgtgtcccgaggaagcgctaagttgcagtggtttgtcgaaagaaacatggtgatacccgagggccgcgtaatcgacctggggtgtggaaggggcggttggtcatactattgcgccgggctcaaaaaggtgaccgaagttcggggatacacaaaaggcggccctgggcatgaggagccggtgcccatgagtacttacggatggaatattgtcaagcttatgagcggtaaagatgtgttctatctgccacctgaaaagtgtgacaccttgctgtgcgatatcggcgagtcctctcccagccctacagtcgaagagtcccgtaccattagagtgctcaagatggttgagccatggttaaaaaacaatcagttctgtatcaaggtactgaacccctacatgcctactgtgattgaacaccttgagaggctgcaacgcaaacacgggggaatgctagtccggaatccactctcacgaaactctacgcatgaaatgtattggatcagtaatggcacaggtaacatagtggcatcggttaatatggtgagcagactgttgctgaacaggtttaccatgactcaccgccggcccaccattgagaaggacgtcgatctcggggccggaacaagacatgtgaacgctgaaccggagacgcctaatatggacgtaatcggcgagcgtatcaaaaggattaaggaagagcacaactccacctggcactacgacgatgaaaatccatataagacttgggcgtaccatggctcttatgaggtgaaagccacagggtcagcaagctccatgataaacggagttgtcaagcttctgaccaaaccctgggacgtggtgcctatggtcactcagatggctatgacagataccacaccattcggtcagcaacgggtttttaaggaaaaagtggacactcgcaccccccgaagtatgccgggcacgagaagggtaatggggatcaccgccgagtggttatggcggacactgggacgcaataagaagcctagattgtgcactagggaggaattcaccaaaaaggtgcgaacaaacgcagccatgggcgctgtctttactgaggaaaatcagtgggattctgccaaagcggcagtggaggacgaagatttctggaagctcgttgaccgggagcgtgagctgcacaaactaggtaagtgtgggagctgcgtgtacaacatgatgggaaaaagagaaaagaagcttggcgagtttggcaaagccaaggggtcacgcgctatttggtacatgtggctgggagccaggtatctcgaattcgaggcactgggttttttgaatgaggatcattggttctcccgggaaaacagttacagcggcgtcgagggggaaggactgcacaaactcggctatatccttagagacatttctaagatccccggtggggctatgtacgccgatgacaccgctggatgggacacgcgcataacagaggatgacctgcataatgaagagaaaatcacccagcagatggatccagagcacaggcaattagccaacgcaatttttaagctgacttatcagaataaggtggtaaaagttcagcgacctacacccaccggcactgtgatggacatcatttcccggaaggatcagagaggctcagggcaagtcggaacctacggtttgaacacattcacgaatatggaagcgcagctcatcaggcagatggagggcgaaggggtgctgagcaaagccgacctagagaacccacaccttcccgaaaagaaaataacccagtggctggagactaagggagtggagcgcctcaagcgtatggctatttcgggcgatgactgcgtcgttaaacctatcgatgaccggtttgccaacgcactgttggctttaaatgatatgggtaaggtgagaaaagacatcccacaatggcagccgtctaaggggtggcatgattggcagcaggtacccttctgtagtcaccatttccacgaactgattatgaaagacggaaggaagctcgtggtcccttgccgcccacaagacgagcttataggccgagcccggatctcccagggcgcagggtggagcctgagagaaacagcctgtctaggaaaggcgtatgctcagatgtggtcactgatgtactttcacaggcgcgatctcagattggcctccaacgcaatttgctctgccgtgcccgttcattgggtgcctaccagccggactacatggagtatccacgctcatcaccaatggatgaccacggaggacatgctgacagtctggaatagggtgtggattgaagataacccatggatggaggacaaaacccccgtaactacctgggagaatgttccttaccttggtaagcgtgaagatcagtggtgtggctccctgatcgggctcacaagccgagccacttgggcacagaacataccgaccgctatccagcaagtgcgctctttaattggaaatgaggaattcctggactatatgccatcaatgaaaagatttcggaaggaggaggaaagtgagggcgccatctggtga

SEQ ID NO: 15456 - RNA, 9873 nt, synthetic construct
  misc_feature 1..9873: note = derived and/or modified CDS sequence (opt3) from DENV-3__FJ547072__SS-prME
  source 1..9873: mol_type = other RNA
accagcctgtgcctcatgatgatccttcccgccgctctggcattccacttgacatccagagacggcgagcctaggatgattgtggggaagaacgaacggggacgctctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaaaagaagcgtagcccttgcaccccatgtgggcatgggtctggatacaaggacccaaacgtggatgtccgccgagggggcttggcggcaggtcgaaaaggtggagacttgggcattgcgccaccctggattcaccattctcgccctgtttctggctcattacatcggcacatctctcactcagaaagttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaagaataagcccacactagacattgagctccagaaaaccgaagcaactcaactggccacacttcggaagctgtgtatcgagggaaaaattaccaacatcacgaccgatagccgctgccctacacagggcgaagctgtcttgccagaggaacaggaccagaattatgtttgtaagcacacttacgtggatcgaggttgggggaacggatgcggcctcttcggcaaagggagtctggtaacctgcgccaagtttcaatgtttagagcccatagagggaaaggtggtccagtatgaaaatctgaaatacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaagaacaaagcgtggatggtgcataggcagtggtttttcgatctccccctgccttggacaagcggggccaccactgaaacaccaacgtggaatcggaaggagcttctggtaacctttaaaaacgcacacgctaagaaacaagaagttgtggtcttgggctcccaggagggagccatgcacactgctctcacaggcgccaccgaaattcagaattcagggggaacaagtatattcgcaggtcatctgaagtgtcgtttaaagatggacaaactggagctaaagggcatgagctacgccatgtgcactaacacctttgtgctcaaaaaggaggtctctgaaacgcagcacgggaccatcctgattaaagtggagtacaagggagaagatgttccctgtaagatccctttctccacagaggacggccaaggtaaagctcataacgggcgccttataactgcgaatccagtggtaaccaagaaagaggaacccgtcaacattgaggcagaaccgcctttcggcgagtcaaatatcgtgatcggaattggcgataacgccttgaagatcaattggtataaaaaggggagcagtattggaaagatgtttgaagctacagccagaggtgcaaggcggatggccatactgggcgacactgcttgggatttcgggtctgttggaggcgtgctcaactccctgggtaaaatggtccaccagatctttgggagcgcctacaccgcacttttctcgggcgtgtcttgggtaatgaagattggaatcggcgtgctgttgacgtggatcgggctcaattccaaaaacacatcaatgagttttagctgcattgttataggaatcattaccctgtatttaggcgcggtcgtgcaggctgacatgggttgtgtgatcaattggaaggggaaagagctgaagtgcggatccggcattttcgtcactaacgaggttcatacatggaccgaacagtacaagtttcaagccgattctcccaaacgactagcaactgccatcgctggtgcctgggagaatggcgtgtgtgggatacgcagcaccacaagaatggaaaacctcctgtggaagcagatcgcaaatgagcttaactatattttgtgggaaaataacatcaaactgacggtggtagtcggagacattatcggcgtgctcgagcaggggaagaggaccctgactccacagcctatggagttaaaatactcatggaagacatggggaaaagctaagatagttaccgccgaaacacaaaacagttccttcattatcgatggccccaatactccagagtgccccagcgcgtctcgggcctggaacgtgtgggaagtcgaggactatggttttggggtgttcaccacgaatatttggctgaagcttcgcgaagtttacacacagttgtgtgaccacagactcatgtcagctgcagtgaaagatgagagggccgtacacgctgacatgggatactggatcgagagtcagaagaacggcagctggaaactggaaaaggcctccctaatagaggtcaaaacctgcacttggcctaagtctcataccctgtggtcgaatggtgtgctcgaaagcgatatgatcattccaaagtccctggcaggcccgatctcacagcacaactatcgtcccgggtaccatacacaaactgcgggaccttggcaccttggcaaattggagctggactttaattattgcgaggggaccacagtggtcattacggaaaactgtggaacccggggcccaagtttacgaactacaaccgtttctggtaagctcatccacgagtggtgctgtagaagctgcactctgccccctcttaggtacatgggggaagatggatgttggtatggcatggagatacgcccaatttccgaaaaagaggagaatatggtgaagtcactggtaagcgccggttctggcaaagtggacaacttcacaatgggggtcttgtgcctcgctatcctgtttgaagaggtgatgcggggaaagttcggcaagaaacatatgatcgccggggttttctttaccttcgtgctactgctctccggacagattacgtggagagatatggcacacactctgatcatgattggcagtaatgctagcgacaggatgggtatgggggtcacctaccttgccttgatagcaacatttaagatccagcccttcctggccttaggatttttcctccgcaaactgacctctcgagaaaaccttctgctaggcgtgggcctcgctatggcgactacactgcaattgccggaggatattgaacagatggccaatgggatcgcactgggattaatggctctcaagctgattacccagtttgagacatatcagctttggactgccctgatctccttgacctgttcaaacacgatattcacactcaccgttgcctggcggactgctaccctgatcctagcaggtgtgagtctgcttcctgtctgccaaagctcgtccatgcgtaaaacagactggctcccaatgactgtagccgcgatgggcgtgccccctctgcccttgtttattttctctctgaaggataccttaaagagaaggagctggccactcaatgagggggttatggctgtgggactggtctcaatccttgccagttccctgttgcgcaacgacgtgcctatggcaggccccctcgtagccggtgggctgctaattgcttgttacgtgatcacgggaacatctgcagatctgaccgtcgaaaaagccgcggacgttacttgggaggaagaggctgaacagacaggcgtgagccataaccttatgataaccgtggacgatgacggcactatgcggattaaggatgacgagacagagaatatcctcaccgtcctgttgaaaacggccttactgatcgtgtccgggatttttccatactcaataccggcaactctcctggtttggcacacctggcagaagcagacacaaagaagcggagtactttgggatgtgcctagtcccccagaaacccagaaagccgagctggaagagggtgtctataggatcaagcagcagggcattttcgggaaaacacaagtgggagttggcgtgcagaaggagggtgtctttcatactatgtggcacgtgacccgaggggctgtattgacgtacaacggaaagcgcctagaacccaattgggcctctgtcaaaaaggacctgatctcctatggcggcgggtggcggctcagcgcacagtggcaaaaaggagaggaagtgcaggttattgctgtggagcctggtaagaacccaaaaaatttccagacaatgcccggcactttccagaccacaaccggggaaatcggagccatagcgctggattttaagcctggcacttcgggttcaccgatcattaacagagaggggaaggtcgtgggactttacggcaatggcgttgtgaccaaaaacgggggatatgtctctggtatcgcccaaacaaatgcagagccagacggccccacgcctgaattagaggaagagatgttcaagaaaaggaacctgactattatggatctccacccagggagtggaaagacccgtaaatacttgcccgctatcgtgcgcgaagccataaagcggagactgaggacactcattctggctcctacccgagtagtggcagccgagatggaggaagcccttaagggcctgccgatccggtatcagactacagctaccaaatccgagcatacgggtcgcgaaatcgttgacttgatgtgccacgcgacttttacaatgagactactgagccccgtcagggtgccaaattacaacctcattatcatggatgaggcacatttcaccgaccctgcctctatagctgcccgggggtacattagcacccgagtgggaatgggcgaagcagccgctatctttatgactgcgacacccccaggcaccgccgatgcattccctcagtccaatgctcccattcaggacgaggagagagacatcccagaacgctcatggaacagtgggaatgagtggataacagattttgccggaaagactgtctggttcgtaccgagcattaaagcaggtaacgacatcgccaactgtttaaggaagaatggcaaaaaggtgatccaactgtctcgtaagacgtttgataccgaatatcagaaaacaaagcttaacgactgggatttcgttgtgactaccgacatttccgagatgggggctaattttaaagccgatcgggtcatcgaccctagaaggtgcctgaagcccgtgattctcacagatggaccagagcgcgttatattggcgggccccatgcctgtgaccgcagcctcagctgcccagcgaagaggtcgggtcgggaggaacccacagaaagaaaatgaccaatacatcttcactggccagcccctgaacaatgatgaggaccacgctcattggacggaagcaaagatgctcctggacaacattaatacccctgagggaatcatcccggcccttttcgaaccagagcgcgagaagagtgctgccattgatggcgaatatcgtctaaaaggggagagcagaaagacatttgtggaactgatgcggaggggagacttgcccgtatggttagcacacaaagtggcgtccgagggtataaagtacactgatcgcaaatggtgcttcgacggccagcgaaacaatcagatcctggaagagaacatggatgttgagatttggaccaaggaaggggagaaaaagaagctcagacctcggtggctggacgccaggacatattctgatccccttgctctgaaagaatttaaggacttcgccgcaggacgcaaatcgatcgctctcgatttggtcaccgagattggcagagtgccaagccacctggcccataggactcggaatgcactagacaacctggtgatgctccacacatcagaacatggtgggaaggcctaccgtcacgctgtcgaggagcttcctgaaacgatggagaccctgttattgctgggcctcatgatcctgcttactggaggcgcgatgctgtttctcatatccgggaaaggaatcggtaagacaagtattggcttgatctgtgttattgcctctagcgggatgctgtggatggcagaaatccccttacaatggatagcttccgccattgtgctagagttctttatgatggtactgctcatcccagagcctgaaaagcagcgcaccccgcaggataatcaacttgcctatgtggtcattggaatcctgaccttggcagctataatcgccgcgaacgagatgggcctgctcgaaacaactaaacgagacctgggtatgtcaaaggagcccggggtggtttctccaacgagctaccttgatgtggacctccaccctgctagtgcctggaccctgtacgcagtcgccacaactgtaattacccccatgttgagacatacaatcgaaaattccaccgctaacgtgagcctggcagccattgcgaaccaggctgttgtgttaatgggcctagacaaaggatggccaatctctaagatggatctgggcgtccctctccttgccctggggtgctattcacaggtgaatcccttgactctgacggcagccgtcctcctgcttataacacactacgctattatcggaccgggcttacaggccaaagcaaccagggaggctcaaaagcggactgccgcgggtatcatgaagaacccaaccgtggacgggattatgacaatcgatctggaccctgttatatatgattccaaattcgagaagcagctcggacaggtgatgttgctggtactatgtgccgtgcagctgctccttatgcgcactagttgggcactgtgcgaagctttgaccctggccacaggccccattacgaccctctgggagggtagcccaggcaaattttggaatactacaatcgcagtctcgatggctaacattttcagagggtcttacctggccggagccggcttagcgttttccatcatgaagagcgttgggaccggaaaaaggggcactggttcacaaggggaaacacttggagagaagtggaagaaaaagctgaatcagctcagtcggaaagaattcgacctatataagaaatctggcataaccgaggtggatcgaacggaggctaaggaaggtctgaaaagaggcgagatcacccatcacgcagtctcccgcgggagcgccaagttgcagtggtttgtggaaaggaacatggtaattcccgagggacgggtgatcgacctgggctgtgggcgtggaggctggtcatactattgcgctggtctcaagaaagttacagaagtgagagggtacactaagggaggccctggccatgaggagccggtccccatgagtacctacgggtggaatattgtgaaacttatgagcggaaaggatgtcttctatctgccacctgaaaaatgtgacacattgctgtgcgatatcggtgagtcctctcccagccctactgtggaagagtccaggaccattcgcgttctcaagatggtagagccatggttaaagaacaatcagttctgtatcaaagtgctgaacccctacatgcctacagtcatagaacaccttgagcggctgcaacgaaagcacggcgggatgctagtgagaaatccactctcaaggaactctacccatgaaatgtattggattagtaatggaactggcaacatcgttgcctcggtgaatatggtcagccgcctgttgctgaaccggtttacgatgacacacagacgtcccaccatcgagaaagacgtggatctcggtgcagggactaggcatgtaaacgccgaaccggagacccctaatatggacgtgattggagagcggataaagcgcatcaaagaagagcacaactccacatggcactacgacgatgaaaatccatataagacgtgggcttaccatggctcttatgaggttaaggcgaccggctcagccagctccatgattaacggggtcgtgaaacttctgactaagccctgggacgtggtccctatggttacacagatggcaatgaccgatactacaccattcggacagcaacgagtgtttaaagaaaaggtagacaccagaacacccaggagtatgccgggtactcggcgcgtgatgggcatcaccgctgagtggttatggagaacgctggggaggaataaaaagcctcgattgtgcacccgggaggaattcacaaagaaagtccgtactaacgccgcaatgggagccgtgtttaccgaggaaaatcagtgggattctgctaaggccgcggttgaggacgaagatttctggattctcgtggacagagagcgcgagctgcacaaactaggcaagtgtggtagctgcgtctacaacatgatggggaaaagggaaaagaaacttggagagtttggcaaggcaaagggctcacgggccatctggtacatgtggctgggggctagatatctcgaattcgaggccctgggatttttgaatgaggatcattggttctcccgcgaaaacagttacagcggtgtggagggcgaagggctgcacaaactcggatatatacttagggacatctctaagattcccggcggtgcaatgtacgctgatgacacagccgggtgggacactcgaatcaccgaggatgacctgcataatgaagagaaaattacgcagcagatggatccagagcaccggcaattagctaacgccatctttaagctgacatatcagaataaagtagttaaggtgcagagacctacccccactggaacagtcatggacataatttccaggaaggatcagcgcggctcaggccaagtggggacctacggattgaacactttcaccaatatggaagcacagctcatccgtcagatggagggtgaaggcgtgctgagcaaagcggacctagagaacccacaccttcccgaaaagaaaatcacacagtggctggagacgaagggggtcgagcggctcaaaagaatggccatttcgggagatgactgcgttgtgaagcctatagatgacaggtttgctaacgccctgttggcattaaatgatatgggcaaggtacgcaaagacatcccacaatggcagccgtctaagggttggcatgattggcagcaggtgcccttctgtagtcaccatttccacgaactgattatgaaagacgggcgaaagctcgtcgtgccttgccggccacaagacgagcttatcggaagagctaggatttcccagggcgccggctggagcctgcgcgaaaccgcatgtctagggaaagcctatgcgcagatgtggtcactgatgtactttcacagacgggatctcaggttggcttccaacgccatctgctctgcagttcccgtgcattgggtccctactagccgtacaacctggagtatacacgcccatcaccaatggatgactacagaggacatgctgaccgtgtggaatcgagtatggatcgaagataacccatggatggaggacaagacgcccgttacaacctgggagaatgtgccttaccttggaaagcgcgaagatcagtggtgtggttccctgattggcctcactagcagagctacctgggcccagaacatcccgacagcaattcagcaagtccggtctttaatcgggaatgaggaattcctggactatatgccatcaatgaaaaggtttcgcaaggaggaggaaagtgagggagctatttggtga

SEQ ID NO: 15457 - RNA, 9873 nt, synthetic construct
  misc_feature 1..9873: note = derived and/or modified CDS sequence (opt3) from DENV-3__FJ547073__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttacgtgatcacgggaacatctgcagatctgaccgtcgaaaaggccgcggacgttacttgggaggaagaggctgaacagacaggcgtgagccataaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcacacctggcagaaacagacacaacggagcggagtactttgggatgtgcctagtcccccagaaacccagaaggccgagctggaagagggtgtctatagaatcaaacagcagggcattttcgggaagacacaagtgggagttggcgtgcagaaggagggtgtctttcatactatgtggcacgtgaccaggggggctgtattgacgtacaacggaaaacgactagaacccaattgggcctctgtcaagaaagacctgatctcctatggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttacggcaatggcgttgtgaccaagaacgggggatatgtctctggtatcgcccaaacaaatgcagagccagacggccccacgcctgaattagaggaagagatgttcaaaaagagaaacctgactattatggatctccacccagggagtggaaaaaccaggaagtacttgcccgctatcgtgcgtgaagccataaagcgccggctgagaacactcattctggctcctaccagggtagtggcagccgagatggaggaagcccttaaaggcctgccgatccgatatcagactacagctaccaagtccgagcatacgggtcgggaaatcgttgacttgatgtgccacgcgacttttacaatgcgcctactgagccccgtcagagtgccaaattacaacctcattatcatggatgaggcacatttcaccgaccctgcctctatagctgccagggggtacattagcacccgggtgggaatgggcgaagcagccgctatctttatgactgcgacacccccaggcaccgccgatgcattccctcagtccaatgctcccattcaggacgaggagcgagacatcccagaaagatcatggaacagtgggaatgagtggataacagattttgccggaaaaactgtctggttcgtaccgagcattaaggcaggtaacgacatcgccaactgtttacgcaaaaatggcaagaaggtgatccaactgtctaggaaaacgtttgataccgaatatcagaagacaaaacttaacgactgggatttcgttgtgactaccgacatttccgagatgggggctaattttaaggccgatcgtgtcatcgaccctcggagatgcctgaaacccgtgattctcacagatggaccagagagggttatattggcgggccccatgcctgtgaccgcagcctcagctgcccagcgccgaggtagagtcgggcggaacccacagaaggaaaatgaccaatacatcttcactggccagcccctgaacaatgatgaggaccacgctcattggacggaagcaaagatgctcctggacaacattaatacccctgagggaatcatcccggcccttttcgaaccagagagggagaaaagtgctgccattgatggcgaatatcgcctaaagggggagagccgtaaaacatttgtggaactgatgagacggggagacttgcccgtatggttagcacacaaggtggcgtccgagggtataaaatacactgataggaagtggtgcttcgacggccagcgcaacaatcagatcctggaagagaacatggatgttgagatttggaccaaagaaggggagaagaagaaactccgacctagatggctggacgcccggacatattctgatccccttgctctgaaggaatttaaagacttcgccgcaggaaggaagtcgatcgctctcgatttggtcaccgagattggccgcgtgccaagccacctggcccatagaactaggaatgcactagacaacctggtgatgctccacacatcagaacatggtgggaaagcctaccggtatgctgtcgaggagcttcctgaaacgatggagaccctgttattgctgggcctcatgatcctgcttactggaggcgcgatgctgtttctcatatccgggaagggaatcggtaagacaagtattggcttgatctgtgttattgcctctagcgggatgctgtggatggcagaaatccccttacaatggatagcttccgccattgtgctagagttctttatgatggtactgctcatcccagagcctgaaaaacagcgtaccccgcaggataatcaacttgcctacgtggtcattggaatcctgaccttggcagctataatcgccgcgaacgagatgggcctgctcgaaacaactaagcgcgacctgggtatgtcaaaagagcccggggtggtttctccaacgagctaccttgatgtggacctccaccctgctagtgcctggaccctgtatgcagtcgccacaactgtaattacccccatgttgcgacacacaatcgaaaattccaccgctaacgtgagcctggcagccattgcgaaccaggctgttgtgttaatgggcctagacaagggatggccaatctctaaaatggatctgggcgtccctctccttgccctggggtgctactcacaggtgaatcccttgactctgacggcagccgtcctcctgcttataacacattatgctattatcggaccgggcttacaggccaaggcaaccagagaggctcaaaagaggactgccgcgggtatcatgaaaaacccaaccgtggacgggattatgacaatcgatctggaccctgttatatacgattccaagttcgagaaacagctcggacaggtgatgttgctggtactatgtgccgtgcagctgctccttatgcggactagttgggcactgtgcgaagctttgaccctggccacaggccccattacgaccctctgggagggtagcccaggcaagttttggaatactacaatcgcagtctcgatggctaacattttccgcgggtcttatctggccggagccggcttagcgttttccatcatgaaaagcgttgggaccggaaagagaggcactggttcacaaggggaaacacttggagagaagtggaaaaagaaactgaatcagctcagtaggaaggaattcgacctatacaaaaagtctggcataaccgaggtggatcggacggaggctaaagaaggtctgaagcgaggcgagatcacccaccatgcagtctccagagggagcgccaagttgcagtggtttgtggaacgcaacatggtaattcccgagggaagggtgatcgacctgggctgtgggcggggaggctggtcatattactgcgctggtctcaaaaaggttacagaagtgcgtgggtacactaaaggaggccctggccacgaggagccggtccccatgagtacctatgggtggaatattgtgaagcttatgagcggaaaagatgtcttctacctgccacctgaaaagtgtgacacattgctgtgcgatatcggtgagtcctctcccagccctactgtggaagagtccagaaccattagggttctcaagatggtagagccatggttaaaaaacaatcagttctgtatcaaggtgctgaacccctatatgcctacagtcatagaacatcttgagcgcctgcaacggaaacacggcgggatgctagtgcgaaatccactctcaagaaactctacccacgaaatgtactggattagtaatggaactggcaacatcgttgcctcggtgaatatggtcagcaggctgttgctgaaccgctttacgatgacacatcggagacccaccatcgagaaggacgtggatctcggtgcagggactcgtcacgtaaacgccgaaccggagacccctaatatggacgtgattggagagaggataaaacggatcaaggaagagcataactccacatggcactatgacgatgaaaatccatacaagacgtgggcttatcacggctcttacgaggttaaagcgaccggctcagccagctccatgattaacggggtcgtgaagcttctgactaaaccctgggacgtggtccctatggttacacagatggcaatgaccgatactacaccattcggacagcaacgcgtgtttaaggaaaaagtagacacccgaacacccagaagtatgccgggtactaggcgggtgatgggcatcaccgctgagtggttatggcgcacgctggggagaaataagaagcctaggttgtgcacccgagaggaattcacaaaaaaggtccggactaacgccgcaatgggagccgtgtttaccgaggaaaatcagtgggattctgctaaagccgcggttgaggacgaagatttctggattctcgtggaccgtgagagagagctgcataagctaggcaaatgtggtagctgcgtctacaacatgatggggaagcgcgaaaaaaagcttggagagtttggcaaggcaaaaggctcaagggccatctggtatatgtggctgggggctcggtacctcgaattcgaggccctgggatttttgaatgaggatcactggttctccagagaaaacagttatagcggtgtggagggcgaagggctgcataagctcggatacatacttcgcgacatctctaaaattcccggcggtgcaatgtatgctgatgacacagccgggtgggacactaggatcaccgaggatgacctgcacaatgaagagaagattacgcagcagatggatccagagcatcgacaattagctaacgccatctttaaactgacataccagaataaggtagttaaggtgcagcggcctacccccactggaacagtcatggacataatttccagaaaagatcagaggggctcaggccaagtggggacctatggattgaacactttcaccaatatggaagcacagctcatccgccagatggagggtgaaggcgtgctgagcaaggcggacctagagaacccacaccttcccgaaaaaaagatcacacagtggctggagacgaaaggggtcgagcgtctcaagcggatggccatttcgggagatgactgcgttgtgaagcctatagatgacagatttgctaacgccctgttggcattaaatgatatgggcaaagtaaggaaggacatcccacaatggcagccgtctaaaggttggcacgattggcagcaggtgcccttctgtagtcatcacttccatgaactgattatgaaggacgggcgcaaactcgtcgtgccttgccgaccacaagacgagcttatcggacgggctagaatttcccagggcgccggctggagcctgagggaaaccgcatgtctagggaaggcctacgcgcagatgtggtcactgatgtactttcaccgcagagatctccggttggcttccaacgccatctgctctgcagttcccgtgcactgggtccctactagcaggacaacctggagtatacatgcccaccatcaatggatgactacagaggacatgctgaccgtgtggaatcgtgtatggatcgaagataacccatggatggaggacaagacgcccgttacaacctgggagaatgtgccttatcttggaaaacgagaagatcagtggtgtggttccctgattggcctcactagccgcgctacctgggcccagaacatcccgacagcaattcagcaagtcagatctttaatcgggaatgaggaattcctggactacatgccatcaatgaagcggtttaggaaagaggaggaaagtgagggagctatttggtga

SEQ ID NO: 15458 - RNA, 9873 nt, synthetic construct
  misc_feature 1..9873: note = derived and/or modified CDS sequence (opt3) from DENV-3__FJ547074__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttacgtgatcacgggaacatctgcagatctgaccgtcgaaaaggccgcggacgttacttgggaggaagaggctgaacagacaggcgtgagccataaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcacacctggcagaaacagacacaacggagcggagtactttgggatgtgcctagtcccccagaaacccagaaggccgagctggaagagggtgtctatagaatcaaacagcagggcattttcgggaagacacaagtgggagttggcgtgcagaaggagggtgtctttcatactatgtggcacgtgaccaggggggctgtattgacgtacaacggaaaacgactagaacccaattgggcctctgtcaagaaagacctgatctcctatggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttacggcaatggcgttgtgaccaagaacgggggatatgtctctggtatcgcccaaacaaatgcagagccagacggccccacgcctgaattagaggaagagatgttcaaaaagagaaacctgactattatggatctccacccagggagtggaaaaaccaggaagtacttgcccgctatcgtgcgtgaagccataaagcgccggctgagaacactcattctggctcctaccagggtagtggcagccgagatggaggaagcccttaaaggcctgccgatccgatatcagactacagctaccaagtccgagcatacgggtcgggaaatcgttgacttgatgtgccacgcgacttttacaatgcgcctactgagccccgtcagagtgccaaattacaacctcattatcatggatgaggcacatttcaccgaccctgcctctatagctgccagggggtacattagcacccgggtgggaatgggcgaagcagccgctatctttatgactgcgacacccccaggcaccgccgatgcattccctcagtccaatgctcccattcaggacgaggagcgagacatcccagaaagatcatggaacagtgggaatgagtggataacagattttgccggaaaaactgtctggttcgtaccgagcattaaggcaggtaacgacatcgccaactgtttacgcaaaaatggcaagaaggtgatccaactgtctaggaaaacgtttgataccgaatatcagaagacaaaacttaacgactgggatttcgttgtgactaccgacatttccgagatgggggctaattttaaggccgatcgtgtcatcgaccctcggagatgcctgaaacccgtgattctcacagatggaccagagagggttatattggcgggccccatgcctgtgaccgcagcctcagctgcccagcgccgaggtagagtcgggcggaacccacagaaggaaaatgaccaatacatcttcactggccagcccctgaacaatgatgaggaccacgctcattggacggaagcaaagatgctcctggacaacattaatacccctgagggaatcatcccggcccttttcgaaccagagagggagaaaagtgctgccattgatggcgaatatcgcctaaagggggagagccgtaaaacatttgtggaactgatgagacggggagacttgcccgtatggttagcacacaaggtggcgtccgagggtataaaatacactgataggaagtggtgcttcgacggccagcgcaacaatcagatcctggaagagaacatggatgttgagatttggaccaaagaaggggagaagaagaaactccgacctagatggctggacgcccggacatattctgatccccttgctctgaaggaatttaaagacttcgccgcaggaaggaagtcgatcgctctcgatttggtcaccgagattggccgcgtgccaagccacctggcccatagaactaggaatgcactagacaacctggtgatgctccacacatcagaacatggtgggaaagcctaccggcacgctgtcgaggagcttcctgaaacgatggagaccctgttattgctgggcctcatgatcctgcttactggaggcgcgatgctgtttctcatatccgggaagggaatcggtaagacaagtattggcttgatctgtgttattgcctctagcgggatgctgtggatggcagaaatccccttacaatggatagcttccgccattgtgctagagttctttatgatggtactgctcatcccagagcctgaaaaacagcgtaccccgcaggataatcaacttgcctatgtggtcattggaatcctgaccttggcagctataatcgccgcgaacgagatgggcctgctcgaaacaactaagcgcgacctgggtatgtcaaaagagcccggggtggtttctccaacgagctaccttgatgtggacctccaccctgctagtgcctggaccctgtacgcagtcgccacaactgtaattacccccatgttgcgacatacaatcgaaaattccaccgctaacgtgagcctggcagccattgcgaaccaggctgttgtgttaatgggcctagacaagggatggccaatctctaaaatggatctgggcgtccctctccttgccctggggtgctattcacaggtgaatcccttgactctgacggcagccgtcctcctgcttataacacactacgctattatcggaccgggcttacaggccaaggcaaccagagaggctcaaaagaggactgccgcgggtatcatgaaaaacccaaccgtggacgggattatgacaatcgatctggaccctgttatatatgattccaagttcgagaaacagctcggacaggtgatgttgctggtactatgtgccgtgcagctgctccttatgcggactagttgggcactgtgcgaagctttgaccctggccacaggccccattacgaccctctgggagggtagcccaggcaagttttggaatactacaatcgcagtctcgatggctaacattttccgcgggtcttacctggccggagccggcttagcgttttccatcatgaaaagcgttgggaccggaaagagaggcactggttcacaaggggaaacacttggagagaagtggaaaaagaaactgaatcagctcagtaggaaggaattcgacctatataaaaagtctggcataaccgaggtggatcggacggaggctaaagaaggtctgaagcgaggcgagatcacccatcacgcagtctccagagggagcgccaagttgcagtggtttgtggaacgcaacatggtaattcccgagggaagggtgatcgacctgggctgtgggcggggaggctggtcatactattgcgctggtctcaaaaaggttacagaagtgcgtgggtacactaaaggaggccctggccatgaggagccggtccccatgagtacctacgggtggaatattgtgaagcttatgagcggaaaagatgtcttctatctgccacctgaaaagtgtgacacattgctgtgcgatatcggtgagtcctctcccagccctactgtggaagagtccagaaccattagggttctcaagatggtagagccatggttaaaaaacaatcagttctgtatcaaggtgctgaacccctacatgcctacagtcatagaacaccttgagcgcctgcaacggaaacacggcgggatgctagtgcgaaatccactctcaagaaactctacccatgaaatgtattggattagtaatggaactggcaacatcgttgcctcggtgaatatggtcagcaggctgttgctgaaccgctttacgatgacataccggagacccaccatcgagaaggacgtggtactcggtgcagggactcgtcacgtgaacgccgaaccggagacccctaatatggatgttattggagagaggataaaacggatcaaggaagagcataactccacatggcactatgacgacgaaaatccatacaagacgtgggcttatcacggctcttacgaggtcaaagcgaccggctcagccagctccatgattaacggggtggtgaagcttctgactaaaccctgggatgtcgttcctatggtgacacagatggcaatgaccgacactacaccattcggacagcaacgcgtatttaaggaaaaagtggatacccgaacacccagaagtatgccgggtactaggcgggtcatgggcatcaccgctgagtggttatggcgcacgctggggagaaataagaagcctaggttgtgcacccgagaggaattcacaaaaaaggtgcggactaacgccgcaatgggagccgtttttaccgaggaaaatcagtgggactctgctaaagccgcggtggaggatgaagacttctggattctcgtcgatcgtgagagagagctgcataagctaggcaaatgtggtagctgcgtgtacaacatgatggggaagcgcgaaaaaaagcttggagagtttggcaaggcaaaaggctcaagggccatctggtatatgtggctgggggctcggtacctcgaattcgaggccctgggatttttgaatgaggaccactggttctccagagaaaacagttatagcggtgtagagggcgaagggctgcataagctcggatacatacttcgcgatatctctaaaattcccggcggtgcaatgtatgctgacgatacagccgggtgggacactaggatcaccgaggacgatctgcacaatgaagagaagattacgcagcagatggacccagagcatcgacaattagctaacgccatctttaaactgacataccagaataaggttgtgaaggtccagcggcctacccccactggaacagtgatggatataatttccagaaaagaccagaggggctcaggccaagtggggacctatggattgaacactttcaccaatatggaagcacagctcatccgccagatggagggtgaaggcgtcctgagcaaggcggatctagagaacccacaccttcccgaaaaaaagatcacacagtggctggagacgaaaggggttgagcgtctcaagcggatggccatttcgggagacgattgcgtggtaaagcctatagacgatagatttgctaacgccctgttggcattaaatgacatgggcaaagtgaggaaggatatcccacaatggcagccgtctaaaggttggcacgactggcagcaggtccccttctgtagtcatcacttccatgaactgattatgaaggatgggcgcaaactcgtggttccttgccgaccacaagacgagcttatcggacgggctagaatttcccagggcgccggctggagcctgagggaaaccgcatgtctagggaaggcctacgcgcagatgtggtcactgatgtactttcaccgcagagacctccggttggcttccaacgccatctgctctgcagtgcccgtccactgggtgcctactagcaggacaacctggagtatacatgcccaccatcaatggatgactacagaggatatgctgaccgtatggaatcgtgtttggatcgaagacaacccatggatggaggataagacgcccgtgacaacctgggagaatgtcccttatcttggaaaacgagaagaccagtggtgtggttccctgattggcctcactagccgcgctacctgggcccagaacatcccgacagcaattcagcaagtgagatctttaatcgggaatgaggaattcctggattacatgccatcaatgaagcggtttaggaaagaggaggaaagtgagggagctatttggtga

SEQ ID NO: 15459 - RNA, 9873 nt, synthetic construct
  misc_feature 1..9873: note = derived and/or modified CDS sequence (opt3) from DENV-3__FJ547075__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgttataggaatcattaccctgtatttaggcgcggtcgtgcaggctgacatgggttgtgtgatcaattggaaagggaaggagctgaagtgcggatccggcattttcgtcactaacgaggttcatacatggaccgaacagtacaaatttcaagccgattctcccaagcggctagcaactgccatcgctggtgcctgggagaatggcgtgtgtgggatacgaagcaccacacgcatggaaaacctcctgtggaaacagatcgcaaatgagcttaactatattttgtgggaaaataacatcaagctgacggtggtagtcggagacattatcggcgtgctcgagcaggggaaaagaaccctgactccacagcctatggagttaaagtactcatggaaaacatggggaaaggctaagatagttaccgccgaaacacaaaacagttccttcattatcgatggccccaatactccagagtgccccagcgcgtctagggcctggaacgtgtgggaagtcgaggactatggttttggggtgttcaccacgaatatttggctgaaacttcgggaagtttacacacagttgtgtgaccaccgcctcatgtcagctgcagtgaaggatgagagagccgtacacgctgacatgggatactggatcgagagtcagaaaaacggcagctggaagctggaaaaagcctccctaatagaggtcaagacctgcacttggcctaagtctcataccctgtggtcgaatggtgtgctcgaaagcgatatgatcattccaaaatccctggcaggcccgatctcacagcacaactataggcccgggtaccatacacaaactgcgggaccttggcaccttggcaagttggagctggactttaattattgcgaggggaccacagtggtcattacggaaaactgtggaacccgtggcccaagtttacggactacaaccgtttctggtaaactcatccacgagtggtgctgtcgaagctgcactctgccccctcttagatacatgggggaagatggatgttggtatggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcatatgatcgccggggttttctttaccttcgtgctactgctctccggacagattacgtggcgggatatggcacacactctgatcatgattggcagtaatgctagcgacagaatgggtatgggggtcacctaccttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacatatcagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttacgtgatcacgggaacatctgcagatctgaccgtcgaaaaggccgcggacgttacttgggaggaagaggctgaacagacaggcgtgagccataaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcacacctggcagaaacagacacaacggagcggagtactttgggatgtgcctagtcccccagaaacccagaaggccgagctggaagagggtgtctatagaatcaaacagcagggcattttcgggaagacacaagtgggagttggcgtgcagaaggagggtgtctttcatactatgtggcacgtgaccaggggggctgtattgacgtacaacggaaaacgactagaacccaattgggcctctgtcaagaaagacctgatctcctatggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttacggcaatggcgttgtgaccaagaacgggggatatgtctctggtatcgcccaaacaaatgcagagagtgacggcccaacgcccgaattagaggaagagatgttcaaaaagagaaacctgactattatggatctccaccctgggtccggaaaaaccaggaagtacttgccagctatcgtgcgtgaagccataaagcgccggctgagaacactcattctggctcccaccagggtagtggcagccgagatggaggaagcccttaaaggcctgcctatccgatatcagactacagctaccaagagcgagcatacgggtcgggaaatcgttgacttgatgtgccacgcgacttttacaatgcgcctactgtctccggtcagagtgcccaattacaacctcattatcatggatgaggcacatttcaccgacccagccagcatagctgccagggggtacatttccacccgggtgggaatgggcgaagcagccgctatctttatgactgcgacacctcccggcaccgccgatgcattcccacagtcaaatgctcctattcaggacgaggagcgagacatccccgaaagaagttggaacagcgggaatgagtggataacagattttgccggaaaaactgtctggttcgtaccatctattaaggcaggtaacgacatcgccaactgtttacgcaaaaatggcaagaaggtgatccaactgtccaggaaaacgtttgataccgaatatcagaagacaaaacttaacgactgggatttcgttgtgactaccgacatttcagagatgggggctaattttaaggccgatcgtgtcatcgacccgcggagatgcctgaaacctgtgattctcacagatggacccgagagggttatattggcgggcccaatgcccgtgaccgcagccagtgctgcccagcgccgaggtagagtcgggcggaaccctcagaaggaaaatgaccaatacatcttcactggccagccactgaacaatgatgaggaccacgctcattggacggaagcaaagatgctcctggacaacattaatacccccgagggaatcatccctgcccttttcgaaccggagagggagaaaagcgctgccattgatggcgaatatcgcctaaagggggagtcccgtaaaacatttgtggaactgatgagacggggagacttgccagtatggttagcacacaaggtggcgtctgagggtataaaatacactgataggaagtggtgcttcgacggccagcgcaacaatcagatcctggaagagaacatggatgttgagatttggaccaaagaaggggagaagaagaaactccgacccagatggctggacgcccggacatattcggatcctcttgctctgaaggaatttaaagacttcgccgcaggaaggaagagcatcgctctcgatttggtcaccgagattggccgcgtgccctcacacctggcccatagaactaggaatgcactagacaacctggtgatgctccacacatccgaacatggtgggaaagcctaccggcacgctgtcgaggagcttccagaaacgatggagaccctgttattgctgggcctcatgatcctgcttactggaggcgcgatgctgtttctcataagtgggaagggaatcggtaagacatctattggcttgatctgtgttattgccagctccgggatgctgtggatggcagaaatccctttacaatggatagcttcagccattgtgctagagttctttatgatggtactgctcatccccgagccagaaaaacagcgtacccctcaggataatcaacttgcctatgtggtcattggaatcctgaccttggcagctataatcgccgcgaacgagatgggcctgctcgaaacaactaagcgcgacctgggtatgtctaaagagccgggggtggttagccccacgagttaccttgatgtggacctccacccagcttccgcctggaccctgtacgcagtcgccacaactgtaattacccctatgttgcgacatacaatcgaaaatagcaccgctaacgtgtctctggcagccattgcgaaccaggctgttgtgttaatgggcctagacaagggatggcccatctcaaaaatggatctgggcgtcccactccttgccctggggtgctattcccaggtgaatcctttgactctgacggcagccgtcctcctgcttataacacactacgctattatcggacccggcttacaggccaaggcaaccagagaggctcaaaagaggactgccgcgggtatcatgaaaaacccgaccgtggacgggattatgacaatcgatctggacccagttatatatgatagtaagttcgagaaacagctcggacaggtgatgttgctggtactatgtgccgtgcagctgctccttatgcggactagctgggcactgtgcgaagctttgaccctggccacaggccctattacgaccctctgggagggttcgcccggcaagttttggaatactacaatcgcagtctctatggctaacattttccgcgggtcctacctggccggagccggcttagcgtttagcatcatgaaatcagttgggaccggaaagagaggcactggtagtcaaggggaaacacttggagagaagtggaaaaagaaactgaatcagctctctaggaaggaattcgacctatataaaaagtccggcataaccgaggtggatcggacggaggctaaagaaggtctgaagcgaggcgagatcacccatcacgcagtcagcagagggtcagccaagttgcagtggtttgtggaacgcaacatggtaattccagagggaagggtgatcgacctgggctgtgggcggggaggctggagttactattgcgctggtctcaaaaaggttacagaagtgcgtgggtacactaaaggaggccccggccatgaggagcctgtcccgatgagcacctacgggtggaatattgtgaagcttatgtccggaaaagatgtcttctatctgcccccagaaaagtgtgacacattgctgtgcgatatcggtgagtctagcccttcccccactgtggaagagtcaagaaccattagggttctcaagatggtagagccttggttaaaaaacaatcagttctgtatcaaggtgctgaacccatacatgcccacagtcatagaacaccttgagcgcctgcaacggaaacacggcgggatgctagtgcgaaatcctctctctagaaacagtacccatgaaatgtattggatttcgaatggaactggcaacatcgttgccagcgtgaatatggtctccaggctgttgctgaaccgctttacgatgacacaccggagaccaaccatcgagaaggacgtggatctcggtgcagggactcgtcatgtaaacgccgaacccgagaccccgaatatggacgtgattggagagaggataaaacggatcaaggaagagcacaactctacatggcactacgacgatgaaaatccttataagacgtgggcttaccatggctcatatgaggttaaagcgaccggcagcgcctccagtatgattaacggggtcgtgaagcttctgactaaaccatgggacgtggtccccatggttacacagatggcaatgaccgatactacacctttcggacagcaacgcgtgtttaaggaaaaagtagacacccgaacaccaagatctatgcccggtactaggcgggtgatgggcatcaccgctgagtggttatggcgcacgctggggagaaataagaagccgaggttgtgcacccgagaggaattcacaaaaaaggtccggactaacgccgcaatgggagccgtgtttaccgaggaaaatcagtgggatagcgctaaagccgcggttgaggacgaagatttctggattctcgtggaccgtgagagagagctgcacaagctaggcaaatgtggttcatgcgtctacaacatgatggggaagcgcgaaaaaaagcttggagagtttggcaaggcaaaaggctccagggccatctggtacatgtggctgggggctcggtatctcgaattcgaggccctgggatttttgaatgaggatcattggttcagtagagaaaacagctactctggtgtggagggcgaagggctgcacaagctcggatatatacttcgcgacatctccaaaattcctggcggtgcaatgtacgctgatgacacagccgggtgggacactaggatcaccgaggatgacctgcataatgaagagaagattacgcagcagatggatcccgagcaccgacaattagctaacgccatctttaaactgacatatcagaataaggtagttaaggtgcagcggccaacccctactggaacagtcatggacataatttcaagaaaagatcagaggggcagcggccaagtggggacctacggattgaacactttcaccaatatggaagcacagctcatccgccagatggagggtgaaggcgtgctgtcgaaggcggacctagagaacccccaccttccagaaaaaaagatcacacagtggctggagacgaaaggggtcgagcgtctcaagcggatggccatttctggagatgactgcgttgtgaagcccatagatgacagatttgctaacgccctgttggcattaaatgatatgggcaaagtaaggaaggacatccctcaatggcagccaagtaaaggttggcatgattggcagcaggtgccgttctgttcccaccatttccacgaactgattatgaaggacgggcgcaaactcgtcgtgccctgccgacctcaagacgagcttatcggacgggctagaattagccagggcgccggctggtcactgagggaaaccgcatgtctagggaaggcctatgcgcagatgtggtccctgatgtactttcaccgcagagatctccggttggcttctaacgccatctgcagcgcagttccagtgcattgggtccccactagtaggacaacctggtccatacacgcccatcaccaatggatgactacagaggacatgctgaccgtgtggaatcgtgtatggatcgaagataacccttggatggaggacaagacgccagttacaacctgggagaatgtgccctaccttggaaaacgagaagatcagtggtgtggtagcctgattggcctcacttctcgcgctacctgggcccagaacatccctacagcaattcagcaagtcagatcattaatcgggaatgaggaattcctggactatatgccgagtatgaagcggtttaggaaagaggaggaatccgagggagctatttggtga

SEQ ID NO: 15460 - RNA, 9873 nt, synthetic construct
  misc_feature 1..9873: note = derived and/or modified CDS sequence (opt3) from DENV-3__FJ547076__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccagtttccgaaaaggaggagaatatggtgaaatcactggtaagcgctggttctggcaaggtggacaacttcacaatgggggtcttgtgcctcgccattctgtttgaagaggtgatgcgcggaaagttcggcaaaaagcatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaaaatacagcccttcctggctttaggatttttcctcaggaagctgacctctcgcgaaaaccttctgctaggcgtgggcctcgcgatggccactacactgcaattgccggaggatatcgaacagatggcaaatgggattgctctgggattaatggccctcaaactgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaagacagactggctcccaatgactgtagcggctatgggcgtgccccctctgcccttgtttatcttctctctgaaggataccttaaaacgtagaagctggccactcaatgagggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgaaaaggcggctgacgttacttgggaggaagaggccgaacagacaggcgtgagccataaccttatgatcaccgtggacgatgacggcactatgcgcataaaagatgacgagacagagaatattctcaccgtcctgttgaagacggcattactgatcgtgtccgggatctttccatactcaattccggccactctcctggtttggcacacctggcagaaacagacacaacggagcggagtactttgggatgtgcctagtcccccagaaacccagaaggctgagctggaagagggtgtctatagaataaaacagcagggcatcttcgggaagacacaagtgggagttggcgtgcagaaggagggtgtctttcatactatgtggcacgtgaccaggggggccgtattgacgtacaacggaaaacgactagaacccaattgggcatctgtcaagaaagacctgatttcctatggcggcgggtggcgcctcagcgctcagtggcaaaagggagaggaagtgcaggttatcgccgtggagcctggtaaaaacccaaagaatttccagacaatgcccggcactttccagaccacaaccggggaaattggagcgatcgccctggattttaagcctggcacttcgggttcaccgataatcaaccgggaggggaaagtcgtgggactttacggcaatggcgttgtgaccaagaacgggggatatgtctctggtattgcacaaacaaatgctgagccagacggccccacgcctgaattagaggaagagatgttcaaaaagagaaacctgactatcatggatctccacccagggagtggaaaaaccaggaagtacttgcccgccattgtgcgtgaagctatcaagcgccggctgagaacactcatactggcacctaccagggtagtggccgccgagatggaggaagctcttaaaggcctgccgattcgatatcagactacagcgaccaagtccgagcatacgggtcgggaaatcgttgacttgatgtgccacgcaacttttacaatgcgcctactgagccccgtcagagtgccaaattacaacctcatcattatggatgaggcccatttcaccgaccctgcttctatcgccgcaagggggtacataagcacccgggtgggaatgggcgaagccgctgcgatttttatgactgccacacccccaggcaccgcagatgctttccctcagtccaatgcccccatccaggacgaggagcgagacattccagaaagatcatggaacagtgggaatgagtggatcacagattttgcaggaaaaactgtctggttcgtaccgagcataaaggccggtaacgacattgctaactgtttacgcaaaaatggcaagaaggtgatccaactgtctaggaaaacgtttgataccgaatatcagaagacaaaacttaacgactgggatttcgttgtgactaccgacatctccgagatgggggccaattttaaggcggatcgtgtcattgaccctcggagatgcctgaaacccgtgatcctcacagatggaccagagagggttattttggcaggccccatgcctgtgaccgccgcttcagccgctcagcgccgaggtagagtcgggcggaacccacagaaggaaaatgaccaatacatattcactggccagcccctgaacaatgatgaggaccacgcacattggacggaagccaagatgctcctggacaacatcaatacccctgagggaattatcccggctcttttcgaaccagagagggagaaaagtgccgcaatcgatggcgaatatcgcctaaagggggagagccgtaaaacatttgtggaactgatgagacggggagacttgcccgtatggttagcgcacaaggtggcctccgagggtattaaatacactgataggaagtggtgcttcgacggccagcgcaacaatcagatactggaagagaacatggatgttgagatctggaccaaagaaggggagaagaagaaactccgacctagatggctggacgctcggacatattctgatccccttgccctgaaggaatttaaagacttcgcagctggaaggaagtcgattgccctcgatttggtcaccgagatcggccgcgtgccaagccacctggcacatagaactaggaatgccctagacaacctggtgatgctccacacatcagaacatggtgggaaagcttaccggcacgcggtcgaggagcttcctgaaacgatggagaccctgttattgctgggcctcatgattctgcttactggaggcgccatgctgtttctcatctccgggaagggaataggtaagacaagtatcggcttgatttgtgttatcgcatctagcgggatgctgtggatggctgaaattcccttacaatggatcgcctccgccatagtgctagagttctttatgatggtactgctcattccagagcctgaaaaacagcgtaccccgcaggataatcaacttgcatatgtggtcatcggaattctgaccttggctgccatcatagcggctaacgagatgggcctgctcgaaacaactaagcgcgacctgggtatgtcaaaagagcccggggtggtttctccaacgagctaccttgatgtggacctccaccctgccagtgcatggaccctgtacgccgtcgctacaactgtaatcacccccatgttgcgacatacaattgaaaattccaccgcaaacgtgagcctggccgcgatcgctaaccaggccgttgtgttaatgggcctagacaagggatggccaatttctaaaatggatctgggcgtccctctccttgcactggggtgctattcacaggtgaatcccttgactctgacggccgctgtcctcctgcttatcacacactacgccataattggaccgggcttacaggcaaaggctaccagagaggcccaaaagaggactgcggccggtatcatgaaaaacccaaccgtggacgggatcatgacaattgatctggaccctgttatctatgattccaagttcgagaaacagctcggacaggtgatgttgctggtactatgtgcagtgcagctgctccttatgcggactagttgggctctgtgcgaagccttgaccctggcaacaggccccataacgaccctctgggagggtagcccaggcaagttttggaatactacaattgctgtctcgatggccaacatcttccgcgggtcttacctggccggagcgggcttagctttttccattatgaaaagcgttgggaccggaaagagaggcactggttcacaaggggaaacacttggagagaagtggaaaaagaaactgaatcagctcagtaggaaggaattcgacctatataaaaagtctggcatcaccgaggtggatcggacggaggcaaaagaaggtctgaagcgaggcgagataacccatcacgccgtctccagagggagcgctaagttgcagtggtttgtggaacgcaacatggtaatccccgagggaagggtgattgacctgggctgtgggcggggaggctggtcatactattgcgccggtctcaaaaaggttacagaagtgcgtgggtacactaaaggaggccctggccatgaggagccggtccccatgagtacctacgggtggaatatcgtgaagcttatgagcggaaaagatgtcttctatctgccacctgaaaagtgtgacacattgctgtgcgatattggtgagtcctctcccagccctactgtggaagagtccagaaccatcagggttctcaagatggtagagccatggttaaaaaacaatcagttctgtattaaggtgctgaacccctacatgcctacagtcatcgaacaccttgagcgcctgcaacggaaacacggcgggatgctagtgcgaaatccactctcaagaaactctacccatgaaatgtattggataagtaatggaactggcaacattgttgcatcggtgaatatggtcagcaggctgttgctgaaccgctttacgatgacacaccggagacccaccatcgagaaggacgtggatctcggtgccgggactcgtcatgtaaacgctgaaccggagacccctaatatggacgtgatcggagagaggattaaacggataaaggaagagcacaactccacatggcactacgacgatgaaaatccatataagacgtgggcgtaccatggctcttatgaggttaaagccaccggctcagcaagctccatgatcaacggggtcgtgaagcttctgactaaaccctgggacgtggtccctatggttacacagatggctatgaccgatactacaccattcggacagcaacgcgtgtttaaggaaaaagtagacacccgaacacccagaagtatgccgggtactaggcgggtgatgggcattaccgccgagtggttatggcgcacgctggggagaaataagaagcctaggttgtgcacccgagaggaattcacaaaaaaggtccggactaacgcagccatgggagctgtgtttaccgaggaaaatcagtgggattctgccaaagcggcagttgaggacgaagatttctggaagctcgtggaccgtgagagagagctgcacaaactaggcaagtgtggtagctgcgtctacaacatgatggggaaacgcgaaaagaagcttggagagtttggcaaagccaagggctcaagggctatctggtacatgtggctgggggcccggtatctcgaattcgaggcactgggatttttgaatgaggatcattggttctccagagaaaacagttacagcggtgtggagggcgaagggctgcacaaactcggatatattcttcgcgacatctctaagatacccggcggtgctatgtacgccgatgacacagctgggtgggacactaggatcaccgaggatgacctgcataatgaagagaaaattacgcagcagatggatccagagcaccgacaattagccaacgcaatctttaagctgacatatcagaataaggtagttaaagtgcagcggcctacccccactggaacagtcatggacattatctccagaaaggatcagaggggctcaggccaagtggggacctacggattgaacactttcaccaatatggaagcgcagctcatacgccagatggagggtgaaggcgtgctgagcaaagccgacctagagaacccacaccttcccgaaaagaaaattacacagtggctggagacgaagggggtcgagcgtctcaagcggatggctatctcgggagatgactgcgttgtgaaacctatcgatgacagatttgccaacgcactgttggctttaaatgatatgggcaaggtaaggaaagacattccacaatggcagccgtctaagggttggcatgattggcagcaggtgcccttctgtagtcaccatttccacgaactgataatgaaagacgggcgcaagctcgtcgtgccttgccgaccacaagacgagcttatcggacgggccagaatttcccagggcgcaggctggagcctgagggaaaccgcctgtctagggaaggcgtatgctcagatgtggtcactgatgtactttcaccgcagagatctccggttggcctccaacgcaatctgctctgccgttcccgtgcattgggtccctactagcaggacaacctggagtattcacgctcatcaccaatggatgactacagaggacatgctgaccgtgtggaatcgtgtatggatcgaagataacccatggatggaggacaaaacgcccgttacaacctgggagaatgtgccttaccttggaaagcgagaagatcagtggtgtggttccctgataggcctcactagccgcgccacctgggcacagaacatcccgacagctattcagcaagtcagatctttaatcgggaatgaggaattcctggactatatgccatcaatgaaacggtttaggaaggaggaggaaagtgagggagccatttggtga

SEQ ID NO: 15461 - RNA, 9873 nt, synthetic construct
  misc_feature 1..9873: note = derived and/or modified CDS sequence (opt3) from DENV-3__FJ547077__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaactataggcccgggtaccatacacaaactgctggaccttggcaccttggcaagttggagctggactttaattattgcgaggggaccacagtcgtgattacggaaaactgtggaacccgtggcccaagtttacggactacaaccgtgtctggtaaactcatccacgagtggtgctgtcgaagctgcactctgccccctcttagatacatgggggaagatggatgttggtatggcatggagataaggccaatttccgaaaaggaggagaatatggtcaaatcactggttagcgccggttctggcaaggtggacaacttcacaatgggggtattgtgcctcgcaatcctgtttgaagaggtgatgcgcggaaagttcggcaaaaagcatatgatcgctggggtcttctttaccttcgtgctactgctctccggacagattacgtggcgggatatggcccacactctgatcatgattggcagtaatgcaagcgacagaatgggtatgggggttacctaccttgccttgatagctacatttaaaatccagcccttcctggcgttaggatttttcctcaggaagctgacctctcgcgaaaaccttctgctaggcgtgggcctcgccatggcaactacactgcaattgccggaggatattgaacagatggctaatgggatcgccctgggattaatggccctcaaactgattacccagtttgagacatatcagctttggactgctctgatctccttgacctgttcaaacacgatattcacactcaccgtcgcatggcgaactgccaccctgatcctagcgggtgtgagtctgcttcctgtttgccaaagctcgtccatgcggaagacagactggctcccaatgactgtggctgccatgggcgtcccccctctgcccttgtttattttctctctgaaggataccttaaaacgtagaagctggccactcaatgagggggtaatggcagtgggactggtttcaatccttgccagttccctgttgaggaacgacgtgcctatggctggccccctcgtcgcaggtgggctgctaattgcctgttacgtgatcacgggaacatctgcggatctgaccgtagaaaaggctgccgacgtgacttgggaggaagaggcagaacagacaggcgtcagccataaccttatgataaccgttgacgatgacggcactatgcgcattaaagatgacgagacagagaatatcctcaccgtgctgttgaagacggccttactgatcgtgtccgggatttttccatactcaataccggctactctcctggtctggcacacctggcagaaacagacacaacggagcggagtgctttgggatgttcctagtcccccagaaacccagaaggccgagctggaagagggtgtatatagaatcaaacagcagggcattttcgggaagacacaagtgggagtcggcgtgcagaaggagggtgtttttcatactatgtggcacgtgaccaggggggcagtcttgacgtacaacggaaaacgactagaacccaattgggcttctgtgaagaaagacctgatctcctatggcggcgggtggcgcctcagcgcccagtggcaaaagggagaggaagtacaggtcattgcggtggagcctggtaaaaacccaaagaatttccagacaatgcccggcactttccagaccacaaccggggaaatcggagccatagcactggattttaagcctggcacttcgggttcaccgatcattaaccgggaggggaaagttgtgggactttacggcaatggcgtcgtgaccaagaacgggggatatgtttctggtatcgctcaaacaaatgccgagccagacggccccacgcctgaattagaggaagagatgttcaaaaagagaaacctgactattatggatctccacccagggagtggaaaaaccaggaagtacttgcccgctatcgtgcgtgaagcaataaagcgccggctgagaacactcattctggcccctaccagggtcgtggccgctgagatggaggaagcgcttaaaggcctgccgatccgatatcagactacagcaaccaagtccgagcatacgggtcgggaaatcgtagacttgatgtgccacgccacttttacaatgcgcctactgagccccgtgagagttccaaattacaacctcattatcatggatgaggctcatttcaccgaccctgcctctatagcagccagggggtacattagcacccgggtcggaatgggcgaagctgcggccatctttatgactgcaacacccccaggcaccgctgatgccttccctcagtccaatgcacccattcaggacgaggagcgagacatcccagaaagatcatggaacagtgggaatgagtggataacagattttgccggaaaaactgtgtggttcgtgccgagcattaaggctggtaacgacatcgccaactgtttacgcaaaaatggcaagaaggtcatccaactgtctaggaaaacgtttgataccgaatatcagaagacaaaacttaacgactgggatttcgtagtgactaccgacatttccgagatgggggcgaattttaaggcagatcgtgttatcgaccctcggagatgcctgaaacccgtgattctcacagatggaccagagagggtcatattggccggccccatgcctgtgaccgctgcctcagctgcacagcgccgaggtagagttgggcggaacccacagaaggaaaatgaccaatacatcttcactggccagcccctgaacaatgatgaggaccacgcccattggacggaagctaagatgctcctggacaacattaatacccctgagggaatcatcccggcccttttcgaaccagagagggagaaaagtgcagcgattgatggcgaatatcgcctaaagggggagagccgtaaaacatttgtggaactgatgagacggggagacttgcccgtctggttagcccacaaggtggcttccgagggtataaaatacactgataggaagtggtgcttcgacggccagcgcaacaatcagatcctggaagagaacatggatgtagagatttggaccaaagaaggggagaagaagaaactccgacctagatggctggacgcccggacatattctgatccccttgcactgaaggaatttaaagacttcgctgccggaaggaagtcgatcgcactcgatttggtgaccgagattggccgcgttccaagccacctggcccatagaactaggaatgctctagacaacctggtcatgctccacacatcagaacatggtgggaaagcgtaccggcacgccgtggaggagcttcctgaaacgatggagaccctgttattgctgggcctcatgatcctgcttactggaggcgcaatgctgtttctcatatccgggaagggaatcggtaagacaagtattggcttgatctgtgtgattgcttctagcgggatgctgtggatggccgaaatccccttacaatggatagcctccgcaattgtcctagagttctttatgatggttctgctcatcccagagcctgaaaaacagcgtaccccgcaggataatcaacttgcttatgtggtaattggaatcctgaccttggccgcgacaatagctgccaacgagatgggcctgctcgaaactacgaagcgcgacctgggtatgtcaaaagagcccggggtggtctctccaaccagctaccttgatgtggacctccaccctgcaagtgcctggacactgtacgctgttgcaactaccgtgatcacacccatgttgcgacataccattgaaaattccactgccaacgtcagcctggcggctatcgccaaccaggcagtagtgttaatgggcctagacaagggatggccaatttctaaaatggatctgggcgttcctctccttgccctggggtgctattcacaggtgaatcccttgacgctgacagctgccgtcctcctgcttatcacccactacgcaataattggaccgggcttacaggctaaggccactagagaggcgcaaaagaggaccgccgcaggtatcatgaaaaacccaacagtggacgggatcatgactattgatctggaccctgtcatctatgattccaagttcgagaaacagctcggacaggtgatgttgctggttctatgtgctgtgcagctgctccttatgcggaccagttgggccctgtgcgaagcattgacactggctacgggccccataaccactctctgggagggtagcccaggcaagttttggaatacaaccattgccgtatcgatggccaacatcttccgcgggtcttacctggcgggagctggcttagcattttccattatgaaaagcgtggggactggaaagagaggcacaggttcacaaggggaaacccttggagagaagtggaaaaagaaactgaatcagctcagtaggaaggaattcgacctatataaaaagtctggcatcacggaggtcgatcggaccgaggccaaagaaggtctgaagcgaggcgagataacacatcacgctgtttccagagggagcgccaagttgcagtggtttgtggaacgcaacatggtcatccccgagggaagggtgattgacctgggctgtgggcggggaggctggtcatactattgcgcaggtctcaaaaaggtaactgaagtgcgtgggtacaccaaaggaggccctggccatgaggagccggttcccatgagtacatacgggtggaatatcgtgaagcttatgagcggaaaagatgtcttctatctgccacctgaaaagtgtgacactttgctgtgcgatattggtgagtcctctcccagccctaccgtggaagagtccagaacaatcagggtcctcaagatggtggagccatggttaaaaaacaatcagttctgtattaaggttctgaacccctacatgcctaccgtaatcgaacaccttgagcgcctgcaacggaaacacggcgggatgctagtgcgaaatccactctcaagaaactctactcatgaaatgtattggataagtaatggaacgggcaacattgtcgcctcggtgaatatggttagcaggctgttgctgaaccgctttacaatgacccaccggagacccactatcgagaaggacgtggatctcggtgctgggacccgtcatgtcaacgcggaaccggagacacctaatatggacgtgatcggagagaggattaaacggataaaggaagagcacaactccacgtggcactacgacgatgaaaatccatataagacctgggcctaccatggctcttatgaggtaaaagcaactggctcagctagctccatgatcaacggggtggttaagcttctgacaaaaccctgggacgtcgtgcctatggtgacccagatggccatgactgatacaaccccattcggacagcaacgcgtctttaaggaaaaagttgacacacgaactcccagaagtatgccgggtaccaggcgggtgatgggcattacggcagagtggttatggcgcaccctggggagaaataagaagcctaggttgtgcacacgagaggaattcactaaaaaggtacggaccaacgccgctatgggagccgtgtttacagaggaaaatcagtgggattctgcgaaagcagccgtcgaggacgaagatttctggaagctcgtggaccgtgagagagagctgcacaaactaggcaagtgtggtagctgcgtttacaacatgatggggaaacgcgaaaagaagcttggagagtttggcaaagctaagggctcaagggccatctggtacatgtggctgggggcacggtatctcgaattcgaggctctgggatttttgaatgaggatcattggttctccagagaaaacagttacagcggtgtggagggcgaagggctgcacaaactcggatatattcttcgcgacatctctaagatacccggcggtgccatgtacgctgatgacactgccgggtgggacaccaggatcacggaggatgacctgcataatgaagagaaaattacacagcagatggatccagagcaccgacaattagcaaacgcgatctttaagctgacctatcagaataaggtcgtgaaagtacagcggcctactcccacaggaaccgttatggacattatctccagaaaggatcagaggggctcaggccaagtggggacttacggattgaacaccttcacaaatatggaagcccagctcatacgccagatggagggtgaaggcgtcctgagcaaagctgacctagagaacccacaccttcccgaaaagaaaattacgcagtggctggagaccaagggggtggagcgtctcaagcggatggccatctcgggagatgactgcgtggtcaaacctatcgatgacagatttgcaaacgctctgttggccttaaatgatatgggcaaggttaggaaagacattccacaatggcagccgtctaagggttggcatgattggcagcaggtgcccttctgtagtcaccatttccacgaactgataatgaaagacgggcgcaagctcgtagtgccttgccgaccacaagacgagcttatcggacgggcaagaatttcccagggcgccggctggagcctgagggaaactgcgtgtctagggaaggcttatgcccagatgtggaacctgatgtactttcaccgcagagatctccggttggcatcaaatgccatctgctccgctgtccccgtgcattgggttcctacatctaggaccacttggagcattcacgcccatcaccaatggatgacaaccgaggacatgctgacggtgtggaaccgtgtctggatcgaagataatccatggatggaggacaaaacacccgtgaccacttgggagaacgtaccttaccttggaaagcgagaagatcagtggtgtggtagtctgataggcctcacctcccgcgcaacatgggctcagaatatcccgactgccattcagcaagttagaagcttaatcgggaacgaggaattcctggactatatgccatctatgaaacggtttaggaaggaggaggaatcagagggagcgatttggtga

SEQ ID NO: 15462 - RNA, 9873 nt, synthetic construct
  misc_feature 1..9873: note = derived and/or modified CDS sequence (opt3) from DENV-3__FJ547078__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctggattgatgtggtcctggagcacggcgggtgcgtgacgactatggcgaagaataaacccacactagacatcgagctccagaagaccgaagcaactcaactggccacacttaggaaactgtgtattgagggaaagatcaccaacataacgaccgatagccggtgccctacacagggcgaagctgtgttgccagaggaacaggaccagaattatgtctgtaaacacacttacgttgatcgcggttgggggaacggatgcggcctcttcggcaaggggagtctggtgacctgcgccaagtttcaatgtttagagcccattgagggaaaagtagtgcagtatgaaaatctgaagtacacagtcatcattactgtgcataccggtgaccagcaccaggttggcaacgagacacaaggggtgaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacagaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgatcaaggtcgagtacaagggagaagatgtgccctgtaaaatacctttctccacagaggacggccaaggtaaggctcataacgggcgtcttattactgcgaatccagttgtgaccaaaaaggaggaacccgtaaacatcgaggcagaaccgcctttcggcgagtcaaatatcgtcattggaatcggcgataacgccttgaaaattaattggtataagaaggggagcagtataggaaaaatgtttgaagctacagcccgcggtgcaagaaggatggccatcctgggcgacactgcttgggatttcgggtctgtgggaggcgttctcaactccctgggtaagatggtgcaccagatttttgggagcgcctacaccgcacttttctcgggcgtctcttgggtgatgaaaatcggaatcggcgtactgttgacgtggattgggctcaattccaagaacacatcaatgagttttagctgcatagcgatcggaattatcaccctgtatttaggcgctgtggttcaggccgacatgggttgtgtcattaattggaaagggaaggagctgaagtgcggatccggcatcttcgtgactaacgaggtgcatacatggaccgaacagtacaaatttcaagcagattctcccaagcggctagccactgctatagccggtgcatgggagaatggcgtctgtgggatccgaagcaccacacgcatggaaaacctcctgtggaaacagattgctaatgagcttaactatatcttgtgggaaaataacattaagctgacggttgtggtgggagacatcataggcgtactcgagcaggggaaaagaaccctgactccacagcctatggagttaaagtactcatggaaaacatggggaaaggccaagattgtcaccgcggaaacacaaaacagttccttcatcattgatggccccaatactccagagtgccccagcgcctctagggcttggaacgtgtgggaagttgaggactatggttttggggtgttcaccacgaatatctggctgaaacttcgggaagtctacacacagttgtgtgaccaccgcctcatgtcagcagccgtgaaggatgagagagctgttcacgccgacatgggatactggatagagagtcagaaaaacggcagctggaagctggaaaaagcatccctaatcgaggtgaagacctgcacttggcctaagtctcataccctgtggtcgaatggtgtactcgaaagcgatatgattatcccaaaatccctggcgggcccgatttcacagcacaactataggcccgggtaccatacacaaactgccggaccttggcaccttggcaagttggagctggactttaattattgcgaggggaccacagtcgtgatcacggaaaactgtggaacccgtggcccaagtttacggactacaaccgtgtctggtaaactcatacacgagtggtgctgtcgaagctgcactctgccccctcttagatacatgggggaagatggatgttggtatggcatggagattaggccaatctccgaaaaggaggagaatatggtcaaatcactggttagcgctggttctggcaaggtggacaacttcacaatgggggtattgtgcctcgccatcctgtttgaagaggtgatgcgcggaaagttcggcaaaaagcatatgattgcaggggtcttctttaccttcgtgctactgctctccggacagatcacgtggcgggatatggctcacactctgattatgataggcagtaatgccagcgacagaatgggtatgggggttacctaccttgcattgatcgccacatttaaaattcagcccttcctggctttaggatttttcctcaggaagctgacctctcgcgaaaaccttctgctaggcgtgggcctcgcgatggccactacactgcaattgccggaggatatcgaacagatggcaaatgggattgctctgggattaatggccctcaaactgatcacccagtttgagatatatcagctttggacagccctgatctccttgacttgttcaaacaccattttcacgctcacagtcgcttggcgaaccgcaactctgatcctagccggtgtgagtctgcttcctgtttgccaaagctcgtccatgcggaagaccgactggctcccaatgacagtggcggctatgggcgtcccccctctgcccttgtttattttctctctgaaggatactttaaaacgtagaagctggccactcaatgagggggtaatggccgtgggactggtttcaatccttgcaagttccctgttgaggaacgacgtgcctatggccggccccctcgtcgctggtgggctgctaatagcatgttacgtgattaccggaacgtctgccgatctgacagtagaaaaggcggctgacgtgacctgggaggaagaggccgaacagactggcgtcagccataaccttatgatcacagttgacgatgacggcaccatgcgcatcaaagatgacgagactgagaatattctcacagtgctgttgaagaccgcattactgatagtgtccgggatctttccatactcaattccggccacgctcctggtctggcacacttggcagaaacagacccaacggagcggagtgctttgggatgttcctagtcccccagaaacacagaaggctgagctggaagagggtgtatatagaatcaaacagcagggcattttcgggaagacccaagtgggagtcggcgtgcagaaggagggtgtttttcatacaatgtggcacgtgactaggggggccgtcttgacctacaacggaaaacgactagaacccaattgggcatctgtgaagaaagacctgatctcctatggcggcgggtggcgcctcagcgctcagtggcaaaagggagaggaagtacaggtcatagccgtggagcctggtaaaaacccaaagaatttccagacgatgcccggcacattccagactaccacaggggaaatcggagcgattgccctggattttaagcctggcacctcgggttcaccgatcattaaccgggaggggaaagttgtgggactttacggcaatggcgtcgtgactaagaacgggggatatgtttctggtatcgcacaaaccaatgctgagccagacggccccacacctgaattagaggaagagatgttcaaaaagagaaacctgacgataatggatctccacccagggagtggaaaaactaggaagtacttgcccgccattgtgcgtgaagctatcaagcgccggctgagaaccctcatcctggcacctacaagggtcgtggccgccgagatggaggaagctcttaaaggcctgccgattcgatatcagaccactgcgacaaagtccgagcataccggtcgggaaatcgtagacttgatgtgccacgcaacgtttactatgcgcctactgagccccgtgagagttccaaattacaacctcataattatggatgaggcccatttcacagaccctgcttctatcgccgcaagggggtacattagcacccgggtcggaatgggcgaagccgctgcgatctttatgaccgccactcccccaggcacagcagatgctttccctcagtccaatgcccccatacaggacgaggagcgagacattccagaaagatcatggaacagtgggaatgagtggatcaccgattttgcaggaaaaacagtgtggttcgtgccgagcatcaaggccggtaacgacattgctaactgtttacgcaaaaatggcaagaaggtcatccaactgtctaggaaaacttttgatacggaatatcagaagaccaaacttaacgactgggatttcgtagtgacaactgacatttccgagatgggggccaattttaaggcggatcgtgttatagaccctcggagatgcctgaaacccgtgatcctcaccgatggaccagagagggtcattttggcaggccccatgcctgtgacagccgcttcagccgctcagcgccgaggtagagttgggcggaacccacagaaggaaaatgaccaatacatcttcaccggccagcccctgaacaatgatgaggaccacgcacattggactgaagccaagatgctcctggacaacatcaatacgcctgagggaattataccggctcttttcgaaccagagagggagaaaagtgccgcaatcgatggcgaatatcgcctaaagggggagagccgtaaaacctttgtggaactgatgagacggggagacttgcccgtctggttagcgcacaaggtggcctccgagggtattaaatacacagataggaagtggtgcttcgacggccagcgcaacaatcagatcctggaagagaacatggatgtagagatttggactaaagaaggggagaagaagaaactccgacctagatggctggacgctcggacctattctgatccccttgccctgaaggaatttaaagacttcgcagctggaaggaagtcgatcgccctcgatttggtgacagagataggccgcgttccaagccacctggcacatagaaccaggaatgccctagacaacctggtcatgctccacacttcagaacatggtgggaaagcttaccggcacgcggtggaggagcttcctgaaacaatggagacgctgttattgctgggcctcatgatcctgcttaccggaggcgccatgctgtttctcatttccgggaagggaatcggtaagactagtattggcttgatctgtgtgatagcatctagcgggatgctgtggatggctgaaattcccttacaatggatcgcctccgccattgtcctagagttctttatgatggttctgctcatcccagagcctgaaaaacagcgtacaccgcaggataatcaacttgcatatgtggtaataggaatcctgaccttggctgccattatcgcggctaacgagatgggcctgctcgaaaccacaaagcgcgacctgggtatgtcaaaagagcccggggtggtctctccaactagctaccttgatgtggacctccaccctgccagtgcatggacgctgtacgccgttgctaccacagtgattactcccatgttgcgacataccatcgaaaattccacagcaaacgtcagcctggccgcgatagctaaccaggccgtagtgttaatgggcctagacaagggatggccaatttctaaaatggatctgggcgttcctctccttgcactggggtgctattcacaggtgaatcccttgaccctgactgccgctgtcctcctgcttatcacgcactacgccatcattggaccgggcttacaggcaaaggctacaagagaggcccaaaagaggaccgcggccggtatcatgaaaaacccaactgtggacgggataatgaccattgatctggaccctgtcatctatgattccaagttcgagaaacagctcggacaggtgatgttgctggttctatgtgcagtgcagctgctccttatgcggacaagttgggctctgtgcgaagccttgactctggcaaccggccccattacaacgctctgggagggtagcccaggcaagttttggaataccactatcgctgtatcgatggccaacatattccgcgggtcttacctggccggagcgggcttagctttttccatcatgaaaagcgtggggacaggaaagagaggcaccggttcacaaggggaaactcttggagagaagtggaaaaagaaactgaatcagctcagtaggaaggaattcgacctatataaaaagtctggcattacagaggtcgatcggaccgaggcaaaagaaggtctgaagcgaggcgagatcacgcatcacgccgtttccagagggagcgctaagttgcagtggtttgtggaacgcaacatggtcattcccgagggaagggtgatcgacctgggctgtgggcggggaggctggtcatactattgcgccggtctcaaaaaggtaaccgaagtgcgtgggtacacaaaaggaggccctggccatgaggagccggttcccatgagtacttacgggtggaatattgtgaagcttatgagcggaaaagatgtcttctatctgccacctgaaaagtgtgacaccttgctgtgcgatatcggtgagtcctctcccagccctacagtggaagagtccagaactataagggtcctcaagatggtggagccatggttaaaaaacaatcagttctgtattaaggttctgaacccctacatgcctaccgtaatcgaacaccttgagcgcctgcaacggaaacacggcgggatgctagtgcgaaatccactctcaagaaactctacacatgaaatgtattggatcagtaatggaaccggcaacattgtcgcatcggtgaatatggttagcaggctgttgctgaaccgctttactatgacgcaccggagacccacaatagagaaggacgtggatctcggtgccgggacccgtcatgtcaacgctgaaccggagactcctaatatggacgtgatcggagagaggattaaacggatcaaggaagagcacaactccacctggcactacgacgatgaaaatccatataagacatgggcgtaccatggctcttatgaggtaaaagccacgggctcagcaagctccatgattaacggggtggttaagcttctgaccaaaccctgggacgtcgtgcctatggtgactcagatggctatgacagataccactccattcggacagcaacgcgtctttaaggaaaaagttgacacacgaacccccaagagtatgccgggtacaagaagggtgatgggcatcactgccgagtggttatggcggaccctggggcgcaataagaaacctagattgtgcacgagggaggaattcaccaagaaagtacgaacaaacgcagccatgggagctgtgtttactgaggaaaatcagtgggattctgccaaggcggcagtcgaggacgaagatttctggaaactcgtggaccgggagcgtgagctgcacaagctaggcaaatgtggtagctgcgtttacaacatgatggggaagagagaaaagaaacttggagagtttggcaaggccaaaggctcacgcgctatatggtacatgtggctgggggccaggtatctcgaattcgaggcactgggatttttgaatgaggatcattggttctcccgggaaaacagttacagcggtgtggagggcgaagggctgcacaagctcggatatatccttagagacatttctaaaatccccggcggtgctatgtacgccgatgacaccgctgggtgggacacacgcattactgaggatgacctgcataatgaagagaagatcacccagcagatggatccagagcacaggcaattagccaacgcaatatttaagctgacgtatcagaataaagtcgtgaaggtacagcgacctacacccaccggaactgttatggacattatctcccggaaagatcagagaggctcaggccaagtggggacatacggattgaacaccttcactaatatggaagcgcagctcatcaggcagatggagggtgaaggcgtcctgagcaaggccgacctagagaacccacaccttcccgaaaaaaagattacccagtggctggagacaaagggggtggagcgcctcaaacgtatggctatatcgggagatgactgcgtggtcaagcctatcgatgaccggtttgccaacgcactgttggctttaaatgatatgggcaaagttagaaaggacattccacaatggcagccgtctaaaggttggcatgattggcagcaggtgcccttctgtagtcaccatttccacgaactgatcatgaaggacgggaggaagctcgtagtgccttgccgcccacaagacgagcttattggacgagcccggatctcccagggcgcaggctggagcctgagagaaacggcctgtctagggaaagcgtatgctcagatgtggtcactgatgtactttcacaggcgcgatctcagattggcctccaacgcaatatgctctgccgtccccgtgcattgggttcctaccagccggactacatggagtatccacgctcatcaccaatggatgaccactgaggacatgctgacagtgtggaatagggtctggattgaagataacccatggatggaggacaagacccccgtgacgacatgggagaatgtaccttaccttggaaaacgtgaagatcagtggtgtggttccctgatcggcctcaccagccgagccacttgggcacagaacattccgaccgctatccagcaagttcgctctttaattgggaatgaggaattcctggactatatgccatcaatgaagagatttcggaaagaggaggaaagtgagggagccatatggtga

SEQ ID NO: 15463 - RNA, 9873 nt, synthetic construct
  misc_feature 1..9873: note = derived and/or modified CDS sequence (opt3) from DENV-3__FJ547079__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatgactgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggaaaaggcggctgacgtcacttgggaggaagaggccgaacagacaggcgttagccataaccttatgataaccgtggacgatgacggcactatgcgcattaaagatgacgagacagagaatatcctcaccgtgctgttgaagacggcattactgatcgtctccgggatttttccatactcaataccggccactctcctggtgtggcacacctggcataaacagacacagcggagcggagttctttgggatgtacctagtcccccagaaacccaaaaggctgagctggaagagggtgtgtatagaatcaaacagcagggcattttcgggaagacacaggtcggagtgggcgttcaaaaggagggtgtgtttcacactatgtggcacgtcaccaggggggccgtgttgacgtacaacggaaaacgactagaacccaattgggcatctgtaaagaaagacctgatctcctatggcggcgggtggcgcctcagcgctcagtggcagaagggagaggaagtccaagtgattgccgttgagcctggtaaaaacccaaagaatttccagacaatgcccggcactttccagaccacaaccggggaaatcggagcgatagccctggattttaagcctggcacttcgggttcaccgatcattaaccgggaggggaaagtggtcggactttacggcaatggcgtggttaccaagaacgggggatatgtgtctggtatcgcacagacaaatgctgagccagacggccccacgcctgaattagaggaagagatgttcaaaaagagaaacctgactattatggatctccatccagggagtggaaaaaccaggaagtacttgcccgccatcgtccgtgaagctataaagcgccggctgagaacactcattctggcacctaccagggtggtagccgccgagatggaggaagctcttaaaggcctgccgatccgatatcaaactacagcgaccaagtccgagcacacgggtcgggaaatcgtggacttgatgtgccatgcaacttttacaatgcgcctactgagccccgttagagtcccaaattacaacctcattatcatggatgaggcccacttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaaaactgtgtggttcgtcccgagcattaaggccggtaacgacatcgctaactgtttacgcaaaaatggcaagaaggtaatccagctgtctaggaaaacgtttgataccgaatatcaaaagacaaaacttaacgactgggatttcgtggttactaccgacatttccgagatgggggccaattttaaggcggatcgtgtgatcgaccctcggagatgcctgaaacccgtcattctcacagatggaccagagagggtgatattggcaggccccatgcctgttaccgccgcttcagccgctcagcgccgaggtagagtggggcggaacccacagaaggaaaatgaccagtacatcttcactggccaacccctgaacaatgatgaggaccatgcacactggacggaagccaagatgctcctggacaacattaatacccctgagggaatcatcccggctcttttcgaaccagagagggagaaaagtgccgcaattgatggcgaatatcgcctaaagggggagagccgtaaaacatttgtcgaactgatgagacggggagacttgcccgtgtggttagcgcacaaggtagcctccgagggtataaaatacactgataggaagtggtgcttcgacggccagcgcaacaatcagatcctggaagagaacatggatgtggagatttggaccaaagaaggggagaagaagaaactccgacctagatggctggacgctcggacatattctgatccccttgccctgaaggaatttaaagacttcgcagctggaaggaagtcgatcgccctcgatttggttaccgagattggccgcgtcccaagccatctggcacacagaactaggaatgccctagacaacctggtgatgctccatacatcagaacacggtgggaaagcttaccggcacgcggtggaggagcttcctgaaacgatggagaccctgttattgctgggcctcatgatcctgcttactggaggcgccatgctgtttctcatatccgggaagggaatcggtaagacaagtattggcttgatctgtgtcattgcatctagcgggatgctgtggatggctgaaatccccttacagtggatagcctccgccattgttctagagttctttatgatggtgctgctcatcccagagcctgaaaaacaacgtaccccgcaggataatcagcttgcatatgtagtgattggaatcctgaccttggctgccataatcgcggctaacgagatgggcctgctcgaaacaactaagcgcgacctgggtatgtcaaaagagcccggggtcgtgtctccaacgagctaccttgatgttgacctccatcctgccagtgcatggaccctgtacgccgtggctacaactgtcattacccccatgttgcgacacacaatcgaaaattccaccgcaaacgtaagcctggccgcgattgctaaccaagccgtggttttaatgggcctagacaagggatggccaatctctaaaatggatctgggcgtgcctctccttgcactggggtgctattcacaggtcaatcccttgactctgacggccgctgtgctcctgcttataacacattacgccattatcggaccgggcttacaggcaaaggctaccagagaggcccagaagaggactgcggccggtatcatgaaaaacccaaccgtcgacgggattatgacaatcgatctggaccctgtgatatatgattccaagttcgagaaacaactcggacaggttatgttgctggtgctatgtgcagtacagctgctccttatgcggactagttgggctctgtgcgaagccttgaccctggcaacaggccccattacgaccctctgggagggtagcccaggcaagttttggaatactacaatcgctgtgtcgatggccaacattttccgcgggtcttacctggccggagcgggcttagctttttccatcatgaaaagcgtcgggaccggaaagagaggcactggttcacagggggaaacacttggagagaagtggaaaaagaaactgaatcaactcagtaggaaggaattcgacctatataaaaagtctggcataaccgaggttgatcggacggaggcaaaagaaggtctgaagcgaggcgagatcacccaccatgccgtgtccagagggagcgctaagttgcagtggtttgtcgaacgcaacatggtgattcccgagggaagggtaatcgacctgggctgtgggcggggaggctggtcatactattgcgccggtctcaaaaaggtgacagaagttcgtgggtacactaaaggaggccctggccacgaggagccggtgcccatgagtacctacgggtggaatattgtcaagcttatgagcggaaaagatgtgttctatctgccacctgaaaagtgtgacacattgctgtgcgatatcggtgagtcctctcccagccctactgtcgaagagtccagaaccattagggtgctcaagatggttgagccatggttaaaaaacaatcagttctgtatcaaggtactgaacccctacatgcctacagtgatagaacaccttgagcgcctgcagcggaaacatggcgggatgctagtccgaaatccactctcaagaaactctacccacgaaatgtattggattagtaatggaactggcaacatcgtggcatcggttaatatggtgagcaggctgttgctgaaccgctttacgatgacacatcggagacccaccatcgagaaggacgtcgatctcggtgccgggactcgtcacgtgaacgctgaaccggagacccctaatatggacgtaattggagagaggataaaacggatcaaggaagagcacaactccacatggcattacgacgatgaaaatccatataagacgtgggcgtaccacggctcttatgaggtgaaagccaccggctcagcaagctccatgattaacggggttgtcaagcttctgactaaaccctgggacgtggtgcctatggtcacacaaatggctatgaccgatactacaccattcggacagcagcgcgtttttaaggaaaaagtggacacccgaacacccagaagtatgccgggtactaggcgggtaatgggcatcaccgccgagtggttatggcgcacgctggggagaaataagaagcctaggttgtgcacccgagaggaattcacaaaaaaggtgcggactaacgcagccatgggagctgtctttaccgaggaaaatcaatgggattctgccaaagcggcagtggaggacgaagatttctggaagctcgttgaccgtgagagagagctgcataaactaggcaagtgtggtagctgcgtgtacaacatgatggggaaacgcgaaaagaagcttggagagtttggcaaagccaagggctcaagggctatttggtacatgtggctgggggcccggtatctcgaattcgaggcactgggatttttgaatgaggatcactggttctccagagaaaacagttacagcggtgtcgagggcgaagggctgcataaactcggatatatccttcgcgacatatctaagatccccggcggtgctatgtacgccgatgacacagctgggtgggacactaggattaccgaggatgacctgcacaatgaagagaaaatcacgcagcagatggatccagagcaccgacagttagccaacgcaatttttaagctgacatatcaaaataaggtggtaaaagttcagcggcctacccccactggaacagtgatggacatcatatccagaaaggatcagaggggctcaggccaggtcgggacctacggattgaacactttcaccaatatggaagcgcaactcattcgccagatggagggtgaaggcgtgctgagcaaagccgacctagagaacccacatcttcccgaaaagaaaatcacacagtggctggagacgaagggggtggagcgtctcaagcggatggctatctcgggagatgactgcgtcgttaaacctattgatgacagatttgccaacgcactgttggctttaaatgatatgggcaaggtgaggaaagacataccacagtggcaaccgtctaagggttggcacgattggcagcaggtacccttctgtagtcatcacttccacgaactgatcatgaaagacgggcgcaagctcgtggtcccttgccgaccacaggacgagcttattggacgggccagaatctcccaaggcgcaggctggagcctgagggaaaccgcctgtctagggaaggcgtatgctcagatgtggtcactgatgtactttcatcgcagagatctccggttggcctccaacgcaatttgctctgccgtgcccgttcactgggtgcctactagcaggacaacctggagtatccatgctcaccatcagtggatgactacagaggacatgctgaccgtctggaatcgtgtgtggatagaagataacccatggatggaggacaaaacgcccgtaacaacctgggagaatgttccttaccttggaaagcgagaagatcaatggtgtggttccctgatcggcctcactagccgcgccacctgggcacagaacattccgacagctatccagcaggtgagatctttaattgggaatgaggaattcctggactatatgccatcaatgaaacggtttaggaaggaggaggaaagtgagggagccatctggtga

SEQ ID NO: 15464 - RNA, 9873 nt, synthetic construct
  misc_feature 1..9873: note = derived and/or modified CDS sequence (opt3) from DENV-3__FJ547080__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagcatgaaaatctgaagtatacagtgattatcactgttcacaccggtgaccagcatcaggtgggcaacgagacacaaggggtcaccgcagaaattactcctcaggcttccacgacagaggccatcctcccagaatacggaacccttggcctggagtgctctccgcgaactggtttggacttcaatgagatgatcctactgaccatgaaaaacaaggcgtggatggtgcacagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcatactgctctcacaggcgccaccgaaattcagaattcagggggaacaagtatattcgcaggtcacctgaagtgtcggttaaaaatggacaagctggagctaaaaggcatgagctatgccatgtgcactaacacctttgtgctcaagaaagaggtctctgaaacgcagcatgggaccatcctgattaaggtggagtacaagggagaagatgttccctgtaaaatccctttctccacagaggacggccaaggtaaggctcacaacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtacaagaaggggagcagtattggaaaaatgtttgaagctacagcccgcggtgcaagaaggatggccatactgggcgacactgcttgggatttcgggtctgttggaggcgtgctcaactccctgggtaagatggtccatcagatctttgggagcgcctataccgcacttttctcgggcgtgtcttgggtaatgaaaattggaatcggcgtgctgttgacgtggatcgggctcaattccaagaacacatcaatgagttttagctgcattgttataggaatcattaccctgtacttaggcgcggtcgtgcaggctgacatgggttgtgtgatcaattggaaagggaaggagctgaagtgcggatccggcattttcgtcactaacgaggttcacacatggaccgaacagtataaatttcaagccgattctcccaagcggctagcaactgccatcgctggtgcctgggagaatggcgtgtgtgggatacgaagcaccacacgcatggaaaacctcctgtggaaacagatcgcaaatgagcttaactacattttgtgggaaaataacatcaagctgacggtggtagtcggagacattatcggcgtgctcgagcaggggaaaagaaccctgactccacagcctatggagttaaagtattcatggaaaacatggggaaaggctaagatagttaccgccgaaacacaaaacagttccttcattatcgatggccccaatactccagagtgccccagcgcgtctagggcctggaacgtgtgggaagtcgaggactacggttttggggtgttcaccacgaatatttggctgaaacttcgggaagtttatacacagttgtgtgaccaccgcctcatgtcagctgcagtgaaggatgagagagccgtacatgctgacatgggatactggatcgagagtcagaaaaacggcagctggaagctggaaaaagcctccctaatagaggtcaagacctgcacttggcctaagtctcacaccctgtggtcgaatggtgtgctcgaaagcgatatgatcattccaaaatccctggcaggcccgatctcacagcataactacaggcccgggtatcacacacaaactgcgggaccttggcaccttggcaagttggagctggactttaattactgcgaggggaccacagtggtcattacggaaaactgtggaacccgtggcccaagtttacggactacaaccgtttctggtaaactcatccatgagtggtgctgtcgaagctgcactctgccccctcttagatatatgggggaagatggatgttggtacggcatggagataaggccaatttccgaaaaggaggagaatatggtgaaatcactggtaagcgccggttctggcaaggtggacaacttcacaatgggggtcttgtgcctcgctatcctgtttgaagaggtgatgcgcggaaagttcggcaaaaagcacatgatcgccggggttttctttaccttcgtgctactgctctccggacagattacgtggcgggatatggcacatactctgatcatgattggcagtaatgctagcgacagaatgggtatgggggtcacctatcttgccttgatagcaacatttaaaatccagcccttcctggccttaggatttttcctcaggaagctgacctctcgcgaaaaccttctgctaggcgtgggcctcgctatggcgactacactgcaattgccggaggatattgaacagatggccaatgggatcgcactgggattaatggctctcaaactgattacccagtttgagacataccagctttggactgccctgatctccttgacctgttcaaacacgatattcacactcaccgttgcctggcgaactgctaccctgatcctagcaggtgtgagtctgcttcctgtctgccaaagctcgtccatgcggaagacagactggctcccaatgactgtagccgcgatgggcgtgccccctctgcccttgtttattttctctctgaaggataccttaaaacgtagaagctggccactcaatgagggggttatggctgtgggactggtctcaatccttgccagttccctgttgaggaacgacgtgcctatggcaggccccctcgtagccggtgggctgctaattgcttgttatgtgatcacgggaacatctgcagatctgaccgtcgaaaaggccgcggacgttacttgggaggaagaggctgaacagacaggcgtgagccacaaccttatgataaccgtggacgatgacggcactatgcgcattaaagatgacgagacagagaatatcctcaccgtcctgttgaagacggccttactgatcgtgtccgggatttttccatactcaataccggcaactctcctggtttggcatacctggcagaaacagacacaacggagcggagtactttgggatgtgcctagtcccccagaaacccagaaggccgagctggaagagggtgtctacagaatcaaacagcagggcattttcgggaagacacaagtgggagttggcgtgcagaaggagggtgtctttcacactatgtggcacgtgaccaggggggctgtattgacgtataacggaaaacgactagaacccaattgggcctctgtcaagaaagacctgatctcctacggcggcgggtggcgcctcagcgcacagtggcaaaagggagaggaagtgcaggttattgctgtggagcctggtaaaaacccaaagaatttccagacaatgcccggcactttccagaccacaaccggggaaatcggagccatagcgctggattttaagcctggcacttcgggttcaccgatcattaaccgggaggggaaagtcgtgggactttatggcaatggcgttgtgaccaagaacgggggatacgtctctggtatcgcccaaacaaatgcagagccagacggccccacgcctgaattagaggaagagatgttcaaaaagagaaacctgactattatggatctccatccagggagtggaaaaaccaggaagtatttgcccgctatcgtgcgtgaagccataaagcgccggctgagaacactcattctggctcctaccagggtagtggcagccgagatggaggaagcccttaaaggcctgccgatccgataccagactacagctaccaagtccgagcacacgggtcgggaaatcgttgacttgatgtgccatgcgacttttacaatgcgcctactgagccccgtcagagtgccaaattataacctcattatcatggatgaggcacacttcaccgaccctgcctctatagctgccagggggtacattagcacccgggtgggaatgggcgaagcagccgctatctttatgactgcgacacccccaggcaccgccgatgcattccctcagtccaatgctcccattcaggacgaggagcgagacatcccagaaagatcatggaacagtgggaatgagtggataacagattttgccggaaaaactgtctggttcgtaccgagcattaaggcaggtaacgacatcgccaactgtttacgcaaaaatggcaagaaggtgatccaactgtctaggaaaacgtttgataccgaataccagaagacaaaacttaacgactgggatttcgttgtgactaccgacatttccgagatgggggctaattttaaggccgatcgtgtcatcgaccctcggagatgcctgaaacccgtgattctcacagatggaccagagagggttatattggcgggccccatgcctgtgaccgcagcctcagctgcccagcgccgaggtagagtcgggcggaacccaaggaaggaaaatgaccagtatatcttcactggccaacccctgaacaatgatgaggaccatgctcactggacggaagcaaagatgctcctggacaacattaatacccctgagggaatcatcccggcccttttcgaaccagagcgcgagaaaagtgctgccattgatggcgaataccgtctaaagggggagagcagaaaaacatttgtggaactgatgcggaggggagacttgcccgtatggttagcacacaaggtggcgtccgagggtataaaatatactgatcgcaagtggtgcttcgacggccagcgaaacaatcagatcctggaagagaacatggatgttgagatttggaccaaagaaggggagaagaagaaactcagacctcggtggctggacgccaggacatactctgatccccttgctctgaaggaatttaaagacttcgccgcaggacgcaagtcgatcgctctcgatttggtcaccgagattggcagagtgccaagccatctggcccacaggactcggaatgcactagacaacctggtgatgctccatacatcagaacacggtgggaaagcctatcgtcacgctgtcgaggagcttcctgaaacgatggagaccctgttattgctgggcctcatgatcctgcttactggaggcgcgatgctgtttctcatatccgggaagggaatcggtaagacaagtattggcttgatctgtgttattgcctctagcgggatgctgtggatggcagaaatccccttacagtggatagcttccgccattgtgctagagttctttatgatggtactgctcatcccagagcctgaaaaacaacgcaccccgcaggataatcagcttgcctacgtggtcattggaatcctgaccttggcagctataatcgccgcgaacgagatgggcctgctcgaaacaactaagcgagacctgggtatgtcaaaagagcccggggtggtttctccaacgagctatcttgatgtggacctccatcctgctagtgcctggaccctgtacgcagtcgccacaactgtaattacccccatgttgagacacacaatcgaaaattccaccgctaacgtgagcctggcagccattgcgaaccaagctgttgtgttaatgggcctagacaagggatggccaatctctaaaatggatctgggcgtccctctccttgccctggggtgctactcacaggtgaatcccttgactctgacggcagccgtcctcctgcttataacacattatgctattatcggaccgggcttacaggccaaggcaaccagggaggctcagaagcggactgccgcgggtatcatgaaaaacccaaccgtggacgggattatgacaatcgatctggaccctgttatatacgattccaagttcgagaaacaactcggacaggtgatgttgctggtactatgtgccgtgcagctgctccttatgcgcactagttgggcactgtgcgaagctttgaccctggccacaggccccattacgaccctctgggagggtagcccaggcaagttttggaatactacaatcgcagtctcgatggctaacattttcagagggtcttatctggccggagccggcttagcgttttccatcatgaaaagcgttgggaccggaaagaggggcactggttcacagggggaaacacttggagagaagtggaaaaagaaactgaatcaactcagtcggaaggaattcgacctatacaaaaagtctggcataaccgaggtggatcgaacggaggctaaagaaggtctgaagagaggcgagatcacccaccatgcagtctcccgcgggagcgccaagttgcagtggtttgtggaaaggaacatggtaattcccgagggacgggtgatcgacctgggctgtgggcgtggaggctggtcatattactgcgctggtctcaaaaaggttacagaagtgagagggtatactaaaggaggccctggccacgaggagccggtccccatgagtacctacgggtggaatattgtgaagcttatgagcggaaaagatgtcttctacctgccacctgaaaagtgtgacacattgctgtgcgatatcggtgagtcctctcccagccctactgtggaagagtccaggaccattcgcgttctcaagatggtagagccatggttaaaaaacaatcagttctgtatcaaggtgctgaacccctatatgcctacagtcatagaacaccttgagcggctgcagcgaaaacatggcgggatgctagtgagaaatccactctcaaggaactctacccacgaaatgtactggattagtaatggaactggcaacatcgttgcctcggtgaatatggtcagccgcctgttgctgaaccggtttacgatgacacatagacgtcccaccatcgagaaggacgtggatctcggtgcagggactaggcacgtaaacgccgaaccggagacccctaatatggacgtgattggagagcggataaaacgcatcaaggaagagcacaactccacatggcattatgacgatgaaaatccatacaagacgtgggcttatcacggctcttacgaggttaaagcgaccggctcagccagctccatgattaacggggtcgtgaagcttctgactaaaccctgggacgtggtccctatggttacacaaatggcaatgaccgatactacaccattcggacagcagcgagtgtttaaggaaaaagtagacaccagaacacccaggagtatgccgggtactcggcgcgtgatgggcatcaccgctgagtggttatggagaacgctggggaggaataagaagcctcgattgtgcacccgggaggaattcacaaaaaaggtccgtactaacgccgcaatgggagccgtgtttaccgaggaaaatcaatgggattctgctaaagccgcggttgaggacgaagatttctggattctcgtggacagagagcgcgagctgcataagctaggcaaatgtggtagctgcgtctataacatgatggggaagagggaaaaaaagcttggagagtttggcaaggcaaaaggctcacgggccatctggtacatgtggctgggggctagatacctcgaattcgaggccctgggatttttgaatgaggatcactggttctcccgcgaaaacagttatagcggtgtggagggcgaagggctgcataagctcggatacatacttagggacatctctaaaattcccggcggtgcaatgtatgctgatgacacagccgggtgggacactcgaatcaccgaggatgacctgcacaatgaagagaagattacgcagcagatggatccagagcaccggcagttagctaacgccatctttaaactgacataccaaaataaggtagttaaggtgcagagacctacccccactggaacagtcatggacataatttccaggaaagatcagcgcggctcaggccaggtggggacctatggattgaacactttcaccaatatggaagcacaactcatccgtcagatggagggtgaaggcgtgctgagcaaggcggacctagagaacccacatcttcccgaaaaaaagatcacacagtggctggagacgaaaggggtcgagcggctcaagagaatggccatttcgggagatgactgcgttgtgaagcctatagatgacaggtttgctaacgccctgttggcattaaatgatatgggcaaagtacgcaaggacatcccacagtggcaaccgtctaaaggttggcacgattggcagcaggtgcccttctgtagtcatcacttccacgaactgattatgaaggacgggcgaaaactcgtcgtgccttgccggccacaggacgagcttatcggaagagctaggatttcccaaggcgccggctggagcctgcgcgaaaccgcatgtctagggaaggcctacgcgcagatgtggtcactgatgtattttcatagacgggatctcaggttggcttccaacgccatctgctctgcagttcccgtgcactgggtccctactagccgtacaacctggagtatacatgcccaccatcagtggatgactacagaggacatgctgaccgtgtggaatcgagtatggatcgaagataacccatggatggaggacaagacgcccgttacaacctgggagaatgtgccttaccttggaaaacgcgaagatcaatggtgtggttccctgattggcctcactagcagagctacctgggcccagaacatcccgacagcaattcagcaggtccggtctttaatcgggaatgaggaattcctggactacatgccatcaatgaagaggtttcgcaaagaggaggaaagtgagggagctatttggtga

SEQ ID NO: 15465 - RNA, 9873 nt, synthetic construct
  misc_feature 1..9873: note = derived and/or modified CDS sequence (opt3) from DENV-3__FJ547081__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcagcggtcatctgaagtgtcggttaaaaatggacaagctggagctaaaaggcatgtcttacgcaatgtgcactaacacctttgtgctcaagaaagaggtctccgaaacgcagcacgggaccatcctgattaaggtggagtacaagggagaagatgttccctgtaaaatccctttctcaacagaggacggccaaggtaaggcccataacgggcgtcttataactgctaatccagtggtaaccaaaaaggaggaacccgtcaacattgaggcggaaccgcctttcggcgagagcaatatcgtgatcggaattggcgataacgcattgaaaatcaattggtataagaaggggagttctattggaaaaatgtttgaagccacagctcgcggtgccagaaggatggcaatactgggcgacactgcctgggatttcgggtccgttggaggcgtgctcaacagcctgggtaagatggtccaccagatctttgggtcggcttacaccgcccttttctctggcgtgtcctgggtaatgaaaattggaatcggcgtgctgttgacgtggatcgggctcaattcaaagaacacaagtatgagcttttcctgcattgcaataggaatcattaccctgtatttaggcgcggttgtccaggctgacatgggttgtgtgatcaattggaaagggaaggagctgaagtgcggatctggcattttcgtgactaacgaggtccatacatggaccgaacagtacaaatttcaagccgatagccccaagcggctagcaactgccatcgctggtgcctgggagaatggcgtttgtgggatacgatcaaccacacgcatggaaaacctcctgtggaaacagatcgcaaatgagcttaactatattttgtgggaaaataacatcaagctgacggtggtggtaggagacattatcggcgtcctcgagcaggggaaaagaaccctgactccacagcctatggagttaaagtacagttggaaaacatggggaaaggctaagatagtgaccgccgaaacacaaaactccagcttcattatcgatggccccaatactccagagtgcccctctgcgtcaagggcctggaacgtttgggaagtggaggactatggttttggggtcttcaccacgaatatttggctgaaacttcgggaagtgtacacacagttgtgtgaccaccgcctcatgagtgctgcagttaaggatgagagagccgtgcacgctgacatgggatactggatcgagagccagaaaaacggctcctggaagctggaaaaagcctctctaatagaggtaaagacctgcacttggcctaagtcgcataccctgtggagcaatggtgtcctcgaatccgatatgatcattccaaaatcactggcaggcccgatcagtcagcacaactataggcccgggtaccatacacaaactgcgggaccttggcaccttggcaagttggagctggactttaattattgcgaggggaccacagtggtgattacggaaaactgtggaacccgtggcccatctttacggactacaaccgtcagcggtaaactcatccacgagtggtgctgtcgatcctgcactctgccccctcttagatacatgggggaagatggatgttggtatggcatggagataaggccaatttcagaaaaggaggagaatatggttaaaagcctggtgtctgccggttccggcaaggtagacaacttcacaatgggggtgttgtgcctcgctatcctgtttgaagaggtcatgcgcggaaagttcggcaaaaagcatatgatcgccggggtgttctttaccttcgttctactgctcagtggacagattacgtggcgggatatggcacacactctgatcatgattggcagcaatgcttctgacagaatgggtatgggggtgacctaccttgccttgatagcaacatttaaaatccagcccttcctggccttaggatttttcctcaggaagctgacctcccgcgaaaaccttctgctaggcgtcggcctcgctatggcgactacactgcaattgccggaggatattgaacagatggccaatgggatcgcactgggattaatgaccctcaaactgattacacagtttgagacttatcagctttggaccgctctgatctcattgacgtgtagtaacacaatattcaccctcactgtggcctggcgaaccgccacactgatcctagctggtgttagcctgcttcctgtgtgccaatcgtcctctatgcggaagactgactggctcccaatgaccgtcgcagccatgggcgtaccccctctgcccttgtttattttcagcctgaaggatacgttaaaacgtagatcatggccactcaatgagggggtgatggcggttggactggtgagtatccttgcttcctctctgttgaggaacgacgtccctatggccggccccctcgtggcaggtgggctgctaattgcctgttacgtaatcacaggaaccagcgctgatctgactgtggaaaaggcagccgacgtcacatgggaggaagaggcggaacagaccggcgtttcccataaccttatgataactgtggacgatgacggcacaatgcgcattaaagatgacgagaccgagaatatcctcacggtgctgttgaagactgctttactgatcgtctcagggatttttccatacagcataccggccaccctcctggtgtggcacacatggcagaaacagacccaacggagtggagttctttgggatgtaccttctcccccagaaacacagaaggcagagctggaagagggtgtgtatagaatcaaacagcagggcattttcgggaagactcaagtcggagtgggcgttcagaaggagggtgtgtttcataccatgtggcacgtcacgaggggggccgtgttgacatacaacggaaaacgactagaacccaattgggcttccgtaaagaaagacctgatcagctatggcggcgggtggcgcctctcggcccagtggcaaaagggagaggaagtccaggtgattgcagttgagcctggtaaaaacccaaagaatttccagactatgcccggcaccttccagacaaccactggggaaatcggagctatagccctggattttaagcctggcacctcaggttctccgatcattaaccgggaggggaaagtggtcggactttacggcaatggcgtggttacaaagaacgggggatatgtgagtggtatcgcgcaaacgaatgccgagccagacggccccactcctgaattagaggaagagatgttcaaaaagagaaacctgaccattatggatctccacccagggtccggaaaaacaaggaagtacttgcccgcaatcgtccgtgaagctataaagcgccggctgagaaccctcattctggcccctactagggtggtagctgcagagatggaggaagcccttaaaggcctgccgatccgatatcagacaaccgccacgaagagcgagcatactggtcgggaaatcgtggacttgatgtgccacgctacatttaccatgcgcctactgtctcccgttagagtcccaaattacaacctcattatcatggatgaggcgcatttcaccgaccctgcaagcatagccgctagggggtacatttccactcgggtgggaatgggcgaagccgcagccatctttatgacagctacccccccaggcacagcggatgccttccctcagtcaaatgcacccattcaggacgaggagcgagacatcccagaaagaagttggaacagcgggaatgagtggataactgattttgctggaaaaacggtgtggttcgtcccgtctattaaggccggtaacgacatcgcaaactgtttacgcaaaaatggcaagaaggtaatccaactgtccaggaaaacctttgatacagaatatcagaagactaaacttaacgactgggatttcgtggttaccacagacatttcagagatgggggccaattttaaggctgatcgtgtgatcgaccctcggagatgcctgaaacccgtcattctcaccgatggaccagagagggtgatattggccggccccatgcctgttactgcggcaagtgccgctcagcgccgaggtagagtggggcggaacccacagaaggaaaatgaccaatacatcttcacgggccagcccctgaacaatgatgaggaccacgcccattggaccgaagctaagatgctcctggacaacattaatacacctgagggaatcatcccggcacttttcgaaccagagagggagaaaagcgccgctattgatggcgaatatcgcctaaagggggagtcccgtaaaacttttgtcgaactgatgagacggggagacttgcccgtgtggttagcccacaaggtagcatctgagggtataaaatacgcggataggaagtggtgcttcgacggccagcgcaacaatcagatcctggaagagaacatggatgtggagatttggaccaaagaaggggagaagaagaaactccgacctagatggctggacgcccggacatattcggatccccttgctctgaaggaatttaaagacttcgccgcaggaaggaagagcatcgctctcgatttggttaccgagattggccgcgtcccatcacacctggcccatagaactaggaatgcactagacaacctggtgatgctccacacatccgaacatggtgggaaagcctaccggcacgctgtggaggagcttcctgaaacgatggagaccctgttattgctgggcctcatgatcctgcttactggaggcgcgatgctgtttctcataagtgggaagggaatcggtaagacatctattggcttgatctgtgtcattgccagctccgggatgctgtggatggcagaaatccccttacaatggatagcttcagccattgttctagagttctttatgatggtgctgctcatcccagagcctgaaaaacagcgtaccccgcaggataatcaacttgcctatgtagtgattggaatcctgaccttggcagctataatcgccgcgaacgagatgggcctgctcgaaacaactaagcgcgacctgggtatgtctaaagagcccggggtcgtgagcagtacgtcctaccttgatgttgacctccacccagctagcgcctggaccctgtacgcagtggccacaactgtcattacccctatgttgcgacatacaatcgaaaattctaccgctaacgtatcactggcagccattgcgaaccaggctgtggttttaatgggcctagacaagggatggcccatctccaaaatggatctgggcgtgccactccttgccctggggtgctatagtcaggtcaatcctttgactctgacggcagccgtgctcctgcttataacacactacgctattatcggacccggcttacaggccaaggcaaccagagaggctcaaaagaggactgccgcgggtatcatgaaaaacccgaccgtcgacgggattatgacaatcgatctggacccagtgatatatgatagcaagttcgagaaacagctcggacaggttatgttgctggtgctatgtgccgtacagctgctccttatgcggacttcgtgggcactgtgcgaagctttgaccctggccacaggccctattacgaccctctgggagggttctcccggcaagttttggaatactacaatcgcagtgtccatggctaacattttccgcgggagctacctggccggagccggcttagcgttttcaatcatgaaaagtgtcgggaccggaaagagaggcactggttctcaaggggaaacacttggagagaagtggaaaaagaaactgaatcagctctccaggaaggaattcgacctatataaaaagagcggcataaccgaggttgatcggacggaggctaaagaaggtctgaagcgaggcgagatcacccatcacgcagtgtcaagagggagtgccaagttgcagtggtttgtcgaacgcaacatggtgattccagagggaagggtaatcgacctgggctgtgggcggggaggctggagctactattgcgctggtctcaaaaaggtgacagaagttcgtgggtacactaaaggaggccccggccatgaggagcctgtgccgatgtccacctacgggtggaatattgtcaagcttatgtctggaaaagatgtgttctatctgcccccagaaaagtgtgacacattgctgtgcgatatcggtgagagctccccttcacccactgtcgaagagtctagaaccattagggtgctcaagatggttgagccttggttaaaaaacaatcagttctgtatcaaggtactgaacccatacatgcccacagtgatagaacaccttgagcgcctgcaacggaaacacggcgggatgctagtccgaaatcctctcagtagaaactcgacccatgaaatgtattggattagcaatggaactggcaacatcgtggcctccgttaatatggtgtctaggctgttgctgaaccgctttacgatgacacaccggagaccaaccatcgagaaggacgtcgatctcggtgcagggactcgtcatgtgaacgccgaacccgagaccccgaatatggacgtaattggagagaggataaaacggatcaaggaagagcacaactcaacatggcactacgacgatgaaaatccttataagacgtgggcttaccatggcagctatgaggtgaaagcgaccggctccgccagttctatgattaacggggttgtcaagcttctgactaaaccatgggacgtggtgcccatggtcacacagatggcaatgaccgatactacacctttcggacagcaacgcgtttttaaggaaaaagtggacacccgaacaccaagaagcatgcccggtactaggcgggtaatgggcatcaccgctgagtggttatggcgcacgctggggagaaataagaagccgaggttgtgcacccgagaggaattcacaaaaaaggtgcggactaacgccgcaatgggagccgtctttaccgaggaaaatcagtgggattcagctaaagccgcggtggaggacgaagatttctggaagctcgttgaccgtgagagagagctgcacaaactaggcaagtgtggttcctgcgtgtacaacatgatggggaaacgcgaaaagaagcttggagagtttggcaaagcaaagggcagtagggccatttggtacatgtggctgggggctcggtatctcgaattcgaggccctgggatttttgaatgaggatcattggttcagcagagaaaactcttactccggtgtcgagggcgaagggctgcacaaactcggatatatccttcgcgacatatcaaagatccctggcggtgcaatgtacgctgatgacacagccgggtgggacactaggattaccgaggatgacctgcataatgaagagaaaatcacgcagcagatggatcccgagcaccgacaattagctaacgccatttttaagctgacatatcagaataaggtggtaaaagttcagcggccaacccctactggaacagtgatggacatcataagcagaaaggatcagaggggctcgggccaagtcgggacctactctttgaacactttcaccaatatggaagcacagctcattcgccagatggagggagaaggtgtgctgagtaaagcggacctagagaacccccaccttccagaaaagaaaatcacacagtggctggagacgaagggcgtggagcgtctcaagcggatggccatctccggggatgactgcgtcgttaaacccattgatgacagatttgctaacgccctgttggcattaaatgatatgggaaaggtgaggaaagacatacctcaatggcagccaagcaagggctggcatgattggcagcaggtaccgttctgttcacaccatttccacgaactgatcatgaaagacggtcgcaagctcgtggtcccctgccgacctcaagacgagcttattgggcgggctagaatctcccagggagccggctggtctctgagggaaaccgcatgtctaggcaaggcctatgcgcagatgtggagcctgatgtactttcaccgcagagatctccggttggctagtaacgccatttgctccgcagtgccagttcattgggtgcccactagcaggacaacctggtctatccacgcccatcaccaatggatgactacagaggacatgctgaccgtctggaatcgtgtgtggatagaagataacccttggatggaggacaaaacgccagtaacaacctgggagaatgttccctaccttgggaagcgagaagatcagtggtgtggatcactgatcggtctcactagtcgcgctacctgggcccagaacattcctacagcaatccagcaagtgagatccttaattggcaatgaggaattcctggactatatgccgagcatgaaacggtttaggaaggaggaggaatctgagggggctatctggtga

SEQ ID NO: 15466 - RNA, 9873 nt, synthetic construct
  misc_feature 1..9873: note = derived and/or modified CDS sequence (opt3) from DENV-3__FJ547082__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacaccggttgtgtgatcaattggaaagggaaggagctgaagtgcggatccggcattttcgtgactaacgaggtccatacatggaccgaacagtacaaatttcaagccgattctcccaagcggctagctactgccatcgcaggtgcttgggagaatggcgtttgtgggatacgaagcaccacacgcatggaaaacctcctgtggaaacagatcgccaatgagcttaactatattttgtgggaaaataacatcaagctgacggtggtggtaggagacattatcggcgtcctcgagcaggggaaaagaaccctgactccacagcctatggagttaaagtactcatggaaaatgtggggaaaggcgaagatagtgacagccgaaacccaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggagctggactttaattattgcgaggggactaccgtggtgattacagaaaactgtggaacgcgtggcccaagtttacggaccactacagtctctggtaaactcatccacgagtggtgctgtcgaagctgcaccctgccccctcttagatacatgggggaagatggatgttggtatggcatggagataaggccaatttccgaaaaggaggagaatatggttaaatcactggtgagcgccggttctggcaaggtagacaacttcactatgggggtgttgtgcctcgcaatcctgtttgaagaggtcatgcgcggaaagttcggcaaaaagcatatgatcgctggggtgttctttacattcgttctactgctctccggacagattacctggcgggatatggcccacacgctgatcatgattggcagtaatgcaagcgacagaatgggtatgggggtgacttaccttgccttgatagctacctttaaaatccagcccttcctggcgttaggatttttcctcaggaagctgacatctcgcgaaaaccttctgctaggcgtcggcctcgccatggcaaccactctgcaattgccggaggatattgaacagatggctaatgggatcgccctgggattaatggccctcaaactgattacacagtttgagacctatcagctttggacagctctgatctccttgacttgttcaaacaccatattcacgctcacagtggcatggcgaaccgccactctgatcctagcgggtgttagtctgcttcctgtgtgccaaagctcgtccatgcggaagtctgactggctcccaatgaccgtcgctgccatgggcgtaccccctctgcccttgtttattttcagcctgaaggatacattaaaacgtagatcatggccactcaatgagggggtgatggcagttggactggtgagtatccttgcctcctctctgttgaggaacgacgtccctatggctggccccctcgtggcaggtgggctgctaattgcctgttacgtaatcactggaaccagcgcggatctgacggtggaaaaggctgccgacgtcacatgggaggaagaggcagaacagaccggcgtttcccataaccttatgataactgtggacgatgacggcacaatgcgcattaaagatgacgagaccgagaatatcctcactgtgctgttgaagacagccttactgatcgtctcagggatttttccatacagcataccggctaccctcctggtgtggcacacgtggcagaaacagactcggagaagtggagttctttgggatgtaccttctcccccagaaacccaaaaggccgagctggaagagggtgtgtataggatcaaacagcagggcattttcgggaagacacaggtcggagtgggcgttcaaaaggagggtgtgtttcataccatgtggcacgtcacacgaggggcagtgttgacttacaacggaaaacgcctagaacccaattgggcttccgtaaagaaagacctgatcagctatggcggcgggtggcggctctcggcccagtggcagaagggagaggaagtccaagtgattgcggttgagcctggtaaaaacccaaagaatttccagaccatgcccggcacgttccagacaactaccggggaaatcggagccatagcactggattttaagcctggcacatcaggttctccgatcattaacagagaggggaaagtggtcggactttacggcaatggcgtggttaccaagaacgggggatatgtgagtggtatcgctcagactaatgccgagccagacggccccacccctgaattagaggaagagatgttcaaaaagaggaacctgacaattatggatctccacccagggtccggaaaaacgcgtaagtacttgcccgctatcgtccgcgaagcaataaagcggagactgaggactctcattctggcccctacccgagtggtagccgctgagatggaggaagcgcttaaaggcctgccgatccggtatcaaacaaccgcaactaagagcgagcatacaggtcgcgaaatcgtggacttgatgtgccacgccacctttacgatgagactactgtctcccgttagggtcccaaattacaacctcattatcatggatgaggctcatttcactgaccctgccagcatagcagcccgggggtacatttccacacgagtgggaatgggcgaagctgcggccatctttatgaccgcaacccccccaggcactgctgatgccttccctcagtcaaatgcacccattcaggacgaggagagagacatcccagaacgcagttggaacagcgggaatgagtggataacagattttgccggaaaaaccgtgtggttcgtcccgtctattaaggctggtaacgacatcgccaactgtttaaggaaaaatggcaagaaggtaatccagctgtcccgtaaaacatttgatactgaatatcaaaagacgaaacttaacgactgggatttcgtggttaccacagacatttcagagatgggggcgaattttaaggcagatcgggtgatcgaccctagaaggtgcctgaaacccgtcattctcactgatggaccagagcgcgtgatattggccggccccatgcctgttaccgctgccagtgctgcacagcgaagaggtcgggtggggaggaacccacagaaggaaaatgaccagtacatcttcacaggccaacccctgaacaatgatgaggaccacgcccattggaccgaagctaagatgctcctggacaacattaatactcctgagggaatcatcccggcccttttcgaaccagagcgcgagaaaagcgcagcgattgatggcgaatatcgtctaaagggggagtccagaaaaacgtttgtcgaactgatgcggaggggagacttgcccgtgtggttagcccacaaggtagcttctgagggtataaaatacaccgatcgcaagtggtgcttcgacggccagcgaaacaatcagatcctggaagagaacatggatgtggagatttggacaaaagaaggggagaagaagaaactcagacctcggtggctggacgccaggacttattcggatccccttgcactgaaggaatttaaagacttcgctgccggacgcaagagcatcgcactcgatttggttaccgagattggcagagtcccatcacacctggcccataggacacggaatgctctagacaacctggtgatgctccacacctccgaacatggtgggaaagcgtaccgtcacgccgtggaggagcttcctgaaactatggagacactgttattgctgggcctcatgatcctgcttacgggaggcgcaatgctgtttctcataagtgggaagggaatcggtaagacctctattggcttgatctgtgtcattgctagctccgggatgctgtggatggccgaaatccccttacagtggatagcctcagcaattgttctagagttctttatgatggtgctgctcatcccagagcctgaaaaacaacgcactccgcaggataatcagcttgcttatgtagtgattggaatcctgacattggccgcgataatcgctgccaacgagatgggcctgctcgaaaccaccaagcgagacctgggtatgtctaaagagcccggggtcgtgagcccaacaagttaccttgatgttgacctccaccctgcatccgcctggactctgtacgctgtggcaacgaccgtcattacacccatgttgagacatactatcgaaaatagcaccgccaacgtatctctggcggctattgccaaccaagcagtggttttaatgggcctagacaagggatggccaatctcaaaaatggatctgggcgtgcctctccttgccctggggtgctattcccaggtcaatcccttgacactgaccgctgccgtgctcctgcttataactcactacgcaattatcggaccgggcttacaggctaaggccacgagggaggcgcagaagcggacagccgcaggtatcatgaaaaacccaaccgtcgacgggattatgactatcgatctggaccctgtgatatatgatagtaagttcgagaaacaactcggacaggttatgttgctggtgctatgtgctgtacagctgctccttatgcgcaccagctgggccctgtgcgaagcattgacactggctactggccccattaccacactctgggagggttcgccaggcaagttttggaatacgaccatcgccgtgtctatggccaacattttcagagggtcctacctggcgggagctggcttagcatttagcatcatgaaatcagtcgggactggaaagaggggcacaggtagtcagggggaaacccttggagagaagtggaaaaagaaactgaatcaactctctcggaaggaattcgacctatataaaaagtccggcataactgaggttgatcgaacagaggccaaagaaggtctgaagagaggcgagatcacccatcacgctgtgagccgcgggtcagccaagttgcagtggtttgtcgaaaggaacatggtgattcccgagggacgggtaatcgacctgggctgtgggcgtggaggctggagttactattgcgcaggtctcaaaaaggtgacggaagttagagggtacaccaaaggaggccctggccatgaggagccggtgcccatgagcacatacgggtggaatattgtcaagcttatgtccggaaaagatgtgttctatctgccacctgaaaagtgtgacactttgctgtgcgatatcggtgagtctagcccctcccctaccgtcgaagagtcaaggacaattcgcgtgctcaagatggttgagccatggttaaaaaacaatcagttctgtatcaaggtactgaacccctacatgcctactgtgatagaacaccttgagcggctgcagcgaaaacacggcgggatgctagtcagaaatccactctctaggaacagtacccatgaaatgtattggatttcgaatggaacaggcaacatcgtggccagcgttaatatggtgtcccgcctgttgctgaaccggtttaccatgactcacagacgtcccacgatcgagaaggacgtcgatctcggtgctgggacaaggcatgtgaacgcggaaccggagacccctaatatggacgtaattggagagcggataaaacgcatcaaggaagagcacaactctacttggcactacgacgatgaaaatccatataagacctgggcctaccatggctcatatgaggtgaaagcaacaggcagcgcttccagtatgattaacggggttgtcaagcttctgacgaaaccctgggacgtggtgcctatggtcacccaaatggccatgactgatacaaccccattcggacagcagcgagtttttaaggaaaaagtggacactagaacacccaggtctatgccgggtacccggcgcgtaatgggcatcacagcagagtggttatggagaactctggggaggaataagaagcctcgattgtgcacccgggaggaattcacgaaaaaggtgcgtaccaacgccgctatgggagccgtctttacagaggaaaatcaatgggatagcgcgaaagcagccgtggaggacgaagatttctggaagctcgttgacagagagcgcgagctgcacaaactaggcaagtgtggttcatgcgtgtacaacatgatggggaaaagggaaaagaagcttggagagtttggcaaagctaagggctcccgggccatttggtacatgtggctgggggcaagatatctcgaattcgaggctctgggatttttgaatgaggatcattggttcagtcgcgaaaacagctactctggtgtcgagggcgaagggctgcacaaactcggatatatccttagggacatatccaagatccccggcggtgccatgtacgctgatgacactgccgggtgggacacccgaattacagaggatgacctgcataatgaagagaaaatcactcagcagatggatccagagcaccggcagttagcaaacgcgatttttaagctgacctatcaaaataaggtggtaaaagttcagagacctacgcccacaggaaccgtgatggacatcatatcaaggaaggatcagcgcggcagcggccaggtcgggacttacggattgaacacattcaccaatatggaagcccaactcattcgtcagatggagggtgaaggcgtgctgtcgaaagctgacctagagaacccacacctttctgaaaagaaaatcactcagtggctggagaccaagggggtggagcggctcaagagaatggccatcagtggagatgactgcgtcgttaaacccattgatgacaggtttgcaaacgctctgttggccttaaatgatatgggcaaggtgcgcaaagacatacctcagtggcaaccatccaagggttggcatgattggcagcaggtaccgttctgtagccaccatttccacgaactgatcatgaaagacgggcgaaagctcgtggtcccctgccggcctcaggacgagcttattggaagagcaaggatctcacaaggcgccggctggtccctgcgcgaaacagcgtgtctagggaaggcttatgcccagatgtggtctctgatgtactttcacagacgggatctcaggttggcaagcaacgccatttgcagtgctgtgccagttcattgggtgcccacgtcccgtaccacttggagcatccacgcccatcaccagtggatgacaaccgaggacatgctgactgtctggaatcgagtgtggatagaagataacccttggatggaggacaaaacaccagtaaccacgtgggagaatgttccctaccttggaaagcgcgaagatcaatggtgtggttctctgatcggcctcacatcaagagcaacctgggctcagaacattcctactgccatccagcaggtgcggagtttaattgggaatgaggaattcctggactatatgccgtccatgaaaaggtttcgcaaggaggaggaaagcgagggagcgatctggtga

SEQ ID NO: 15467 - RNA, 9873 nt, synthetic construct
  misc_feature 1..9873: note = derived and/or modified CDS sequence (opt3) from DENV-3__FJ547083__SS-prME
  source 1..9873: mol_type = other RNA
accagcctgtgcctcatgatgatccttcccgcagctctggcattccacttgacatccagagacggcgaacctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgaaccggaagacatcgattgctggtgtaacctgaccagtacatgggtgacctatgggacttgcaatcaggctggagaacgccgacgtgacaagagatccgtcgcccttgcaccccacgtgggcatgggtctggatacaaggacccagacgtggatgtccgccgaaggggcttggcggcaggtcgaaaaagtggaaacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagagttatgtttgtaaacacacttacgtggatcgaggttgggggaatggatgcggcctcttcggcaaggggtccctggtaacctgcgccaagtttcaatgtttagagcccatagagggaaaagtggtccagtatgaaaacctgaagtacacagtgattatcactgttcacaccggtgaccagcatcaggtgggcaatgagacacaaggggtcaccgcagaaattactcctcaggcttctacgacagaggccatcctcccagaatatggaacccttggcctggagtgcagcccgagaactggtttggacttcaacgagatgatcctactgaccatgaaaaataaggcgtggatggtgcacaggcagtggtttttcgatctccccctgccttggacatccggggccaccactgaaacaccaacgtggaaccggaaagagcttctggtaacctttaagaatgcacatgctaaaaagcaagaagttgtggtcttgggctcacaggagggagccatgcacactgctctcacaggcgccaccgaaattcagaacagtgggggaacaagcatattcgcaggtcacctgaagtgtcgtttaaaaatggacaagctggagctaaaaggcatgtcttacgccatgtgcactaatacctttgtgctcaagaaagaggtctccgaaacgcagcatgggaccatcctgattaaggtggagtacaagggagaagatgctccctgtaaaatccctttctcaacagaggacggccaaggtaaggcgcacaacgggcgccttataactgcaaacccagttgtgaccaaaaaggaggaacccgtaaatattgaggccgaaccgcctttcggcgagagcaacatcgtcatcggaattggcgataatgctttgaaaatcaactggtataagaaggggagttctattggaaaaatgtttgaagccacagcaagaggtgccaggcggatggctatactgggcgacactgcctgggatttcgggtccgtgggaggcgttctcaatagcctgggtaagatggtgcatcagatctttgggtcggcatacaccgcgcttttctctggcgtctcctgggtgatgaaaattggaatcggcgtactgttgacgtggatcgggctcaactcaaagaatacaagtatgagcttttcctgcattgctataggaatcattaccctgtatttaggcgccgtggttcaggcagacatgggttgtgtcatcaactggaaagggaaggagctgaagtgcggatctggcattttcgtgactaatgaggtgcacacatggaccgaacagtacaaatttcaagccgatagccccaagcgactagctactgccatcgccggtgcttgggagaacggcgtctgtgggatacgctcaaccacaagaatggaaaatctcctgtggaaacagatcgccaacgagcttaattatattttgtgggaaaacaatatcaagctgacggttgtggtgggagacaccattggcgtactcgagcaggggaaaaggactctgacaccacagcctatggagttaaagtacagttggaaaacctggggaaaggcgaagatcgtcacagccgaaactcaaaactccagcttcataattgatggccccaacaccccagagtgcccctctgcttcacgggcatggaatgtgtgggaagttgaggactatggttttggggtgttcacgacaaacatctggctgaaacttcgcgaagtctacacccagttgtgtgaccatagactcatgagtgccgctgtgaaggatgagagggccgttcacgcagacatgggatactggattgagagccagaaaaatggctcctggaagctggaaaaagcgtctctaatcgaggtgaagacttgcacctggcctaagtcgcacacactgtggagcaacggtgtactcgaatccgatatgataatcccaaaatcactggccggcccgattagtcagcataatcaccgtcccgggtatcatactcaaaccgctggaccttggcaccttggcaagttggagctggactttaactactgcgaggggacaacggtcgtgatcaccgaaaattgtggaactcggggcccatctttacgaacaaccactgtgagcggtaaactcattcacgagtggtgctgtagatcctgcacactgccccctcttaggtatatgggggaagatggatgttggtacggcatggagatccgcccaatatcagaaaaggaggagaacatggtcaaaagcctggtttctgccggttccggcaaggtggacaatttcaccatgggggtattgtgcctcgcaattctgtttgaagaggtgatgcggggaaagttcggcaaaaagcatatgatcgctggggtcttctttacgttcgtgctactgctcagtggacagatcacttggagagatatggcccacaccctgattatgatcggcagctctgcatccgacaggatgggtatgggggttacatatcttgccttgattgctacctttaaaatacagcccttcctggcgttaggatttttcctccgcaagctgacttcacgagaaaaccttctgctaggcgtgggcctcgccatggcaacaaccctgcaattgccggaggatatcgaacagatggctaatgggattgccctgggattaatggccctcaaactgatcacacagtttgagacttaccagctttggaccgctctgattagtttgacgtgtagcaacacaatgttcaccctcactgtcgcatggcggaccgccacactgatcctagcgggtgtgtcgctgcttcctgtttgccaatcctctagcatgcgtaagactgactggctcccaatggctgtggccgcaatgggcgtaccccctctgcccttgtttatattctcactgaaggataccttaaaaagaaggagttggccactcaatgagggggtaatggccgtgggactggtttccatccttgcttctagcctgttgcgcaacgacgtgcctatggcaggccccctcgtcgccggtgggctgctaattgcgtgttatgtgatcacgggaacatccgctgatctgaccgtagaaaaggccgcagacattacttgggaggaagaggccgaacagacaggcgtgtcacataatcttatgatcaccgtcgacgatgacggcactatgcggataaaagatgacgagacagagaacattctcaccgttctgttgaagacggctttactgatcgtgagcggggtgtttccatacagtatcccggccactctcctggtctggcacacctggcagaaacagacacaaagatctggagtgctttgggatgttccttcgcccccagaaacccagaaggcagagctggaagagggtgtatacaggattaaacagcagggcatattcgggaagacacaagtgggagtcggcgtgcagaaggagggtgtttttcatactatgtggcacgtgacccgaggggctgtcttgacgtataacggaaaacgcctagaacccaattgggccagcgtgaagaaagacctgatcagctacggcggcgggtggcggctctcagcgcagtggcaaaagggagaggaagtacaggtcattgccgtggagcctggtaaaaacccaaagaatttccagacaatgcccggcactttccagaccacaaccggggaaatcggagcaattgctctggattttaagcctggcacttctggtagtccgatcataaacagagaggggaaagttgtgggactttatggcaatggcgtcgtgaccaagaacgggggatacgtttccggtatcgcccaaacaaatgctgagccagacggccccacgcctgaattagaggaagagatgttcaaaaagaggaacctgactattatggatctccacccagggagcggaaaaacccgtaagtatttgcccgcaatcgtgcgcgaagccattaagcggagactgaggacactcatcctggcccctacccgagtcgtggctgcggagatggaggaagcacttaaaggcctgccgatacggtaccagactacagccaccaagtctgagcatacgggtcgcgaaattgtagacttgatgtgccacgctacttttacaatgagactactgagccccgtgagggttccaaattataacctcatcatcatggatgaggcccatttcaccgaccctgcatccattgccgctcgggggtacatctcaacccgagtcggaatgggcgaagcggccgcaatatttatgactgctacacccccaggcaccgccgatgcattccctcagagtaatgcccccattcaggacgaggagagagacatcccagaacgcagctggaactctgggaatgagtggattacagattttgctggaaaaactgtgtggttcgtgccgtccatcaaggccggtaacgacatagcgaattgtttaaggaaaaacggcaagaaggtcattcaactgtcacgtaaaacgtttgataccgaataccagaagacaaaacttaacgactgggatttcgtagtgactaccgacatcagtgagatgggggcaaattttaaggccgatcgggttatcgaccctagaaggtgcctgaaacccgtgattctcacagatggaccagagcgcgtcatcttggctggccccatgcctgtgaccgccgctagcgcagcccagcgaagaggtcgggttgggaggaacccacagaaggaaaatgaccaatatattttcactggccagcccctgaacaatgatgaggaccacgctcattggacggaagccaagatgctcctggacaacataaatacccctgagggaatcattccggcacttttcgaaccagagcgcgagaaatccgcggccatcgatggcgaataccgtctaaagggggagtctagaaaaacatttgtggaactgatgcggaggggagacttgcccgtctggttagctcacaaggtggcctcggagggtatcaaatatactgatcgcaagtggtgcttcgacggccagcgaaacaatcagattctggaagagaacatggatgtagagatatggaccaaagaaggggagaagaagaaactcagacctcggtggctggacgcaaggacatacagcgatccccttgctctgaaggaatttaaagacttcgccgcaggacgcaagtcaatcgccctcgatttggtgaccgagattggcagagttccatcccacctggctcataggactcggaatgcgctagacaacctggtcatgctccacacaagtgaacatggtgggcgtgcctatcgccacgcagtggaggagcttcctgaaacgatggagaccctgttattgctgggcctcatgatcctgcttactggaggcgctatgctgtttctcatttctgggaaaggaatcggtaagacaagcataggcttgatctgtgtgattgcctcctcagggatgctgtggatggccgaaatccccttacaatggattgcatctgctatcgtcctagagttctttatgatggttctgctcataccagagcctgaaaagcagcgaaccccgcaggataatcaacttgcctacgtggtaattggaatcctgaccttggcggctattatcgccgcaaacgagatgggcctgctcgaaacaactaaaagagacctgggtatgagcaaggagcccggggtggtcagtccaacgtcctatcttgatgtggacctccaccctgccagcgcttggaccctgtacgcagttgccacaactgtgataacccccatgttgaggcatacaatcgaaaattctaccgcgaacgtctcactggctgccattgcaaatcaggccgtagtgttaatgggcctagacaaaggatggccaatctccaagatggatctgggcgttcctctccttgctctggggtgctacagtcaggtgaaccccttgactctgacggccgcagtcctcctgcttattacacactatgctatcataggaccgggcttacaggccaaagcgacccgggaggcccaaaagcgcactgcagctggtattatgaagaacccaaccgtggacgggatcatgacaatcgatctggaccctgtcatttacgatagcaaattcgagaagcagctcggacaggtgatgttgctggttctatgtgccgtgcagctgctccttatgagaacttcgtgggcactgtgcgaggctttgaccctggccacaggccccatcacgaccctctgggagggttctccaggcaaattttggaatactacaatagccgtatccatggcgaacattttcagggggagctatctggctggagcaggcttagccttttcaatcatgaagagtgtggggaccggaaaacggggcactggttctcaaggggaaacacttggagagaagtggaagaaaaagctgaatcagctctcccgaaaagagttcgacctatacaagaaaagcggcattaccgaggtcgatagaacggaggctaaggaaggtctgaaacgcggcgagatcacccatcacgccgtttcaagggggagtgcaaagttgcagtggtttgtggaacggaacatggtcatacccgagggacgtgtgatcgacctgggctgtgggagaggaggctggagctattactgcgccggtctcaagaaagtaacagaagtgagggggtatactaagggaggccctggccatgaggagccggttcccatgtccacctacgggtggaatattgtgaaacttatgtctggaaaggatgtcttctacctgccacctgaaaaatgtgacacattgctgtgcgatatcggtgagagctccccctcacctactgtggaagagtctcgcaccattcgggtcctcaagatggtggagccatggttaaagaacaatcagttctgtatcaaagttctgaacccctatatgcctacagtaattgaacaccttgagcgactgcaaagaaagcacggcgggatgctagtgaggaatccactcagtcgcaactcgacccatgaaatgtactggatcagcaatggaactggcaacatagtcgcttccgtgaatatggtttctcggctgttgctgaacagatttacgatgacacaccgtaggcccaccattgagaaagacgtggatctcggtgcggggactcggcatgtcaatgccgaaccggagacccctaacatggacgtgatcggagagcgcatcaagcgaattaaagaagaacacaactcaacatggcactatgacgatgaaaatccatacaagacgtgggcatatcatggcagctacgaggtaaaggctaccggctccgccagttctatgataaacggggtggttaaacttctgactaagccctgggacgtcgtgcctatggtgacacagatggcaatgaccgatactacaccattcggacagcaaagagtctttaaagaaaaggttgacaccaggacaccccggagcatgccgggtactcgcagagtgatgggcatcaccgccgagtggttatggaggacgctggggcgaaataaaaagcctcggttgtgcacccgtgaggagttcacaaagaaagtaagaactaacgctgccatgggagcggtgtttaccgaggaaaatcagtgggattcagcaaaggccgctgtcgaggacgaagatttctggaaactcgtggaccgcgagagggagctgcacaagctaggcaaatgtggttcctgcgtttataacatgatggggaagcgggagaagaaacttggagagtttggcaaggccaaaggcagtagagcaatttggtacatgtggctgggggctcgctacctcgagttcgaggccctgggatttttgaatgaggatcattggttcagcagggaaaactcttattccggtgtggagggcgaagggctgcacaagctcggatacatccttcgagacatttcaaaaatccccggcggtgctatgtatgccgatgacacagcagggtgggacactcggataaccgaggatgacctgcataatgaagagaagatcacgcagcagatggatccagagcacagacaattagcgaacgccatttttaaactgacataccagaataaggtcgtgaaggtacagaggcctacccccactggaacagttatggacatcattagccgcaaagatcagcgtggctcgggccaagtggggacctatggattgaacactttcaccaatatggaagctcagctcatccggcagatggagggtgaaggcgtcctgtctaaggccgacctagagaacccacaccttcccgagaaaaagataacacagtggctggagacgaaaggggtggagagactcaagaggatggcaattagtggagatgactgcgtggtcaagcctatcgatgaccgctttgctaatgccctgttggcattaaacgatatgggcaaagttcgaaaggacatcccacaatggcagccgtccaaaggttggcatgattggcaacaggtgcccttctgtagccaccatttccacgaactgattatgaaggacgggcggaaactcgtagtgccttgcagaccacaagacgagcttataggaagggcccgcatctcacagggcgcgggctggtccctgagagaaaccgcttgtctagggaaggcctacgcacagatgtggtctctgatgtattttcaccggagggatctccgtttggccagcaacgctatttgcagtgccgtccccgtgcattgggttcctacttcccgaacaacctggagcatccacgcacatcaccaatggatgactacagaggacatgctgaccgtgtggaatcgcgtctggattgaagataacccatggatggaggacaagacgcccgtgacaacctgggagaatgtaccttaccttggaaaaagagaagatcagtggtgtggttctctgatcggcctcacttcacgggctacctgggcccagaacataccgacagcgatccagcaagttaggagtttaattgggaatgaggagttcctggactacatgccatccatgaagcgctttagaaaagaggaggaaagcgagggagctatctggtga

SEQ ID NO: 15468 - RNA, 9873 nt, synthetic construct
  misc_feature 1..9873: note = derived and/or modified CDS sequence (opt3) from DENV-3__FJ547084__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagcgcgggagcagtattggaaagatgtttgaagctacagccagaggtgcaaggcggatggccatactgggcgacactgcttgggatttcgggtctgttggaggcgtgctcaactccctgggtaaaatggtccaccagatctttgggagcgcctacaccgcacttttctcgggcgtgtcttgggtaatgaagattggaatcggcgtgctgttgacgtggatcgggctcaattccaaaaacacatcaatgagttttagctgcattgcgataggaatcattaccctgtatttaggcgctgttgtccaggccgacatgggttgtgtgatcaattggaaggggaaagagctgaagtgcggatccggcattttcgtgactaacgaggtccatacatggaccgaacagtacaagtttcaagcagattctcccaaacgactagccactgctatcgccggtgcatgggagaatggcgtttgtgggatacgcagcaccacaagaatggaaaacctcctgtggaagcagatcgctaatgagcttaactatattttgtgggaaaataacatcaaactgacggtggtggtaggagacaccattggcgtcctcgagcaggggaagaggactctgacaccacagcctatggagttaaaatactcatggaagacctggggaaaagccaagatcgtgacagcggaaactcaaaacagttccttcataattgatggccccaataccccagagtgccccagcgcctctcgggcttggaacgtttgggaagtggaggactatggttttggggtcttcacgacaaatatctggctgaagcttcgcgaagtgtacacccagttgtgtgaccacagactcatgtcagcagccgttaaagatgagagggctgtgcacgccgacatgggatactggattgagagtcagaagaacggcagctggaaactggaaaaggcatccctaatcgaggtaaaaacttgcacctggcctaagtctcatacactgtggtcgaatggtgtcctcgaaagcgatatgataatcccaaagtccctggcgggcccgatttcacagcacaactatcgtcccgggtaccatactcaaaccgccggaccttggcaccttggcaaattggagctggactttaattattgcgaggggacaacggtggtgatcaccgaaaactgtggaactcggggcccaagtttacgaacaaccactgtctctggtaagctcattcacgagtggtgctgtagaagctgcacactgccccctcttaggtacatgggggaagatggatgttggtatggcatggagatccgcccaatatccgaaaaagaggagaatatggttaagtcactggtgagcgctggttctggcaaagtagacaacttcaccatgggggtgttgtgcctcgccattctgtttgaagaggtcatgcggggaaagttcggcaagaaacatatgatcgtgggggttttctttacgttcgtgctactgctctccggacagatcacttggagagatatggcacacaccctgattatgatcggcagtaatgctagcgacaggatgggtatgggggtcacataccttgccttgattgcaacctttaagatacagcccttcctggccttaggatttttcctccgcaaactgacttctcgagaaaaccttctgctaggcgtgggcctcgctatggcgacaaccctgcaattgccggaggatatcgaacagatggccaatgggattgcactgggattaatggctctcaagctgacaactcagtttgagacctatcagctttggacggccctgatctccttgacatgttcaaacaccattttcactctcaccgttgcctggcggacagctactctgatcctagcaggtgtgagtctgcttcctgtctgccaaagctcgtccatgcgtaaaaccgactggctcccaatgacggtagccgcgatgggcgtgccccctctgcccttgtttatattctctctgaaggatacattaaagagaaggagctggccactcaatgagggggttatggctgtgggactggtctcaatccttgccagttccctgttgcgcaacgacgtgcctatggcaggccccctcgtagccggtgggctgctaattgcttgttacgtgatcaccggaacttctgcagatctgacagtcgaaaaagccgcggacgttacctgggaggaagaggctgaacagactggcgtgagccataaccttatgattacagtggacgatgacggcaccatgcggatcaaggatgacgagacggagaatatactcactgtcctgttgaaaaccgccttactgattgtgtccgggatctttccatactcaatcccggcaacactcctggtttggcacacctggcagaagcagacacaaagaagcggagtactttgggatgtgcctagtcccccagaaactcagaaagccgagctggaagagggtgtctataggattaagcagcagggcatattcgggaaaacccaagtgggagttggcgtgcagaaggagggtgtctttcatacgatgtggcacgtgacacgaggggctgtattgacttacaacggaaagcgcctagaacccaattgggcctctgtcaaaaaggacctgatctcctatggcggcgggtggcggctcagcgcacagtggcaaaaaggagaggaagtgcaggttattgctgtggagcctggtaagaacccaaaaaatttccagaccatgcccggcacattccagaccactaccggggaaatcggagccattgcgctggattttaagcctggcacatcgggttcaccgatcataaacagagaggggaaggtcgtgggactttacggcaatggcgttgtgacgaaaaacgggggatatgtctctggtatcgcccaaactaatgcagagccagacggccccacccctgaattagaggaagagatgttcaagaaaaggaacctgacaattatggatctccacccagggagtggaaagacccgtaaatacttgcccgctatcgtgcgcgaagccattaagcggagactgaggactctcatcctggctcctacacgagtagtggcagccgagatggaggaagcccttaagggcctgccgatacggtatcagaccacggctactaaatccgagcatacaggtcgcgaaattgttgacttgatgtgccacgcgacctttaccatgagactactgagccccgtcagggtgccaaattacaacctcatcatcatggatgaggcacatttcactgaccctgcctctattgctgcccgggggtacatcagcacacgagtgggaatgggcgaagcagccgctatatttatgaccgcgacacccccaggcactgccgatgcattccctcagtccaatgctcccattcaggacgaggagagagacatcccagaacgctcatggaacagtgggaatgagtggattacggattttgccggaaagaccgtctggttcgtaccgagcatcaaagcaggtaacgacatagccaactgtttaaggaagaatggcaaaaaggtgattcaactgtctcgtaagacatttgatactgaatatcagaaaaccaagcttaacgactgggatttcgttgtgacaaccgacatctccgagatgggggctaattttaaagccgatcgggtcatcgaccctagaaggtgcctgaagcccgtgattctcactgatggaccagagcgcgttatcttggcgggccccatgcctgtgacggcagcctcagctgcccagcgaagaggtcgggtcgggaggaacccacagaaagaaaatgaccaatacattttcaccggccagcccctgaacaatgatgaggaccacgctcattggacagaagcaaagatgctcctggacaacataaatactcctgagggaatcattccggcccttttcgaaccagagcgcgagaagagtgctgccatcgatggcgaatatcgtctaaaaggggagagcagaaagacctttgtggaactgatgcggaggggagacttgcccgtatggttagcacacaaagtggcgtccgagggtatcaagtacacagatcgcaaatggtgcttcgacggccagcgaaacaatcagattctggaagagaacatggatgttgagatatggaccaaggaaggggagaaaaagaagctcagacctcggtggctggacgccaggacttattctgatccccttgctctgaaagaatttaaggacttcgccgcaggacgcaaatcgatcgctctcgatttggtcacagagattggcagagtgccaagccacctggcccataggacgcggaatgcactagacaacctggtgatgctccacacctcagaacatggtgggaaggcctaccgtcacgctgtcgaggagcttcctgaaactatggagacactgttattgctgggcctcatgatcctgcttaccggaggcgcgatgctgtttctcatttccgggaaaggaatcggtaagaccagtataggcttgatctgtgttattgcctctagcgggatgctgtggatggcagaaatccccttacaatggattgcttccgccatcgtgctagagttctttatgatggtactgctcataccagagcctgaaaagcagcgcacaccgcaggataatcaacttgcctatgtggtcattggaatcctgactttggcagctattatcgccgcgaacgagatgggcctgctcgaaacgaccaaacgagacctgggtatgtcaaaggagcccggggtggtttctccaacaagctaccttgatgtggacctccaccctgctagtgcctggactctgtacgcagtcgccaccacagtaataacccccatgttgagacatactatcgaaaattccacggctaacgtgagcctggcagccattgcgaaccaggctgttgtgttaatgggcctagacaaaggatggccaatctctaagatggatctgggcgtccctctccttgccctggggtgctattcacaggtgaatcccttgacactgaccgcagccgtcctcctgcttattactcactacgctatcataggaccgggcttacaggccaaagcaaccagggaggctcaaaagcggacagccgcgggtattatgaagaacccaactgtggacgggatcatgaccatcgatctggaccctgttatttatgattccaaattcgagaagcagctcggacaggtgatgttgctggtactatgtgccgtgcagctgctccttatgcgcacaagttgggcactgtgcgaagctttgacgctggccaccggccccatcactacactctgggagggtagcccaggcaaattttggaataccactatagcagtctcgatggctaacattttcagagggtcttacctggccggagccggcttagcgttttccatcatgaagagcgttgggacaggaaaaaggggcaccggttcacaaggggaaacgcttggagagaagtggaagaaaaagctgaatcagctcagtcggaaagaattcgacctatataagaaatctggcattaccgaggtggatcgaacagaggctaaggaaggtctgaaaagaggcgagatcactcatcacgcagtctcccgcgggagcgccaagttgcagtggtttgtggaaaggaacatggtaatacccgagggacgggtgatcgacctgggctgtgggcgtggaggctggtcatactattgcgctggtctcaagaaagttaccgaagtgagagggtacacaaagggaggccctggccatgaggagccggtccccatgagtacttacgggtggaatattgtgaaacttatgagcggaaaggatgtcttctatctgccacctgaaaaatgtgacaccttgctgtgcgatatcggtgagtcctctcccagccctacagtggaagagtccaggaccattcgcgttctcaagatggtagagccatggttaaagaacaatcagttctgtatcaaagtgctgaacccctacatgcctactgtcattgaacaccttgagcggctgcaacgaaagcacggcgggatgctagtgagaaatccactctcaaggaactctacgcatgaaatgtattggatcagtaatggaacaggcaacatagttgcctcggtgaatatggtcagccgcctgttgctgaaccggtttaccatgactcacagacgtcccaccattgagaaagacgtggatctcggtgcagggacaaggcatgtaaacgccgaaccggagacgcctaatatggacgtgatcggagagcggatcaagcgcattaaagaagagcacaactccacctggcactacgacgatgaaaatccatataagacttgggcttaccatggctcttatgaggttaaggcgacaggctcagccagctccatgataaacggggtcgtgaaacttctgaccaagccctgggacgtggtccctatggttactcagatggcaatgacagataccacaccattcggacagcaacgagtgtttaaagaaaaggtagacactagaacccccaggagtatgccgggtacgcggcgcgtgatgggcatcaccgctgagtggttatggagaacactggggaggaataaaaagcctcgattgtgcactcgggaggaattcaccaagaaagtccgtacaaacgccgcaatgggagccgtgtttactgaggaaaatcagtgggattctgctaaggccgcggttgaggacgaagatttctggaaactcgtggacagagagcgcgagctgcacaagctaggcaaatgtggtagctgcgtctacaacatgatggggaagagggaaaaaaagcttggagagtttggcaaggcaaaaggctcacgggccatttggtacatgtggctgggggctagatatctcgaattcgaggccctgggatttttgaatgaggatcattggttctcccgcgaaaacagttacagcggtgtggagggcgaagggctgcacaagctcggatatatccttagggacatttctaaaatccccggcggtgcaatgtacgctgatgacaccgccgggtgggacacgcgaataacagaggatgacctgcataatgaagagaagatcacccagcagatggatccagagcaccggcaattagctaacgccatttttaaactgacttatcagaataaggtagttaaggtgcagagacctacacccaccggaactgtcatggacatcatttccaggaaagatcagcgcggctcaggccaagtggggacctacggattgaacacattcacgaatatggaagcacagctcatccgtcagatggagggtgaaggcgtgctgagcaaggcggacctagagaacccacaccttcccgaaaaaaagataacccagtggctggagactaaaggggtcgagcggctcaagagaatggccatttcgggagatgactgcgttgtgaagcctatcgatgacaggtttgctaacgccctgttggcattaaatgatatgggcaaagtacgcaaggacatcccacaatggcagccgtctaaaggttggcatgattggcagcaggtgcccttctgtagtcaccatttccacgaactgattatgaaggacgggcgaaaactcgtcgtgccttgccggccacaagacgagcttataggaagagctaggatctcccagggcgccggctggagcctgcgcgaaacagcatgtctagggaaggcctatgcgcagatgtggtcactgatgtactttcacagacgggatctcaggttggcttccaacgccatttgctctgcagttcccgtgcattgggtccctaccagccgtactacatggagtatccacgcccatcaccaatggatgaccacggaggacatgctgacagtgtggaatcgagtatggattgaagataacccatggatggaggacaagacccccgttactacctgggagaatgtgccttaccttggaaaacgcgaagatcagtggtgtggttccctgatcggcctcacaagcagagctacttgggcccagaacataccgaccgcaatccagcaagtccggtctttaattgggaatgaggaattcctggactatatgccatcaatgaagaggtttcgcaaagaggaggaaagtgagggagctatctggtga

SEQ ID NO: 15469 - RNA, 9873 nt, synthetic construct
  misc_feature 1..9873: note = derived and/or modified CDS sequence (opt3) from DENV-3__FJ478456__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattgctgaagttgagccggaagacatcgattgctggtgtaacctgactagtacctgggtgacatatgggacctgcaatcaggccggagagcaccgccgagacaagcgtagcgtagcacttgccccccatgtgggcatgggtctggatactagaacacaaacctggatgtccgctgagggggcatggaggcaggtcgaaaaagtggagacgtgggccttgcggcaccctggattcactattctcgctctgtttctggcccattacatcggcacctctctcacacagaaggttgtgatattcatcttactgatgcttgtcactccatcgatgaccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccgtcttgccagaggaacaggaccagaattatgtttgtaaacacacatacgtggatcgcggttgggggaacggatgcggcctcttcggcaaggggagtctggtaacttgcgcaaagtttcaatgtttagagcccatagagggaaaagtggtccagtatgaaaatctgaagtacaccgtgattatcacagttcatactggtgaccagcaccaggtgggcaacgagacccaaggggtcacagctgaaattacccctcaggcctccactacggaggcgatcctcccagaatatggaacacttggcctggagtgctctccgcgaaccggtttggacttcaatgagatgatcctactgactatgaaaaacaaggcctggatggtgcatagacagtggtttttcgatctccccctgccttggaccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacaccggttgtgtgatcaattggaaagggaaggagctgaagtgcggatccggcattttcgtgactaacgaggtccatacatggaccgaacagtacaaatttcaagccgattctcccaagcggctagctactgccatcgcaggtgcttgggagaatggcgtttgtgggatacgaagcaccacacgcatggaaaacctcctgtggaaacagatcgccaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggcgaagatagtgaccgccgaaacacaaaacagttccttcattatcgatggccccaatactccagagtgccccagcgcttctagggcatggaacgtttgggaagtggaggactatggttttggggtcttcaccacgaatatttggctgaaacttcgggaagtgtacacacagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacctgcacttggcctaagtctcataccctgtggtcgaatggtgtcctcgaaagcgatatgatcattccaaaatccctggccggcccgatctcacagcacaactataggcccgggtaccatacacaaactgctggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgccggttctggcaaggtagacaacttcacaatgggggtgttgtgcctcgcaatcctgtttgaagaggtcatgcgcggaaagttcggcaaaaagcatatgatcgctggggtgttctttaccttcgttctactgctctccggacagattacgtggcgggatatggcccacactctgatcatgattggcagtaatgcaagcgacagaatgggtatgggggtgacctaccttgccttgatagctacatttaaaatccagcccttcctggcgttaggatttttcctcaggaagctgacctctcgcgaaaaccttctgctaggcgtcggcctcgccatggcaactacactgcaattgccggaggatattgaacagatggctaatgggatcgccctgggattaatggccctcaaactgattacccagtttgagacatatcagctttggactgctctgatctccttgacctgttcaaacacgatattcacactcaccgtggcatggcgaactgccaccctgatcctagcgggtgttagtattctgcctgtgtgccaaagctcgtccatgcggaagtctgactggcttccaatgacagtcgctgccatgggcgtaccccctctccccctgtttatcttcagcttgaaggatactctgaaacgtagatcatggccattaaatgagggggtgatggcagttggactcgtgagtattctggcctcctctcttctgaggaacgacgtccctatggctggccccttggtggcaggtgggctcctgatcgcctgttacgtaataaccggaacgagcgcggatctaacagtggaaaaggctgccgacgtcacctgggaggaagaggcagaacagactggcgtttcccataacctgatgattacagtggacgatgacggcaccatgcgcatcaaagatgacgagactgagaatatccttacagtgctcctgaagaccgccttgttaattgtctcagggatatttccatacagcatcccggctacgctgctcgtgtggcacacttggcagaaacagacccggagaagtggagttctgtgggatgtaccttctcccccagaaacacaaaaggccgagcttgaagagggtgtgtataggattaaacagcagggcatcttcgggaagacccaggtcggagtgggcgttcaaaaggagggtgtgtttcatacaatgtggcacgtcactcgaggggcagtgctgacctacaacggaaaacgcttggaacccaattgggcttccgtaaagaaagacctaattagctatggcggcgggtggcggctgtcggcccagtggcagaagggagaggaagtccaagtgatcgcggttgagcctggtaaaaacccaaagaatttccagacgatgcccggcacattccagactaccacaggggaaataggagccatcgcactcgattttaagcctggcacctcaggttctccgattatcaacagagaggggaaagtggtcggactgtacggcaatggcgtggttactaagaacgggggatatgtgagtggtattgctcagaccaatgccgagccagacggccccacacctgaacttgaggaagagatgttcaaaaagaggaacttaacgatcatggatctgcacccagggtccggaaaaactcgtaagtacctccccgctatagtccgcgaagcaattaagcggagattgaggaccctgatcctcgcccctacacgagtggtagccgctgagatggaggaagcgctgaaaggccttccgatccggtatcaaaccactgcaacaaagagcgagcataccggtcgcgaaattgtggacctgatgtgccacgccacgtttactatgagattgctatctcccgttagggtcccaaattacaacctgatcataatggatgaggctcatttcacagaccctgccagcattgcagcccgggggtacatctccacccgagtgggaatgggcgaagctgcggccatttttatgaccgcaactcccccaggcacagctgatgccttccctcagtcaaatgcacccatccaggacgaggagagagacataccagaacgcagttggaacagcgggaatgagtggattaccgattttgccggaaaaacagtgtggttcgtcccgtctatcaaggctggtaacgacatcgccaactgtctcaggaaaaatggcaagaaggtaattcagttatcccgtaaaacttttgatacggaatatcaaaagaccaaactgaacgactgggatttcgtggttacaactgacatctcagagatgggggcgaattttaaggcagatcgggtgattgaccctagaaggtgccttaaacccgtcatactgaccgatggaccagagcgcgtgatcctcgccggccccatgcctgttacagctgccagtgctgcacagcgaagaggtcgggtggggaggaacccacagaaggaaaatgaccagtacattttcaccggccaacccttgaacaatgatgaggaccacgcccattggactgaagctaagatgctgctcgacaacatcaatacgcctgagggaatcattccggccctgttcgaaccagagcgcgagaaaagcgcagcgatagatggcgaatatcgtcttaagggggagtccagaaaaacctttgtcgaactaatgcggaggggagacctgcccgtgtggttggcccacaaggtagcttctgagggtatcaaatacacagatcgcaagtggtgcttcgacggccagcgaaacaatcagattttagaagagaacatggatgtggagatctggactaaagaaggggagaagaagaaactgagacctcggtggctcgacgccaggacctattcggatcccctggcacttaaggaatttaaagacttcgctgccggacgcaagagcattgcactggatctcgttacagagatcggcagagtcccatcacacttggcccataggacccggaatgctctggacaacctagtgatgctgcacacttccgaacatggtgggaaagcgtaccgtcacgccgtggaggagctccctgaaacaatggagacgcttctgttattgggcctgatgatactcctgaccggaggcgcaatgctttttctgatcagtgggaagggaattggtaagacttctatcggcctcatttgtgtcatcgctagctccgggatgttgtggatggccgaaatacccctgcagtggattgcctcagcaatcgttttagagttctttatgatggtgctactgattccagagcctgaaaaacaacgcacaccgcaggataatcagctcgcttatgtagtgatcggaatacttaccctggccgcgatcattgctgccaacgagatgggcttgctggaaaccacaaagcgagacctcggtatgtctaaagagcccggggtcgtgagcccaactagttacctggatgttgaccttcaccctgcatccgcctggacgctctacgctgtggcaaccacagtcatcactcccatgctgagacataccattgaaaatagcacagccaacgtatctttggcggctatcgccaaccaagcagtggttctgatgggcttagacaagggatggccaatatcaaaaatggatctaggcgtgcctctgctcgcccttgggtgctattcccaggtcaatcccctgaccttgactgctgccgtgctgctcctgattacgcactacgcaatcatcggaccgggccttcaggctaaggccacaagggaggcgcagaagcggaccgccgcaggtattatgaaaaacccaactgtcgacgggatcatgaccatagatttagaccctgtgatttatgatagtaagttcgagaaacaactgggacaggttatgctcttggtgctgtgtgctgtacagctactgctcatgcgcacaagctgggccctttgcgaagcactgactttggctaccggccccatcacaacgctgtgggagggttcgccaggcaagttttggaataccactattgccgtgtctatggccaacatcttcagagggtcctacctcgcgggagctggcctggcatttagcataatgaaatcagtcgggacaggaaagaggggcaccggtagtcagggggaaactttaggagagaagtggaaaaagaaacttaatcaactgtctcggaaggaattcgacctctataaaaagtccggcatcacagaggttgatcgaaccgaggccaaagaaggtctaaagagaggcgagattacgcatcacgctgtgagccgcgggtcagccaagctgcagtggtttgtcgaaaggaacatggtgatccccgagggacgggtaattgacttgggctgtgggcgtggaggctggagttactattgcgcaggtctgaaaaaggtgaccgaagttagagggtacacaaaaggaggccctggccatgaggagccggtgcccatgagcacttacgggtggaatatcgtcaagctcatgtccggaaaagatgtgttctatcttccacctgaaaagtgtgacaccctgttgtgcgatattggtgagtctagcccctcccctacagtcgaagagtcaaggactatccgcgtgctgaagatggttgagccatggctcaaaaacaatcagttctgtataaaggtattaaacccctacatgcctaccgtgattgaacacctggagcggcttcagcgaaaacacggcgggatgctggtcagaaatccactatctaggaacagtacacatgaaatgtattggatctcgaatggaaccggcaacatcgtggccagcgttaatatggtgtcccgcctcctgttgaaccggtttactatgacgcacagacgtcccacaattgagaaggacgtcgatctgggtgctgggaccaggcatgtgaacgcggaaccggagactcctaatatggacgtaataggagagcggatcaaacgcattaaggaagagcacaactctacctggcactacgacgatgaaaatccatataagacatgggcctaccatggctcatatgaggtgaaagcaacgggcagcgcttccagtatgatcaacggggttgtcaagctccttaccaaaccctgggacgtggtgcctatggtcactcaaatggccatgacagataccactccattcggacagcagcgagtttttaaggaaaaagtggacacaagaacccccaggtctatgccgggtacacggcgcgtaatgggcattactgcagagtggctgtggagaaccttagggaggaataagaagcctcgactgtgcacgcgggaggaattcaccaaaaaggtgcgtacaaacgccgctatgggagccgtctttactgaggaaaatcaatgggatagcgcgaaagcagccgtggaggacgaagatttctggaagttggttgacagagagcgcgagctccacaaactgggcaagtgtggttcatgcgtgtacaacatgatggggaaaagggaaaagaagctaggagagtttggcaaagctaagggctcccgggccatctggtacatgtggcttggggcaagatatctggaattcgaggctctcggatttctgaatgaggatcattggttcagtcgcgaaaacagctactctggtgtcgagggcgaagggttgcacaaactgggatatatactcagggacatctccaagattcccggcggtgccatgtacgctgatgacaccgccgggtgggacacacgaatcactgaggatgaccttcataatgaagagaaaattacccagcagatggatccagagcaccggcagctggcaaacgcgatctttaagttaacgtatcaaaataaggtggtaaaagttcagagacctacacccaccggaactgtgatggacataatttcaaggaaggatcagcgcggcagcggccaggtcgggacatacggactgaacaccttcactaatatggaagcccaattgatccgtcagatggagggtgaaggcgtgctctcgaaagctgacctggagaacccacacctatctgaaaagaaaatcacccagtggcttgagacaaagggggtggagcggctgaagagaatggccattagtggagatgactgcgtcgttaaacccatagatgacaggtttgcaaacgctctcctggccttgaatgatatgggcaaggtgcgcaaagacatccctcagtggcaaccatccaagggttggcatgattggcagcaggtaccgttctgtagccaccatttccacgaattaattatgaaagacgggcgaaagctggtggtcccctgccggcctcaggacgagctcatcggaagagcaaggatttcacaaggcgccggctggtcccttcgcgaaacggcgtgtctggggaaggcttatgcccagatgtggtctctaatgtactttcacagacgggatctgaggctcgcaagcaacgccatctgcagtgctgtgccagttcattgggtgcccacctcccgtactacatggagcatacacgcccatcaccagtggatgaccactgaggacatgttgacagtctggaatcgagtgtggatcgaagataacccttggatggaggacaaaaccccagtaacgacatgggagaatgttccctacctgggaaagcgcgaagatcaatggtgtggttctcttattggcctgacctcaagagcaacttgggctcagaacatccctaccgccattcagcaggtgcggagtctcatcgggaatgaggaattcttagactatatgccgtccatgaaaaggtttcgcaaggaggaggaaagcgagggagcgatttggtga

SEQ ID NO: 15470 - RNA, 9873 nt, synthetic construct
  misc_feature 1..9873: note = derived and/or modified CDS sequence (opt3) from DENV-3__FJ547085__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacactggttgtgtgatcaattggaaagggaaggagctgaagtgcggatccggcattttcgtgacaaacgaggtccatacctggactgaacagtacaaatttcaagcagattctcccaagcggctagccaccgctatcgccggtgcatgggagaatggcgtttgtgggatacgaagcacaacgcgcatggaaaacctcctgtggaaacagatcgctaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggccaggatagtgacagcggaaactcaaaacagttccttcattatcgatggccccaataccccagagtgccccaacacgagccgggcctggaatgtttgggaagtggaggactatggttttggggtcttcacaaccaacatttggctgaagcttcgcgaagtgtacactcagttgtgtgaccacagactcatgtctgctgcagttaaagatgagagggccgtgcacgctgacatgggatactggatcgagtcacagaagaatggcagttggaaactggaaaaggccagcctaatagaggtaaaaacctgcacatggcctaagtcccatactctgtggtctaacggtgtcctcgaatcggatatgatcattccaaagagcctggcaggcccgatctcccagcacaattatcgtcccgggtaccatacccaaacagcgggaccttggcaccttggcaaattggagctggactttaactattgcgaggggacgaccgtggtgattactgaaaattgtggaacacggggcccatcattacgaaccactacagtcagtggtaagctcatccacgagtggtgctgtagatcttgcaccctgccccctcttaggtacatgggggaagatggatgttggtatggcatggagatacgcccaattagcgaaaaagaggagaacatggttaagtccctggtgtcagccggtagcggcgaagtagacaatttcacgatgggggtgttgtgcctcgctatcctgtttgaggaagtcatgcggggaaaattcggcaagaagcatatgatcgccggggtgttctttactttcgttctactgctctctggacagattacctggagagatatggcacacacactgatcatgattggctccaacgctaccgacaggatgggtatgggggtgacttaccttgccttgatagcaacatttaaaatccagcccttcctggccttaggatttttcctccgcaagctgaccagtcgagagaatcttctgctaggcgtcggcctcgctatggcgacaactctgcaattgccggaagatattgagcagatggccaacgggatcgcactgggattaatggctctcaaactgattacccagtttgagacgtatcagctttggacagccctgatcagcttgacctgttctaatactatattcaccctcacagtggcctggcggactgctaccctgatcctagcaggtgtttccctgcttcctgtgtgccaatcaagtagcatgcgtaagacggactggctcccaatgacagtcgccgcgatgggcgtaccccctctgcccttgtttattttctcgctgaaagataccttaaagagaaggtcctggccactcaacgaaggggtgatggctgttggactggtgtctatccttgccagctcactgttgcgcaacgacgtccctatggcaggccccctcgtggccggtgggctgctaattgcttgttacgtaatcactggaacaagtgcagatctgaccgtggagaaggccgcggacgtcacttgggaagaggaagctgagcagacaggcgtttcccataatcttatgataaccgtggacgatgacggcacgatgcggattaaagatgacgagactgaaaacatcctcaccgtgctgttgaagacagccttactgatcgtctctgggatttttccatacagcataccggcaaccctcctggtgtggcacacatggcagaaacagactcaaagatccggagttctttgggatgtaccttcacccccagagacccagaaggccgaactggaggagggtgtgtataggatcaaacagcagggcattttcgggaagacgcaagtcggagtgggcgttcagaaagaaggtgtgtttcatacaatgtggcacgtcactcgaggggctgtgttgacctacaatggaaagcgcctagagcccaactgggccagcgtaaagaaagacctgatcagttatggcggcgggtggcggctctctgcacagtggcaaaagggagaagaggtccaggtgattgctgttgaacctggtaaaaatccaaagaacttccagacaatgcccggcaccttccagactaccacaggggagatcggagccatagcgctggattttaaacctggcacgtccggtagcccgatcattaatagagaggggaaggtggtcggactttacggcaacggcgtggttactaagaatgggggatatgtgtcgggtatcgcccaaaccaacgcagaaccagacggccccacacctgagttagaagaggaaatgttcaaaaagaggaatctgaccattatggatctccacccagggtcaggaaaaactcgtaagtacttgcccgctatcgtccgcgaggccataaaacggagactgaggacactcattctggctcctacccgagtggtagcagccgagatggaagaggcccttaagggcctgccgatccggtatcagacgactgctacaaagtctgaacataccggtcgcgagatcgtggacttgatgtgccacgcgacctttactatgagactactgagtcccgttagggtcccaaactacaatctcattatcatggatgaagcacatttcacagaccctgcctccatagctgcccgggggtacattagcacccgagtgggaatgggcgaggcagccgctatctttatgacagcgactcccccaggcacggccgatgcattccctcagtctaacgctcccattcaggacgaggaaagagacatcccagagcgcagctggaattccgggaacgaatggataaccgattttgccggaaaaacagtgtggttcgtcccgtcaattaaggcaggtaacgacatcgccaattgtttaaggaaaaacggcaagaaagtaatccaactgagtcgtaagacttttgataccgagtatcagaagacaaaacttaatgactgggatttcgtggttaccactgacattagcgagatgggggctaactttaaggccgatcgggtgatcgaccctagaaggtgcctgaaacccgtcattctcacggatggaccagaacgcgtgatattggcgggccccatgcctgttaccgcagcctctgctgcccagcgaagaggtcgggtggggaggaatccacagaaggagaacgaccaatacatcttcacaggccagcccctgaataacgatgaagaccacgctcattggactgaggcaaaaatgctcctggacaatattaacacccctgaaggaatcatcccggcccttttcgagccagagcgcgaaaagtccgctgccattgatggcgagtatcgtctaaagggggaatcaagaaaaacatttgtcgagctgatgcggaggggagacttgcccgtgtggttagcacacaaggtagcgagtgaaggtataaaatacaccgatcgcaagtggtgcttcgacggccagcgaaataaccagatcctggaggagaatatggatgtggaaatttggactaaagagggggaaaagaaaaagctcagacctcggtggctggacgccaggacatatagcgatccccttgctctgaaggagtttaaagacttcgccgcaggacgcaagtccatcgctctcgatttggttacggaaattggcagagtcccaacccacctggcccataggactcggaacgcactagacaatctggtgatgctccacacatctgagcatggtgggaaagcctaccgtcacgctgtggaggaacttcctgagaccatggaaaccctgttattgctgggcctcatgatcctgcttacaggaggcgcgatgctgtttctcatatcggggaagggaatcggtaaaactagcattggcttgatctgtgtcattgcctcatccgggatgctgtggatggcagagatccccttacaatggatagctagtgccattgttctagagttctttatgatggtgctgctcatcccagaacctgagaagcagcgcacgccgcaggataaccaacttgcctatgtagtgattggaatcctgaccttggcagctataatcgccgcgaatgaaatgggcctgctcgagacaactaagcgagacctgggtatgtctaaagaacccggggtcgtgagcccaacctcctaccttgatgttgacctccaccctgcttcagcctggacactgtacgcagtggccaccactgtcattacgcccatgttgagacatacaatcgagaactctaccgctaacgtaagcctggcagccattgcgaatcaggctgtggttttaatgggcctagacaagggatggccaatcagtaaaatggatctgggcgtgcctctccttgccctggggtgctattcccaggtcaaccccttgactctgaccgcagccgtgctcctgcttataacacactacgctattatcggaccgggcttacaggccaaggcaactagggaggctcaaaaacggaccgccgcgggtatcatgaagaatccaacagtcgacgggattatgacgatcgatctggaccctgtgatatatgatagcaagttcgaaaaacagctcggacaggttatgttgctggtgctatgtgccgtacagctgctccttatgcgcacctcttgggcactgtgcgaggctttgactctggccacaggccccattaccactctctgggaaggttcaccaggcaagttttggaacacaaccatcgcagtgtccatggctaatattttcagagggagttacctggccggagccggcttagcgtttagcatcatgaaatcggtcgggacgggaaagaggggcaccggttctcaaggggagacacttggagaaaaatggaagaagaaactgaaccagctctcccggaaggagttcgacctatataaaaagagcggcataactgaggttgatcgaaccgaagctaaagagggtctgaagagaggcgaaatcacacatcacgcagtgtcacgcgggactgccaaattgcagtggtttgtcgagaggaatatggtgattcccgaaggacgggtaatcgacctgggctgtgggcgtggaggctggagttactattgcgctggtctcaagaaggtgaccgaggttagagggtacacaaaaggaggccctggccatgaggaaccggtgcccatgtctacctacgggtggaacattgtcaagcttatgtccggaaaagatgtgttctatctgccacctgagaagtgtgacactttgctgtgcgatatcggtgaaagctcacccagtcctacggtcgaggagagcaggacaattcgcgtgctcaaaatggttgaaccatggttaaagaataaccagttctgtatcaaggtactgaatccctacatgcctgccgtgatagagcaccttgaacggctgcaacgaaaacacggcgggatgctagtcagaaacccactctccaggaattctacccatgagatgtattggattagcaacggaactggcaatatcgtggcatccgttaacatggtgtcacgcctgttgctgaaccggtttaccatgacacacagacgtcccacgatcgaaaaggacgtcgatctcggtgccgggaccaggcatgtgaatgctgagccggagactcctaacatggacgtaattggagaacggataaaacgcatcaaggaggaacacaattctacatggcactacgacgatgagaacccatataaaacctgggcgtaccatggcagttatgaagtgaaggccactggctcggcaagctccatgattaatggggttgtcaagcttctgacaaaaccctgggacgtggtgcctatggtcacccagatggctatgacagatactaccccattcggacagcaacgagtttttaaggagaaagtggacacgagaacccccaggtctatgccgggtacacggcgcgtaatggagatcactgccgaatggttatggagaaccctgggcaggaacaagaaacctcgattgtgcacacgggaggaattcactaagaaggtgcgtaccaatgcagccatgggggctgtctttacggaggaaaaccagtgggattcagccaaagcggcagtggaggacgaggatttctggaagctcgttgacagagaacgcgagctgcacaaactaggaaagtgtggcagctgcgtgtacaatatgatgggtaaaagggaaaagaaacttggggagtttggaaaggccaagggctcccgggctatttggtacatgtggctgggcgccagatatctcgagttcgaagcactggggtttttgaacgaggatcattggttcagtcgcgaaaattcttacagcggagtcgagggtgaaggcctgcacaaactcgggtatatccttagggacatatcaaagatccccggaggcgctatgtacgccgatgacacagctggttgggacacccgaattactgaggatgacctgcataacgaggaaaaaatcacacagcagatggatccagagcaccggcaattagccaatgcaatttttaagctgacctatcagaacaaagtggtaaaggttcagagacctactcccaccgggacagtgatggacatcatatccaggaaggatcagcgcggaagtggccaagtcggcacgtacgggttgaataccttcactaacatggaagcgcagctcattcgtcagatggagggagaaggtgtgctgagcaaagccgacctagagaacccacaccttcccgagaagaaaatcacacagtggctggaaaccaagggcgtggagcggctcaaaagaatggctatctctggggatgactgcgtcgttaagcctattgatgacaggtttgccaatgcactgttggctttaaacgatatgggaaaggtgcgcaaagacataccacaatggcagccgtccaagggctggcatgattggcagcaggtacccttctgttcacaccatttccacgaactgatcatgaaagacggtcgaaagctcgtggtcccttgccggccacaagacgagcttattgggagagccaggatcagccagggagcaggctggtcgctgcgcgaaactgcctgtctaggcaaagcgtatgctcagatgtggtctctgatgtactttcacagacgggatctcaggttggccagtaatgcaatttgctccgccgtgcccgttcattgggtgcctacaagccgtaccacgtggtcaatccacgctcatcaccaatggatgacaaccgaggacatgctgactgtctggaaccgagtgtggatagaggataatccatggatggaagacaagacccccgtaacaacttgggagaacgttccttaccttgggaagcgcgaagatcagtggtgtggatccctgatcggtctcacctctagagccacatgggcacagaatattccgacggctatccagcaagtgcggagcttaattggcaacgaggagttcctggactatatgccaagtatgaaaaggtttcgcaaggaagaggaatccgagggggccatctggtga

SEQ ID NO: 15471 - RNA, 9873 nt, synthetic construct
  misc_feature 1..9873: note = derived and/or modified CDS sequence (opt3) from DENV-3__EU482595__SS-prME
  source 1..9873: mol_type = other RNA
accagcctgtgcctcatgatgatgcttcccgccgctctggcattccacttgacatccagagacggcgagcctaggatgatcgtggggaagaacgaacggggaaaatctttactgtttaagactgcctcaggtattaatatgtgtacgctaatagcgatggatctcggcgagatgtgcgacgataccgtcacatacaaatgtccacatatcactgaagttgagccggaagacattgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccatcctcgccctgtttctggctcattacgttggcacatctctcactcagaaggtggtcattttcatcttactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatagagctccagaagaccgaagcaactcaactggccacacttaggaaactgtgtatcgagggaaagattaccaacatcacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccattgagggaaaagtcgtgcagtatgaaaatctgaagtacacagttatcataactgtgcataccggtgaccagcaccaggtcggcaacgagacacaaggggtgaccgcagaaattactcctcaggcttccacgacagaggccatcctcccagaatatggaacccttggcctggagtgctctccgcgaactggtttggacttcaatgagatgattctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgataaaggttgagtacaagggagaagatgtgccctgtaaagtacctttctccacagaggacggccaaggtaaggctcataacgggcgtcttatcactgcgaatccagtcgtgaccaaaaaggaggaacccgttaacattgaggcagaaccgcctttcggcgagtcaaatatcgtgataggaattggcgataacgccttgaaaatcaattggtataagaaggggagcagtatcggaaaaatgtttgaagctacagcccgcggtgcaagaaggatggccattctgggcgacactgcttgggatttcgggtctgtcggaggcgtgctcaactccctgggtaagatggtacaccagatctttgggagcgcctacaccgcacttttctcgggcgtgtcttgggttatgaaaattggaataggcgtcctgttgacgtggatcgggctcaattccaagaacacatcaatgagttttagctgcattgtgatcggaatcattaccctgtatttaggcgcggtggtccaggctgacatgggttgtgttataaattggaaagggaaggagctgaagtgcggatccggcatcttcgtgactaacgaggtgcatacatggaccgaacagtacaaatttcaagccgattctcccaagcggctagcaactgccattgctggtgcctgggagaatggcgtatgtgggatccgaagcaccacacgcatggaaaacctcctgtggaaacagattgcaaatgagcttaactatatcttgtgggaaaataacataaagctgacggtcgtggttggagacatcattggcgtgctcgagcaggggaaaagaatcctgaccccacagcctatggagttaaagtactcatggaaaacttggggaaaggctaagattgtcacagccgaaacccaaaacagttccttcatcatagatggccccaatacaccagagtgccccagcgcgtctagggcctggaacgtgtgggaagttgaggactatggttttggggtgttctcaactaatatttggctgaaacttcgggaagtatacacccagttgtgtgaccaccgcctcatgagtgctgcagtcaaggatgagagagccgtgcacgctgacatgggatactggatcgagagccagaaaaacggctcctggaagctggaaaaagcctctctaattgaggtgaagacgtgcacatggcctaagtcgcataccctgtggagcaatggtgtcctcgaatccgatatgatcataccaaaatcactggcaggcccgatcagtcagcacaactataggcccgggtaccatactcaaaccgcgggaccttggcaccttggcaagttggagctggactttaattattgcgaggggacaactgttgtgattaccgaaaactgtggaacacgtggcccatctttacggacgaccactgtaagcggtaaactcatccacgagtggtgctgtcgatcctgcacactgccccctcttagatacatgggggaagatggatgttggtatggcatggagattaggccaatctcagaaaaggaggagaatatggtgaaaagcctggtctctgccggttccggcaaggtggacaacttcaccatgggggttttgtgcctcgctatactgtttgaagaggtgatgcgcggaaagttcggcaaaaagcatatgattgccggggtcttctttactttcgtgctactgctcagtggacagatcacatggcgggatatggcacacaccctgatcatgattggcagcaatgcttctgacagaatgggtatgggggttacgtaccttgccttgatcgcaacttttaaaattcagcccttcctggccttaggatttttcctcaggaagctgacctcccgcgaaaaccttctgctaggcgtgggcctcgctatggcgacaaccctgcaattgccggaggatatagaacagatggccaatgggatcgcactgggattaatggctctcaaactgattactcagtttgagacatatcagctttggaccgccctgatctcattgacatgtagtaacactattttcaccctcacggtcgcctggcgaacagctaccctgatcctagcaggtgtaagcctgcttcctgtgtgccaatcgtcctctatgcggaagactgactggctcccaatgaccgttgccgcgatgggcgtgccccctctgcccttgtttatattcagcctgaaggatacattaaaacgtagatcatggccactcaatgagggggtcatggctgtgggactggtaagtatccttgcctcctctctgttgaggaacgacgtgcctatggcaggccccctcgtcgccggtgggctgctaattgcttgttacgttatcactggaaccagcgcagatctgacggtggaaaaggccgcggacgtgacatgggaggaagaggctgaacagaccggcgtctcccataaccttatgattactgtggacgatgacggcacaatgcgcatcaaagatgacgagaccgagaatatactcactgttctgttgaagacagccttactgattgtatcagggatctttccatacagcatcccggcaaccctcctggtgtggcacacgtggcagaaacagactcaacggagtggagtcctttgggatgtgccttctcccccagaaacccagaaggccgagctggaagagggtgtttatagaattaaacagcagggcatattcgggaagacacaagtgggagtcggcgtgcagaaggagggtgtatttcataccatgtggcacgtcacaaggggggctgtgttgacttacaacggaaaacgactagaacccaattgggcctccgttaagaaagacctgatcagctatggcggcgggtggcgcctctcggcacagtggcaaaagggagaggaagtgcaggtcattgctgtggagcctggtaaaaacccaaagaatttccagaccatgcccggcacgttccagacaactaccggggaaatcggagccattgcgctggattttaagcctggcacatcaggttctccgatcataaaccgggaggggaaagttgtgggactttacggcaatggcgtcgtgaccaagaacgggggatatgtaagtggtatcgcccaaactaatgcagagccagacggccccgctcctgaattagaggaagagatgttcaaaaagagaaacctgaccattatggatctccacccagggtccggaaaaacaaggaagtacttgcccgccatcgtgcgtgaagctattaagcgccggctgagaacgctcatcctggcacctactagggttgtcgccgccgagatggaggaagctcttaaaggcctgccgatacgatatcagaccacagcgaccaagagcgagcatactggtcgggaaattgtggacttgatgtgccacgcaacatttaccatgcgcctactgtctcccgtgagagtcccaaattacaacctcatcatcatggatgaggcccatttcacggaccctgctagcattgccgcaagggggtacatctccactcgggtaggaatgggcgaagccgctgcgatatttatgacagccacccccccaggcaccgcagatgctttccctcagtcaaatgcccccattcaggacgaggagcgagacatcccagaaagaagttggaacagcgggaatgagtggattactgattttgcaggaaaaacagtgtggttcgttccgtctatcaaggccggtaacgacatagctaactgtttacgcaaaaatggcaagaaggtgattcaactgtccaggaaaacctttgatacagaatatcagaagactaaacttaacgactgggatttcgtcgtgacgaccgacatctcagagatgggggccaattttaaggcggatcgtgttatcgaccctcggagatgcctgaaacccgtgattctcacagatggaccagagagggtcatcttggcaggccccatgcctgtgactgccgctagtgccgctcagcgccgaggtagagtagggcggaacccacagaaggaaaatgaccaatacattttcaccggccagcccctgaacaatgatgaggaccacgcacattggacagaagccaagatgctcctggacaacataaatacccctgagggaatcattccggctcttttcgaaccagagagggagaaaagcgccgcaatcgatggcgaatatcgcctaaagggggagtcccgtaaaacttttgtggaactgatgagacggggagacttgcccgtttggttagcgcacaaggtcgcctctgagggtatcaaatacacggataggaagtggtgcttcgacggccagcgcaacaatcagattctggaagagaacatggatgtggagatatggaccaaagaaggggagaagaagaaactccgacctagatggctggacgctcggacatattcggatccccttgccctgaaggaatttaaagacttcgcagctggaaggaagagcatcgccctcgatttggtgactgagattggccgcgtcccatcacacctggcacatagaaccaggaatgccctagacaacctggttatgctccacacatccgaacatggtgggaaagcttaccggcacgcggtggaggagcttcctgaaaccatggagactctgttattgctgggcctcatgatcctgcttacaggaggcgccatgctgtttctcattagtgggaagggaatcggtaagacgtctataggcttgatctgtgtaattgcaagctccgggatgctgtggatggctgaaatccccttacaatggattgcctcagccatcgtgctagagttctttatgatggtcctgctcataccagagcctgaaaaacagcgtaccccgcaggataatcaacttgcatatgtggttattggaatcctgactttggctgccattatcgcggctaacgagatgggcctgctcgaaacaaccaagcgcgacctgggtatgtctaaagagcccggggtggtcagcccaaccagttaccttgatgtagacctccaccctgcctccgcatggacactgtacgccgtggctactacggttataacccccatgttgcgacatacaatcgaaaatagcactgcaaacgtgtctctggccgcgattgctaaccaggccgtcgtgttaatgggcctagacaagggatggccaatctcaaaaatggatctgggcgtccctctccttgcactggggtgctattcccaggtgaatcccttgaccctgacagccgctgttctcctgcttattacccactacgccatcataggaccgggcttacaggcaaaggctactagagaggcccaaaagaggacggcggccggtattatgaaaaacccaacagtggacgggatcatgaccatcgatctggaccctgtaatttatgatagtaagttcgagaaacagctcggacaggtgatgttgctggtcctatgtgcagttcagctgctccttatgcggactagctgggctctgtgcgaagccttgaccctggcaacaggccccatcactaccctctgggagggttcgccaggcaagttttggaatacaacgatagctgtgtctatggccaacattttccgcgggtcctacctggccggagcgggcttagcttttagcatcatgaaatcagtcgggaccggaaagagaggcactggtagtcaaggggaaacacttggagagaagtggaaaaagaaactgaatcagctctctaggaaggaattcgacctatataaaaagtccggcattaccgaggtggatcggactgaggcaaaagaaggtctgaagcgaggcgagatcacacatcacgccgtaagcagagggtcagctaagttgcagtggtttgtggaacgcaacatggttatacccgagggaagggtgatcgacctgggctgtgggcggggaggctggagttactattgcgccggtctcaaaaaggtcaccgaagtgcgtgggtacacgaaaggaggccctggccatgaggagccggtccccatgagcacctacgggtggaatattgtgaagcttatgtccggaaaagatgttttctatctgccacctgaaaagtgtgacacattgctgtgcgatatcggtgagtctagcccctcccctactgtagaagagtcaagaaccattagggtgctcaagatggtcgagccatggttaaaaaacaatcagttctgtatcaaggtgctgaacccctacatgcctacagttattgaacaccttgagcgcctgcaacggaaacacggcgggatgctagtgcgaaatccactctctagaaacagtactcatgaaatgtattggatctcgaatggaaccggcaacatagtcgcaagcgtgaatatggtatccaggctgttgctgaaccgctttacaatgacccaccggagacccactattgagaaggacgtggatctcggtgccgggacgcgtcatgttaacgctgaaccggagacacctaatatggacgtcatcggagagaggatcaaacggattaaggaagagcacaactctacctggcactacgacgatgaaaatccatataagacttgggcgtaccatggctcatatgaggtgaaagccaccggcagcgcatccagtatgataaacggggtggtcaagcttctgacaaaaccctgggacgttgtgcctatggtaacgcagatggctatgaccgatactacaccattcggacagcaacgcgtgtttaaggaaaaagtcgacacccgaactcccagatctatgccgggtacaaggcgggtgatgggcatcaccgccgagtggttatggcgcacactggggagaaataagaagcctaggttgtgcactcgagaggaattcaccaaaaaggttcggacgaacgcagccatgggagctgtgtttaccgaggaaaatcagtgggatagcgccaaagcggcagtcgaggacgaagatttctggattctcgtggaccgtgagagagagctgcacaagctaggcaaatgtggttcatgcgtatacaacatgatggggaagcgcgaaaaaaagcttggagagtttggcaaggccaaaggctccagggctatctggtacatgtggctgggggcccggtatctcgaattcgaggcactgggatttttgaatgaggatcattggttcagtagagaaaacagctactctggtgttgagggcgaagggctgcacaagctcggatatattcttcgcgacatctccaaaatacccggcggtgctatgtacgccgatgacacagctgggtgggacactaggatcaccgaggatgacctgcataatgaagagaagattacacagcagatggatccagagcaccgacaattagccaacgcaatctttaaactgacttatcagaataaggtggtcaaggtgcagcggcctacccccacgggaacagtgatggacattatctcaagaaaagatcagaggggcagcggccaagtcgggacctacggattgaacactttcacaaatatggaagcgcagctcatacgccagatggagggtgaaggcgttctgtcgaaggccgacctagagaacccacaccttcccgaaaaaaagattacccagtggctggagactaaaggggtggagcgtctcaagcggatggctatctctggagatgactgcgtagtgaagcctatcgatgacagatttgccaacgcactgttggctttaaatgatatgggcaaagtcaggaaggacattccacaatggcagccgagtaaaggttggcatgattggcagcaggtgcccttctgttcccaccatttccacgaactgataatgaaggacgggcgcaaactcgttgtgccttgccgaccacaagacgagcttatcggacgggccagaattagccagggcgcaggctggtcactgagggaaaccgcctgtctagggaaggcgtatgctcagatgtggtccctgatgtactttcaccgcagagatctccggttggcctctaacgcaatctgcagcgccgtccccgtgcattgggtacctacaagtaggacgacctggtccattcacgctcatcaccaatggatgactacagaggacatgctgaccgtttggaatcgtgtgtggatcgaagataacccatggatggaggacaagactcccgtcacaacctgggagaatgtgccttaccttggaaaacgagaagatcagtggtgtggtagcctgataggcctcacgtctcgcgccacatgggcacagaacatcccgaccgctattcagcaagttagatcattaatcgggaatgaggaattcctggactatatgccaagtatgaagcggtttaggaaagaggaggaatccgagggagccatttggtga

SEQ ID NO: 15472 - RNA, 9873 nt, synthetic construct
  misc_feature 1..9873: note = derived and/or modified CDS sequence (opt3) from DENV-3__EU482596__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcaaggtagacaacttcacaatgggggtgttgtgcctcgccatcctgtttgaagaggtcatgcgcggaaagttcggcaaaaagcatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaaaatccagcccttcctggctttaggatttttcctcaggaagctgacctctcgcgaaaaccttctgctaggcgtcggcctcgcgatggccactacactgcaattgccggaggatattgaacagatggcaaatgggatcgctctgggattaatggccctcaaactgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaagacagactggctcccaatgactgtcgcggctatgggcgtaccccctctgcccttgtttattttctctctgaaggataccttaaaacgtagaagctggccactcaatgagggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggaaaaggcggctgacgtcacttgggaggaagaggccgaacagacaggcgttagccataaccttatgataaccgtggacgatgacggcactatgcgcattaaagatgacgagacagagaatatcctcaccgtgctgttgaagacggcattactgatcgtctccgggatttttccatactcaataccggccactctcctggtgtggcacacctggcagaaacagacacaacggagcggagttctttgggatgtacctagtcccccagaaacccagaaggctgagctggaagagggtgtgtatagaatcaaacagcagggcattttcgggaagacacaagtcggagtgggcgttcagaaggagggtgtgtttcatactatgtggcacgtcaccaggggggccgtgttgacgtacaacggaaaacgactagaacccaattgggcatctgtaaagaaagacctgatctcctatggcggcgggtggcgcctcagcgctcagtggcaaaagggagaggaagtccaggtgattgccgttgagcctggtaaaaacccaaagaatttccagacaatgcccggcactttccagaccacaaccggggaaatcggagcgatagccctggattttaagcctggcacttcgggttcaccgatcattaaccgggaggggaaagtggtcggactttacggcaatggcgtggttaccaagaacgggggatatgtgtctggtatcgcacaaacaaatgctgagccagacggccccacgcctgaattagaggaagagatgttcaaaaagagaaacctgactattatggatctccacccagggagtggaaaaaccaggaagtacttgcccgccatcgtccgtgaagctataaagcgccggctgagaacactcattctggcacctaccagggtggtagccgccgagatggaggaagctcttaaaggcctgccgatccgatatcagactacagcgaccaagtccgagcatacgggtcgggaaatcgtggacttgatgtgccacgcaacttttacaatgcgcctactgagccccgttagagtcccaaattacaacctcattatcatggatgaggcccatttcaccgaccctgcttctatagccgcaagggggtacattagcacccgggtgggaatgggcgaagccgctgcgatctttatgactgccacacccccaggcaccgcagatgctttccctcagtccaatgcccccattcaggacgaggagcgagacatcccagaaagatcatggaacagtgggaatgagtggataacagattttgcaggaaaaactgtgtggttcgtcccgagcattaaggccggtaacgacatcgctaactgtttacgcaaaaatggcaagaaggtaatccaactgtctaggaaaacgtttgataccgaatatcagaagacaaaacttaacgactgggatttcgtggttactaccgacatttccgagatgggggccaattttaaggcggatcgtgtgatcgaccctcggagatgcctgaaacccgtcattctcacagatggaccagagagggtgatattggcaggccccatgcctgttaccgccgcttcagccgctcagcgccgaggtagagtggggcggaacccacagaaggaaaatgaccaatacatcttcactggccagcccctgaacaatgatgaggaccacgcacattggacggaagccaagatgctcctggacaacattaatacccctgagggaatcatcccggctcttttcgaaccagagagggagaaaagtgccgcaattgatggcgaatatcgcctaaagggggagagccgtaaaacatttgtcgaactgatgagacggggagacttgcccgtgtggttagcgcacaaggtagcctccgagggtataaaatacactgataggaagtggtgcttcgacggccagcgcaacaatcagatcctggaagagaacatggatgtggagatttggaccaaagaaggggagaagaagaaactccgacctagatggctggacgctcggacatattctgatccccttgccctgaaggaatttaaagacttcgcagctggaaggaagtcgatcgccctcgatttggttaccgagattggccgcgtcccaagccacctggcacatagaactaggaatgccctagacaacctggtgatgctccacacatcagaacatggtgggaaagcttaccggcacgcggtggaggagcttcctgaaacgatggagaccctgttattgctgggcctcatgatcctgcttactggaggcgccatgctgtttctcatatccgggaagggaatcggtaagacaagtattggcttgatctgtgtcattgcatctagcgggatgctgtggatggctgaaatccccttacaatggatagcctccgccattgttctagagttctttatgatggtgctgctcatcccagagcctgaaaaacagcgtaccccgcaggataatcaacttgcatatgtagtgattggaatcctgaccttggctgccataatcgcggctaacgagatgggcctgctcgaaacaactaagcgcgacctgggtatgtcaaaagagcccggggtcgtgtctccaacgagctaccttgatgttgacctccaccctgccagtgcatggaccctgtacgccgtggctacaactgtcattacccccatgttgcgacatacaatcgaaaattccaccgcaaacgtaagcctggccgcgattgctaaccaggccgtggttttaatgggcctagacaagggatggccaatctctaaaatggatctgggcgtgcctctccttgcactggggtgctattcacaggtcaatcccttgactctgacggccgctgtgctcctgcttataacacactacgccattatcggaccgggcttacaggcaaaggctaccagagaggcccaaaagaggactgcggccggtatcatgaaaaacccaaccgtcgacgggattatgacaatcgatctggaccctgtgatatatgattccaagttcgagaaacagctcggacaggttatgttgctggtgctatgtgcagtacagctgctccttatgcggactagttgggctctgtgcgaagccttgaccctggcaacaggccccattacgaccctctgggagggtagcccaggcaagttttggaatactacaatcgctgtgtcgatggccaacattttccgcgggtcttacctggccggagcgggcttagctttttccatcatgaaaagcgtcgggaccggaaagagaggcactggttcacaaggggaaacacttggagagaagtggaaaaagaaactgaatcagctcagtaggaaggaattcgacctatataaaaagtctggcataaccgaggttgatcggacggaggcaaaagaaggtctgaagcgaggcgagatcacccatcacgccgtgtccagagggagcgctaagttgcagtggtttgtcgaacgcaacatggtgattcccgagggaagggtaatcgacctgggctgtgggcggggaggctggtcatactattgcgccggtctcaaaaaggtgacagaagttcgtgggtacactaaaggaggccctggccatgaggagccggtgcccatgagtacctacgggtggaatattgtcaagcttatgagcggaaaagatgtgttctatctgccacctgaaaagtgtgacacattgctgtgcgatatcggtgagtcctctcccagccctactgtcgaagagtccagaaccattagggtgctcaagatggttgagccatggttaaaaaacaatcagttctgtatcaaggtactgaacccctacatgcctacagtgatagaacaccttgagcgcctgcaacggaaacacggcgggatgctagtccgaaatccactctcaagaaactctacccatgaaatgtattggattagtaatggaactggcaacatcgtggcatcggttaatatggtgagcaggctgttgctgaaccgctttacgatgacacaccggagacccaccatcgagaaggacgtcgatctcggtgccgggactcgtcatgtgaacgctgaaccggagacccctaatatggacgtaattggagagaggataaaacggatcaaggaagagcacaactccacatggcactacgacgatgaaaatccatataagacgtgggcgtaccatggctcttatgaggtgaaagccaccggctcagcaagctccatgattaacggggttgtcaagcttctgactaaaccctgggacgtggtgcctatggtcacacagatggctatgaccgatactacaccattcggacagcaacgcgtttttaaggaaaaagtggacacccgaacacccagaagtatgccgggtactaggcgggtaatgggcatcaccgccgagtggttatggcgcacgctggggagaaataagaagcctaggttgtgcacccgagaggaattcacaaaaaaggtgcggactaacgcagccatgggagctgtctttaccgaggaaaatcagtgggattctgccaaagcggcagtggaggacgaagatttctggaagctcgttgaccgtgagagagagctgcacaaactaggcaagtgtggtagctgcgtgtacaacatgatggggaaacgcgaaaagaagcttggagagtttggcaaagccaagggctcaagggctatttggtacatgtggctgggggcccggtatctcgaattcgaggcactgggatttttgaatgaggatcattggttctccagagaaaacagttacagcggtgtcgagggcgaagggctgcacaaactcggatatatccttcgcgacatatctaagatccccggcggtgctatgtacgccgatgacacagctgggtgggacactaggattaccgaggatgacctgcataatgaagagaaaatcacgcagcagatggatccagagcaccgacaattagccaacgcaatttttaagctgacatatcagaataaggtggtaaaagttcagcggcctacccccactggaacagtgatggacatcatatccagaaaggatcagaggggctcaggccaagtcgggacctacggattgaacactttcaccaatatggaagcgcagctcattcgccagatggagggtgaaggcgtgctgagcaaagccgacctagagaacccacaccttcccgaaaagaaaatcacacagtggctggagacgaagggggtggagcgtctcaagcggatggctatctcgggagatgactgcgtcgttaaacctattgatgacagatttgccaacgcactgttggctttaaatgatatgggcaaggtgaggaaagacataccacaatggcagccgtctaagggttggcatgattggcagcaggtacccttctgtagtcaccatttccacgaactgatcatgaaagacgggcgcaagctcgtggtcccttgccgaccacaagacgagcttattggacgggccagaatctcccagggcgcaggctggagcctgagggaaaccgcctgtctagggaaggcgtatgctcagatgtggtcactgatgtactttcaccgcagagatctccggttggcctccaacgcaatttgctctgccgtgcccgttcattgggtgcctactagcaggacaacctggagtatccacgctcatcaccaatggatgactacagaggacatgctgaccgtctggaatcgtgtgtggatagaagataacccatggatggaggacaaaacgcccgtaacaacctgggagaatgttccttaccttggaaagcgagaagatcagtggtgtggttccctgatcggcctcactagccgcgccacctgggcacagaacattccgacagctatccagcaagtgagatctttaattgggaatgaggaattcctggactatatgccatcaatgaaacggtttaggaaggaggaggaaagtgagggagccatctggtga

SEQ ID NO: 15473 - RNA, 9873 nt, synthetic construct
  misc_feature 1..9873: note = derived and/or modified CDS sequence (opt3) from DENV-3__JQ922554__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccacatatcaccgaactggagccggaagacattgattgctggtgtaaccttacaagtacctgggttacttatgggacatgcaatcaggcgggagagcaccgccgagacaagcgtagcgtggctctggccccccatgtaggcatgggtttggataccagaacgcaaacttggatgtccgcagagggggcctggaggcaggtggaaaaagtcgagacctgggctctccggcaccctggattcacaatcctggcactgtttctcgcccattacattggcacttctttaacccagaaggtggttatcttcatactgcttatgttggtgacaccatcgatgaccatgcgctgtgtcggcgtggggaacagagactttgtagaaggactgtcaggtgctacgtgggttgatgtggtcctagagcacggcgggtgcgtgactacaatggccaagaataaacccaccctcgacatcgagctgcagaagactgaagcgacacaacttgcaaccctgaggaaattgtgtattgagggaaagatcacgaacattaccacagatagccggtgccctactcagggcgaagccatcctcccagaggaacaggaccagaattatgtgtgtaaacacacctacgtcgatcgcggttgggggaacggatgcggcctgttcggcaaggggagtttagttacatgcgctaagtttcaatgtctggagtccatagagggaaaagtggtacagcatgaaaatctcaagtatactgtgattatcaccgtccacacaggtgaccagcatcaggtgggcaacgagacccaaggggttactgccgaaattacgtctcaggcaagcacagctgaggccatccttcccgaatacggaaccctgggcttggagtgctcccctcgaactggtctagacttcaatgagatgatcctgctcaccatgaaaaacaaggcgtggatggtgcacagacagtggtttttcgatctgccacttccgtggacatcaggggccaccactaaaacacccacgtggaataggaaggaactgttggtcacctttaaaaacgcacacgctaagaagcaagaggtggtagttctcggcagtcaggaaggagccatgcatactgctctgacaggcgccaccgagattcagacaagcgggggaacttctatattcgcaggtcacttaaaatgtcggctgaagatggacaaactagaactcaagggcatgtcctatgccatgtgcctgaatacctttgtgcttaaaaaggaggtctcagagacgcagcatgggaccatcttgattaaggtggaatacaaaggagaggatgctccttgtaagatcccattcagcacagaagacggccaaggtaaagcgcacaacgggcgtctgataactgcaaaccccgtcgtgaccaagaaagaggagcctgttaatattgaagccgagccacccttcggcgaaagtaacatcgtgatcggaattggcgataaggctctcaagatcaattggtaccgcaaagggtcttccattggaaagatgtttgaggccacagcaagaggtgccaggcggatggctatactgggcgacactgcctgggatttcgggagcgtaggaggcgtccttaactcgctgggtaaaatggtgcatcagatctttgggtctgcatataccgcgttgttctccggcgtttcatggattatgaagatcggaatcggcgtgctcctgacgtggattgggttaaatagtaaaaacacaagcatggctttttcctgcatagccatcggaattatcaccctgtacgtcggcgtggtagtgcaggcagacatgggttgtgttattaattggaaggggaaggaactaaaatgcggatctggcatcttcgtcactaacgaggtgcacacatggaccgagcagtataagtttcaagccgatagcccgaaacgactcgctactgccatagcaggtgcttgggaaaatggcgtgtgtgggatccgctcaaccacaagaatggagaacctgctttggaagcagattgccaatgaattgaactacatcctgtgggagaataacattaaactcacggtcgttgtgggagacatcaccggcgtgctggaacagggggagaggactttaacacctcagcccatggagctgaagtatagttggaaaacctggggaaaggcgaagatagtaacagccgaaactcaaaattccagcttcattatcgatggcccatctacccctgagtgcccctcagctagtcgggcatggaacgtctgggaagtggaggactacggttttggggttttcacgacaaacatttggcttaaattgcgcgaagtgtatacccagctctgtgaccacagactgatgagcgccgctgtcaaggatgagagggccgtgcatgcagacatgggatactggatcgagtcccagaaaaatggctcttggaagctagaaaaagcgtcgctgatagaggttaagacttgcacctggccaaagagccacacactctggtccaacggtgtgctggaatcagatatgatcattcccaaaagtcttgccggccctatctctcagcataatcaccgtccagggtaccacactcaaaccgctggaccgtggcatttgggcaagctggagttagactttaactattgcgaggggacaacggtagtcattagcgaaaattgtggaacccggggcccctccctccgaactacaaccgtgtcaggtaaactgatccacgagtggtgctgtagaagctgcactcttcctccactgaggtacatgggggaagatggatgttggtatggcatggagatacgccccattaacgaaaaggaggagaatatggtgaaatctttggcctccgcaggtagtggcaaggtcgacaacttcacaatgggggttctctgcctggctatcctatttgaagaggtgatgcggggaaagttcagaaaaaagcatatgatcgccggcgtactgttcacctttgtgctcctgcttagcgggcagattacgtggagggatatggcacacactttgatcatgattggatctaatgcctccgaccgcatgggcatgggtgtcacctacctggctttaatagcgacattcaaaatccagccttttctcgccctggggttctttcttcgaaagctgacctcacgggaaaacctactcctgggagtgggcttggcaatggctgccactctgcgtttaccagaggatattgaacaaatggccaatggcatcgctctcgggctgatggcacttaaactgattacacagttcgagacctatcagttgtggacagccctcgttagtctgacttgtagcaacaccatctttacgctaacagtggcgtggagaaccgctactctgatacttgccggaatctcgctcctgcccgtctgccagtcctctagcatgaggaagaccgactggttgccgatgacagtggcagccatgggtgttcctccactgcccttattcattttttcactcaaggatactctgaaacgccggagttggcctcttaatgagggcgtgatggctgtcgggctggtatccatcttggcatctagcctcctgagaaacgacgtgcccatggccggaccactagttgcgggcggtctgcttattgcttgttacgtgatcaccgggacgtccgccgatctcacagtcgaaaaggcagccgacgtgacctgggaggaagaggctgaacaaactggagtatcacataatctgatgataacagtggacgatgacggcaccatgaggattaaagatgacgagactgagaacatcttgacagtcttactgaagaccgccctcctgatcgttagcggcattttcccttatagtatacccgcaacgcttctggtgtggcacacttggcagaaacagacccagcgatctggggtgttgtgggatgtcccatccccgcctgaaacacaaaaggctgagctagaagagggagtgtaccgcatcaaacagcagggtatttttggcaagacccaggttggggtaggagtgcaaaaggagggcgtcttccacacaatgtggcatgtgactcggggtgccgttctgacccacaacgggaaaagactcgaacccaattgggcgagcgtgaagaaagacctgatctcgtacggaggcggctggaggctttcagcccagtgggcaaaggggggagagacgcaggtcattgctgtggaaccaggtaaaaaccccaagaattttcaaacaatgcctggcatcttccagactaccacaggggagataggagccatcgctttagatttcaagccaggcacctctggtagtcccattatcaaccgtgaagggaaagtagtcggactgtatggcaatggcgtggttactaagaacgggggatacgtgtccggtattgcacagaccaatgccgagctcgacggccctacaccggagttggaagaggaaatgtttaaaaagcgcaacctgacgatcatggatctccatccagggagcggaaaaactcggaagtatctgcccgccatagtcagagaggctattaagaggcgacttcggaccctgatcttggcgcctacacgcgtggttgcagccgaaatggaggaggctctaaaaggcctgccaatcagataccagaccactgccacaaagtctgaacacaccggtagggagattgtggacctcatgtgccatgcaacgttcactatgcggttactgagccccgtccgagggtccaattataaccttatcataatggatgaagcccactttacagaccctgcttcaattgcggccatcggatacattagtaccagagtgggcatgggcgaggcagctgccatcttcatgaccgcaactccgcccgggacagtagatgcctttccacaaagcatacctcccattcaggacgaagagcgcgacatcccagagaggtcttggaattccggaaacgaatggatcaccgatttcgtgggtaaaacagtttggtttgtcccttcaattaaggctggcaatgacatcgccaactgtctgcgtaaaaatgggaagaaggtgattcagctcagtcggaaaactttcgatacggagtatcagaagaccaaattgaacgactgggattttgtggtcacaactgacataagcgaaatgggagcgaacttcaaggcagatagagtaatctacctgaggcgctgcctcaaacccgtgattctgaccaatggcccagagcgagttatccttgccggtccgatgcctgtgacagtcgcttccgccgctcaaagacgggggagggtgggccgcaacccccagaaggagaatgaccagtacatctttatgggacagccactaaacaatgatgaagaccacgcacattggaccgaggccaagatgctgttggataacattaatactcccgaaggcataatccctgctttattcgagccagaacgtgagaaatctgccgcaattgacggggagtatagactgaagggagaatcgcggaaaacgttcgttgagctcatgaggcgcggtgacctgcccgtgtggcttgcgcacaaggtcgccagcgaaggcatcaaatacaccgatcgaaagtggtgctttgacggggagagaaacaatcaaattctggaagagaacatggatgtggagatctggacaaaagaaggagagaagaagaattggcggcctaggtggctcgacgctcgcacttattcagatccgttggccctgaaagaattcaaggactttgcagctggcagaaaatccatagccctagatctggtaaccgagatcggtagggtgccaagtcatctcgcacacacagttcggaacgcccttgacaatctggtcatgttacacacctctgaacatgggggccgtgcttaccgccacgcggtggaggagttgcccgaaactatggagacactgctcctgcttggactgatgattctcttgacgggcggggccatgctgttcttaatcagcggaaagggtattggcaaaacctccatcgggctaatatgtgtgattgcatcatctggaatgctgtggatggctgatgtccctctccagtggatcgccagcgccattgttcttgaatttttcatgatggtgctgttgatccccgagccagagaagcagcgaactcctcaggacaaccaactggcatatgtagtgataggcatcctcacactggctgccattgtcgcggctaatgaaatgggtcttctcgagaccaccaagagagatctggggatgagtaaagaacccggcgtggtttccccaacaagctacttggacgtggatctgcatcctgcctctgcatggactttatatgccgtcgctacgccggtaatcacccccatgctaaggcacacaattgagaactcaactgcaaatgtgtccctggccgcgatcgctaaccaggccgttgtgctcatgggacttgacaagggctggccaataagtaaaatggacctgggggtccctttgctggcactcggatgctacagccaggtgaaccccctgacccttgccgctgccgtcttactgctcgtgacacattacgcaattatcggcccaggtttgcaagctaaggccacccgggaagcgcagaaacgcactgccgcagggatcatgaagaatcctacggttgatggaattatgacaatcgacctggatcccgtgatatatgactcgaagtttgagaaacagctaggccaggtaatgctgctcgtgctttgtgctgtccaactgttgctgatgagaacctcttggccgctctgcgaggttctggccttagcaactggtccaattaccacactttgggaaggctcccctgggaagttctggaacactaccatcgctgtgagcatggccaatatttttaggggatcatacctggccggcgcggggctcgctttcagtatcatgaaatctgtcggaacaggcaagcggggtacggggtcccagggagagaccctaggcgaaaaatggaagaagaaactgaaccagttgagccgaaaggagtttgatctgtataaaaagtcaggtataactgaagtggacagaacagaggcaaaagagggcctcaagcgcggggaaatcacccaccacgccgtaagtaggggaagcgctaaacttcagtggttcgtggagcggaatatggtttttcccgaaggccgtgtgattgatctggggtgtggaagaggcggttggtcctactattgcgccgggttgaagaaggtcactgaggtgaggggatacacaaaaggcggcccagggcatgaagagcccgtccctatgtctacctatggatggaacatcgtgaagctgatgagcggtaaagacgttttctacctcccgcccgagaagtgtgatacgttactgtgcgacattggcgaatcctcaccatctcctaccgtagaggaaagtcgcacaatccgggtgcttaaaatggtcgagccctgggtgaagaataaccaattctgtattaaggttctgaatccttacatgccatcggtgatcgagcacctagaaaacctccagcgaaaacatgggggaatactggtcagaaatcccttgagcaggaactccactcacgagatgtattggatttctaatggcaccggtaacatcgtgtcaagcgtaaatatggtgtcccgcctgctccttaaccggtttacaatgactcacagacgtcctaccatcgaaaaggatgttgacctgggggcaggaacaaggcatgtcaacgccgagccagaaacccccaatatggatgtgattggcgagcggataaaacgcatcaaggaggaacacagttctacttggcattacgacgacgagaacccgtataaaacgtgggcttaccacggcagctatgaagtgaaggcgacagggtcagcctccagtatgattaatggagtcgttaagttactgaccaaaccttgggatgtggtaccaatggtgactcagatggcaatgaccgacacaacgcccttcggtcagcaacgagtctttaaggagaaagtggataccagaactcctaggccaatgcccggcacacggaaggttatggaaatcaccgctgagtggttgtggcgcactctcgggagaaacaaaaggccgcgactgtgcacacgggaggaattcaccaagaaggtgcgtacaaatgccgcaatgggagccgtctttactgaggaaaaccagtgggacagcgctagagccgcggtggaggatgaagagttctggaaactagtagaccgcgagagggaacttcataagctgggcaaatgtggttcttgcgtttacaatatgatggggaagcgggagaaaaagctcggagaatttggcaaagcaaaggattccagagccatttggtatatgtggctgggcgctcgctacttggagttcgaggccctggggtttctcaacgaagaccactggttctcaagggagaatagctactcgggagtggaaggtgagggccttcacaagctggggtatatcttacgagatatatctaaaatccctggaggcgcaatgtacgctgacgataccgccggttgggacacgcggattaccgaagacgatctgcataacgaggagaagatcacacagcaaatggctagagaacacaggcagttggccaatgcaatttttaaactcacttatcagaacaaggtcgtgaaagtgcagcgccccaccccaaaggggacagtcatggacatcataagtcgtaaggatcaacggggatccggccaggttggcacttacgggctgaataccttcacgaacatggaggcgcagctaattagacagatggaaggagagggtgtgcttagcaaagccgacctggaaaatcctcatcccctcgagaagaaaatcacacaatggctggagaccaagggcgtagaaaggttgaaacgcatggctatctcaggggatgactgcgtggtcaagccaattgatgaccgatttgccaacgcattactggctctcaacgatatgggaaaggtgcggaaagacataccccagtggcagccttccaagggctggcacgattggcagcaagttccattctgttctcaccatttccacgagcttatcatgaaagacggtagaaagctggtggtcccgtgcaggccccaggatgaactactggggaaagcccgcattagccagggagcaggctggagtctcagagagactgcctgtttgggcaaggcgtatgctcagatgtggacactgatgtactttcatcggagggaccttcgtctggcctccaatgcaatctgcagcgccgtgcctgtacactgggttccaacctctcgaactacctggtcaattcatgctcaccaccaatggatgacaacggaagacatgctcaccgtgtggaaccgcgtctggatcgaggataatccctggatggaggacaagactcctgtgacaacctgggaagatgttccatatttagggaaaagagaggaccagtggtgtggaagtctgataggtttgacttcccgggccacatgggcacagaacatcctgaccgctattcaacaggtgaggagcctcatcggcaatgaagagttccttgattacatgccctctatgaagcgctttagaaaagaggaagagtcggaaggggccatttggtga

SEQ ID NO: 15474 - RNA, 9873 nt, synthetic construct
  misc_feature 1..9873: note = derived and/or modified CDS sequence (opt3) from DENV-3__EU529683__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacactggttgtgtgatcaattggaaagggaaggagctgaagtgcggatccggcattttcgtgacaaacgaggtccatacctggactgaacagtacaaatttcaagcagattctcccaagcggctagccaccgctatcgccggtgcatgggagaatggcgtttgtgggatacgaagcacaacgcgcatggaaaacctcctgtggaaacagatcgctaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggccaggatagtgacagcggaaactcaaaacagttccttcattatcgatggccccaataccccagagtgccccaacacgagccgggcctggaatgtttgggaagtggaggactatggttttggggtcttcacaaccaacatttggctgaagcttcgcgaagtgtacactcagttgtgtgaccacagactcatgtctgctgcagttaaagatgagagggccgtgcacgctgacatgggatactggatcgagtcacagaagaatggcagttggaaactggaaaaggccagcctaatagaggtaaaaacctgcacatggcctaagtcccatactctgtggtctaacggtgtcctcgaatcggatatgatcattccaaagagcctggcaggcccgatctcccagcacaattatcgtcccgggtaccatacccaaacagcgggaccttggcaccttggcaaattggagctggactttaactattgcgaggggacgaccgtggtgattactgaaaattgtggaacacggggcccatcattacgaaccactacagtcagtggtaagctcatccacgagtggtgctgtagatcttgcaccctgccccctcttaggtacatgggggaagatggatgttggtatggcatggagatacgcccaattagcgaaaaagaggagaacatggttaagtccctggtgtcagccggtagcggcgaagtagacaatttcacgatgggggtgttgtgcctcgctatcctgtttgaggaagtcatgcggggaaaattcggcaagaagcatatgatcgccggggtgttctttactttcgttctactgctctctggacagattacctggagagatatggcacacacactgatcatgattggctccaacgctaccgacaggatgggtatgggggtgacttaccttgccttgatagcaacatttaaaatccagcccttcctggccttaggatttttcctccgcaagctgaccagtcgagagaatcttctgctaggcgtcggcctcgctatggcgacaactctgcaattgccggaagatattgagcagatggccaacgggatcgcactgggattaatggctctcaaactgattacccagtttgagacgtatcagctttggacagccctgatcagcttgacctgttctaatactatattcaccctcacagtggcctggcggactgctaccctgatcctagcaggtgtttccctgcttcctgtgtgccaatcaagtagcatgcgtaagacggactggctcccaatgacagtcgccgcgatgggcgtaccccctctgcccttgtttattttctcgctgaaagataccttaaagagaaggtcctggccactcaacgaaggggtgatggctgttggactggtgtctatccttgccagctcactgttgcgcaacgacgtccctatggcaggccccctcgtggccggtgggctgctaattgcttgttacgtaatcactggaacaagtgcagatctgaccgtggagaaggccgcggacgtcacttgggaagaggaagctgagcagacaggcgtttcccataatcttatgataaccgtggacgatgacggcacgatgcggattaaagatgacgagactgaaaacatcctcaccgtgctgttgaagacagccttactgatcgtctctgggatttttccatacagcataccggcaaccctcctggtgtggcacacatggcagaaacagactcaaagatccggagttctttgggatgtaccttcacccccagagacccagaaggccgaactggaggagggtgtgtataggatcaaacagcagggcattttcgggaagacgcaagtcggagtgggcgttcagaaagaaggtgtgtttcatacaatgtggcacgtcactcgaggggctgtgttgacctacaatggaaagcgcctagagcccaactgggccagcgtaaagaaagacctgatcagttatggcggcgggtggcggctctctgcacagtggcaaaagggagaagaggtccaggtgattgctgttgaacctggtaaaaatccaaagaacttccagacaatgcccggcaccttccagactaccacaggggagatcggagccatagcgctggattttaaacctggcacgtccggtagcccgatcattaatagagaggggaaggtggtcggactttacggcaacggcgtggttactaagaatgggggatatgtgtcgggtatcgcccaaaccaacgcagaaccagacggccccacacctgagttagaagaggaaatgttcaaaaagaggaatctgaccattatggatctccacccagggtcaggaaaaactcgtaagtacttgcccgctatcgtccgcgaggccataaaacggagactgaggacactcattctggctcctacccgagtggtagcagccgagatggaagaggcccttaagggcctgccgatccggtatcagacgactgctacaaagtctgaacataccggtcgcgagatcgtggacttgatgtgccacgcgacctttactatgagactactgagtcccgttagggtcccaaactacaatctcattatcatggatgaagcacatttcacagaccctgcctccatagctgcccgggggtacattagcacccgagtgggaatgggcgaggcagccgctatctttatgacagcgactcccccaggcacggccgatgcattccctcagtctaacgctcccattcaggacgaggaaagagacatcccagagcgcagctggaattccgggaacgaatggataaccgattttgccggaaaaacagtgtggttcgtcccgtcaattaaggcaggtaacgacatcgccaattgtttaaggaaaaacggcaagaaagtaatccaactgagtcgtaagacttttgataccgagtatcagaagacaaaacttaatgactgggatttcgtggttaccactgacattagcgagatgggggctaactttaaggccgatcgggtgatcgaccctagaaggtgcctgaaacccgtcattctcacggatggaccagaacgcgtgatattggcgggccccatgcctgttaccgcagcctctgctgcccagcgaagaggtcgggtggggaggaatccacagaaggagaacgaccaatacatcttcacaggccagcccctgaataacgatgaagaccacgctcattggactgaggcaaaaatgctcctggacaatattaacacccctgaaggaatcatcccggcccttttcgagccagagcgcgaaaagtccgctgccattgatggcgagtatcgtctaaagggggaatcaagaaaaacatttgtcgagctgatgcggaggggagacttgcccgtgtggttagcacacaaggtagcgagtgaaggtataaaatacaccgatcgcaagtggtgcttcgacggccagcgaaataaccagatcctggaggagaatatggatgtggaaatttggactaaagagggggaaaagaaaaagctcagacctcggtggctggacgccaggacatatagcgatccccttgctctgaaggagtttaaagacttcgccgcaggacgcaagtccatcgctctcgatttggttacggaaattggcagagtcccaacccacctggcccataggactcggaacgcactagacaatctggtgatgctccacacatctgagcatggtgggaaagcctaccgtcacgctgtggaggaacttcctgagaccatggaaaccctgttattgctgggcctcatgatcctgcttacaggaggcgcgatgctgtttctcatatcggggaagggaatcggtaaaactagcattggcttgatctgtgtcattgcctcatccgggatgctgtggatggcagagatccccttacaatggatagctagtgccattgttctagagttctttatgatggtgctgctcatcccagaacctgagaagcagcgcacgccgcaggataaccaacttgcctatgtagtgattggaatcctgaccttggcagctataatcgccgcgaatgaaatgggcctgctcgagacaactaagcgagacctgggtatgtctaaagaacccggggtcgtgagcccaacctcctaccttgatgttgacctccaccctgcttcagcctggacactgtacgcagtggccaccactgtcattacgcccatgttgagacatacaatcgagaactctaccgctaacgtaagcctggcagccattgcgaatcaggctgtggttttaatgggcctagacaagggatggccaatcagtaaaatggatctgggcgtgcctctccttgccctggggtgctattcccaggtcaaccccttgactctgaccgcagccgtgctcctgcttataacacactacgctattatcggaccgggcttacaggccaaggcaactagggaggctcaaaaacggaccgccgcgggtatcatgaagaatccaacagtcgacgggattatgacgatcgatctggaccctgtgatatatgatagcaagttcgaaaaacagctcggacaggttatgttgctggtgctatgtgccgtacagctgctccttatgcgcacctcttgggcactgtgcgaggctttgactctggccacaggccccattaccactctctgggaaggttcaccaggcaagttttggaacacaaccatcgcagtgtccatggctaatattttcagagggagttacctggccggagccggcttagcgtttagcatcatgaaatcggtcgggacgggaaagaggggcaccggttctcaaggggagacacttggagaaaaatggaagaagaaactgaaccagctctcccggaaggagttcgacctatataaaaagagcggcataactgaggttgatcgaaccgaagctaaagagggtctgaagagaggcgaaatcacacatcacgcagtgtcacgcgggagtgccaaattgcagtggtttgtcgagaggaatatggtgattcccgaaggacgggtaatcgacctgggctgtgggcgtggaggctggtcttactattgcgctggtctcaagaaggtgactgaggttagagggtacaccaaaggaggccctggccatgaggaaccggtgcccatgtccacatacgggtggaacattgtcaagcttatgagcggaaaagatgtgttctatctgccacctgagaagtgtgacaccttgctgtgcgatatcggtgaatcaagtcccagccctactgtcgaggagtccaggacgattcgcgtgctcaaaatggttgaaccatggttaaagaataaccagttctgtatcaaggtactgaatccctacatgcctgccgtgatagagcaccttgaacggctgcaacgaaaacacggcgggatgctagtcagaaacccactctctaggaatagcacacatgagatgtattggatttccaacggaaccggcaatatcgtggcatcagttaacatggtgtctcgcctgttgctgaaccggtttactatgacccacagacgtcccacaatcgaaaaggacgtcgatctcggtgccgggacgaggcatgtgaatgctgagccggagacccctaacatggacgtaattggagaacggataaaacgcatcaaggaggaacacaatagtacttggcactacgacgatgagaacccatataaaacatgggcgtaccatggctcgtatgaagtgaaggccaccggcagcgcatcctctatgattaatggggttgtcaagcttctgactaaaccctgggacgtggtgcctatggtcacacagatggctatgaccgatacaactccattcggacagcaacgagtttttaaggagaaagtggacaccagaacgcccaggtcaatgccgggtacccggcgcgtaatggagatcacagccgaatggttatggagaactctgggcaggaacaagaaacctcgattgtgcacccgggaggaattcacaaagaaggtgcgtactaatgcagccatgggggctgtctttaccgaggaaaaccagtgggatagcgccaaagcggcagtggaggacgaggatttctggaagctcgttgacagagaacgcgagctgcacaaactaggaaagtgtggctcctgcgtgtacaatatgatgggtaaaagggaaaagaaacttggggagtttggaaaggccaagggcagtcgggctatttggtacatgtggctgggcgccagatatctcgagttcgaagcactggggtttttgaacgaggatcattggttctctcgcgaaaatagctactcaggagtcgagggtgaaggcctgcacaaactcgggtatatccttagggacatatccaagatccccggaggcgctatgtacgccgatgacacggctggttgggacacacgaattaccgaggatgacctgcataacgaggaaaaaatcactcagcagatggatccagagcaccggcaattagccaatgcaatttttaagctgacatatcagaacaaagtggtaaaggttcagagacctacccccactgggaccgtgatggacatcataagtaggaaggatcagcgcggaagcggccaagtcggcacatacgggttgaatacgttcaccaacatggaagcgcagctcattcgtcagatggagggagaaggtgtgctgtctaaagccgacctagagaacccacaccttcccgagaagaaaatcactcagtggctggaaacaaagggcgtggagcggctcaaaagaatggctatctccggggatgactgcgtcgttaagcctattgatgacaggtttgccaatgcactgttggctttaaacgatatgggaaaggtgcgcaaagacataccacaatggcagccgtcaaagggctggcatgattggcagcaggtacccttctgtagccaccatttccacgaactgatcatgaaagacggtcgaaagctcgtggtcccttgccggccacaagacgagcttattgggagagccaggatctcgcagggagcaggctggtctctgcgcgaaaccgcctgtctaggcaaagcgtatgctcagatgtggagtctgatgtactttcacagacgggatctcaggttggcctccaatgcaatttgcagcgccgtgcccgttcattgggtgcctacttcacgtacaacctggtccatccacgctcatcaccaatggatgacgacagaggacatgctgaccgtctggaaccgagtgtggatagaggataatccatggatggaagacaagactcccgtaaccacatgggagaacgttccttaccttgggaagcgcgaagatcagtggtgtggatctctgatcggtctcactagcagagccacctgggcacagaatattccgacagctatccagcaagtgcggagtttaattggcaacgaggagttcctggactatatgccatccatgaaaaggtttcgcaaggaagaggaaagcgagggggccatctggtga

SEQ ID NO: 15475 - RNA, 9873 nt, synthetic construct
  misc_feature 1..9873: note = derived and/or modified CDS sequence (opt3) from DENV-3__EU529684__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagaaactagccactgctatcgccggtgcatgggagaatggcgtttgtgggatacggagcaccacacgaatggaaaacctcctgtggaagcagatcgctaatgagcttaactatattttgtgggaaaataacatcaaactgacggtggtggtaggagacattatcggcgtcctcgagcaggggaagcgcaccctgactccacagcctatggagttaaaatactcatggaagacatggggaaaggccaaaatagtgaccgcggaaacacaaaacagttccttcattatcgatggccccaatactccagagtgccccagcgcctctagagcttggaacgtttgggaagtggaggactatggttttggggtcttcaccacgaatatttggctgaagcttagggaagtgtacacacagttgtgtgaccaccggctcatgtcagcagccgttaaagatgagcgcgctgtgcacgccgacatgggatactggatcgagagtcagaagaacggcagctggaaactggaaaaggcatccctaatagaggtaaagacctgcacttggcctaaatctcataccctgtggtcgaatggtgtcctcgaaagcgatatgatcattccaaagtccctggcgggcccgatctcacagcacaactatagacccgggtaccatacacaaactgccggaccttggcaccttggcaaattggagctggactttaattattgcgaggggaccacagtggtgattacggaaaactgtggaaccaggggcccaagtttacgtactacaaccgtctctggtaagctcatccacgagtggtgctgtcggagctgcactctgccccctcttcgatacatgggggaagatggatgttggtatggcatggagataagaccaatttccgaaaaagaggagaatatggttaagtcactggtgagcgctggttctggcgaagtagacaacttcacaatgggggtgttgtgcctcgccatcctgtttgaggaagtcatgaggggaaagttcggcaaaaagcatatgatcgcaggggtgttctttaccttcgttctactgctctccggacagattacgtggcgcgatatggctcacactctgatcatgattggcagtaatgccagcgaccggatgggtatgggggtgacctaccttgcattgatagccacatttaaaatccagcccttcctggctttaggatttttcctcagaaagctgacctctagggagaaccttctgctaggcgtcggcctcgcgatggccactacactgcaattgccggaagatattgagcagatggcaaatgggatcgctctgggattaatggccctcaaactgattacccagtttgagacatatcagctttggactgccctgatctccttgacctgttcaaacacgatattcacactcaccgtggcttggcgcactgcaaccctgatcctagccggtgttagtctgcttcctgtgtgccaaagctcgtccatgcgaaagacagactggctcccaatgactgtcgcggctatgggcgtaccccctctgcccttgtttattttctctctgaaggataccttaaaacggcgtagctggccactcaatgaaggggtgatggccgttggactggtgtcaatccttgcaagttccctgttgagaaacgacgtccctatggccggccccctcgtggctggtgggctgctaattgcatgttacgtaatcacgggaacatctgccgatctgaccgtggagaaggcggctgacgtcacttgggaagaggaagccgagcagacaggcgttagccataaccttatgataaccgtggacgatgacggcactatgaggattaaagatgacgagacagaaaatatcctcaccgtgctgttgaagacggcattactgatcgtctccgggatttttccatactcaataccggccactctcctggtgtggcacacctggcagaaacagacacaacgcagcggagttctttgggatgtacctagtcccccagagacccagaaggctgaactggaggagggtgtgtatcggatcaaacagcagggcattttcgggaagacacaagtcggagtgggcgttcagaaggaaggtgtgtttcatactatgtggcacgtcaccagaggggccgtgttgacgtacaacggaaaaaggctagagcccaattgggcatctgtaaagaaagacctgatctcctatggcggcgggtggcgactcagcgctcagtggcaaaagggagaagaggtccaggtgattgccgttgaacctggtaaaaacccaaagaatttccagacaatgcccggcactttccagaccacaaccggggagatcggagcgatagccctggattttaagcctggcacttcgggttcaccgatcattaaccgcgaggggaaaatcgtgggactttacggcaatggcgtcgtgaccaagaacgggggatatgtttctggtattgcacaaacaaatgctgaaccagacggccccacgcctgagttagaagaggaaatgttcaaaaagcggaacctgactatcatggatctccacccagggagtggaaaaaccagaaagtacttgcccgccatagtgagggaggctattaagcgtcgcctgcggacactcatcctggcacctaccagagtcgtggccgccgagatggaagaggctcttaaaggcctgccgatcaggtatcagactacagcgaccaagtccgaacatacgggtcgagagattgtagacttgatgtgccacgcaacttttacaatgcggctactgagccccgtgcgcgttccaaattacaacctcatcataatggatgaagcccatttcaccgaccctgcttctattgccgcaagagggtacatcagcaccagggtcggaatgggcgaggccgctgcgatttttatgactgccacacccccaggcaccgcagatgctttccctcagtccaatgcccccatccaggacgaggaacgggacataccagagcgatcatggaacagtgggaatgaatggattacagattttgcaggaaaaactgtgtggttcgtgccgagcatcaaggccggtaacgacatcgctaactgtttaagaaaaaatggcaagaaggtcattcaactgtctcgcaaaacgtttgataccgagtatcagaagacaaaacttaacgactgggatttcgtagtgactaccgacatctccgagatgggggccaattttaaggcggatagggttattgaccctcgtcggtgcctgaaacccgtgatactcacagatggaccagaaagagtcatcttggcaggccccatgcctgtgaccgccgcttcagccgctcagaggcgcggtcgagttgggagaaacccacagaaggagaatgaccaatacattttcactggccagcccctgaacaatgatgaagaccacgcacattggacggaggccaagatgctcctggacaacatcaatacccctgaaggaatcattccggctcttttcgagccagagcgggaaaaaagtgccgcaatagatggcgagtataggctaaagggggaaagccgcaaaacatttgtggagctgatgcgtagaggagacttgcccgtctggttagcgcacaaggtggcctccgaaggtatcaaatacactgatcggaagtggtgcttcgacggccagaggaacaatcagattctggaggagaacatggatgtagaaatctggaccaaagagggggaaaagaagaaactccgccctcgatggctggacgctagaacatattctgatccccttgccctgaaggagtttaaagacttcgcagctggacggaagtcgattgccctcgatttggtgaccgaaatcggcagggttccaactcacctggcacatcgcacaagaacggccctagacaatctggtcatgctccacaccagcgagcatggtgggaaagcttacaggcacgcggtggaggaacttcctgagactatggaaacactgttattgctgggcctcatgatactgcttaccggaggcgccatgctgtttctcatctcagggaagggaattggtaagacctccatcggcttgatttgtgtgatcgcaagttctgggatgctgtggatggctgagatacccttacaatggattgccagcgccatcgtcctagagttctttatgatggttctgctcattccagaacctgagaaacagcggacaccgcaggataaccaacttgcatatgtggtaatcggaatactgactttggctgccatcattgcggctaatgaaatgggcctgctcgagacgaccaagcgtgacctgggtatgtccaaagaacccggggtggtctcaccaacatcttaccttgatgtggacctccaccctgccagcgcatggactctgtacgccgttgctaccacagtgatcacccccatgttgcgccatactattgagaacagtacggcaaatgtctccctggccgcgatcgctaaccaggccgtagtgttaatgggcctagacaagggatggccaataagcaaaatggatctgggcgttcctctccttgcactggggtgctattctcaggtgaaccccttgacactgaccgccgctgtcctcctgcttattactcactacgccatcatcggaccgggcttacaggcaaaggctacccgagaggcccaaaagagaacagcggccggtattatgaaaaatccaactgtggacgggatcatgaccatagatctggaccctgtcatttatgattcaaagttcgaaaaacagctcggacaggtgatgttgctggttctatgtgcagtgcagctgctccttatgaggacatcctgggctctgtgcgaggccttgacgctggcaaccggccccatcactacactctgggaaggtagtccaggcaagttttggaacaccactattgctgtaagcatggccaatatcttccgggggtcgtacctggccggagcgggcttagctttttctataatgaaatccgtggggacaggaaagcgcggcaccggtagccaaggggagacgcttggagaaaagtggaaaaagaaactgaaccagctctcaagaaaggagttcgacctatataaaaagagtggcatcaccgaggtcgataggacagaagcaaaagagggtctgaagcggggcgaaattactcatcacgccgtttctcgagggtccgctaagttgcagtggtttgtggagagaaatatggtcatccccgaaggacgcgtgattgacctgggctgtgggaggggaggctggagctactattgcgccggtctcaaaaaggtaaccgaggtgcgggggtacacaaaaggaggccctggccatgaggaaccggttcccatgtcaacttacgggtggaacatcgtgaagcttatgagtggaaaagatgtcttctatctgccacctgagaagtgtgacaccttgctgtgcgatattggtgaaagctccccctctcctacagtggaggagagccgtaccatcagagtcctcaagatggtggaaccatggttaaaaaataaccagttctgtataaaggttctgaatccctacatgcctactgtaattgagcaccttgaaaggctgcaacgcaaacacggcgggatgctagtgcggaacccactctcccgaaattcaacgcatgagatgtattggatctctaacggaacaggcaatatcgtcgcaagtgtgaacatggtttcgagactgttgctgaataggtttaccatgactcaccgccggcccaccattgaaaaggacgtggatctcggtgccgggacaagacatgtcaacgctgagccggagacgcctaacatggacgtgataggagaacgtatcaaaaggattaaggacgagcacaatagcacctggcactacgatgacgaaaacccatataagacttgggcgtaccatggctcctatgaggtaaaagccacaggctctgcatcaagcatgatcaatggggtggttaagcttctgaccaaaccctgggatgtcgtgcctatggtgactcagatggctatgacagacaccacaccattcggacagcaacgggtctttaaggaaaaagttgatactcgcaccccccgatccatgccgggtacgagaagggtgatgggcattaccgccgagtggttatggcggacactggggcgcaacaagaagcctagattgtgcactagggaggaattcaccaaaaaggtacgaacaaatgcagccatgggagctgtgtttactgaggaaaaccagtgggacagtgccaaagcggcagtcgaggatgaagacttctggaagctcgtggatcgggagcgtgagctgcacaaactaggcaagtgtggttcttgcgtttacaatatgatggggaaaagagaaaagaagcttggagagtttggcaaagccaagggcagccgcgctatctggtacatgtggctgggggccaggtatctcgaattcgaggcactgggatttttgaacgaggaccattggttctcacgggaaaattcctacagtggtgtggagggcgaagggctgcacaaactcggatatatacttagagatatcagcaagattcccggcggtgctatgtacgccgacgacaccgctgggtgggatacgcgcatcacagaggacgatctgcataacgaagagaaaattacccagcagatggacccagagcacaggcaattagccaatgcaatctttaagctgacttatcagaacaaggtcgtgaaagtacagcgacctacacccaccggaactgttatggatataatttctcggaaggaccagagaggctccggccaagtggggacctacggattgaatacattcacgaacatggaagcgcagctcatcaggcagatggagggtgaaggcgtcctgtcaaaagccgatctagagaatccacaccttcccgaaaagaaaatcacccagtggctggagactaagggggtggagcgcctcaagcgtatggctattagcggagacgattgcgtggtcaaacctatagacgatcggtttgccaacgcactgttggctttaaacgacatgggcaaggttagaaaagatatcccacaatggcagccgtcgaagggttggcatgactggcagcaggtgcccttctgttctcaccatttccacgaactgattatgaaagacgggaggaagctcgtagtgccttgccgcccacaagatgagcttatcggacgagcccggattagtcagggcgcaggctggtccctgagagaaacagcctgtctagggaaggcgtatgctcagatgtggagcctgatgtactttcacaggcgcgacctcagattggcctcaaatgcaatctgctccgccgtccccgtgcattgggttcctacctctcggactacatggagcatacacgctcatcaccaatggatgaccacggaggatatgctgacagtgtggaacagggtctggatcgaagacaatccatggatggaggataaaacccccgtgactacctgggagaacgtaccttaccttggaaagcgtgaagaccagtggtgtggtagtctgattggcctcacatcccgagccacttgggcacagaatatcccgaccgctattcagcaagttcgcagcttaatcgggaacgaggaattcctggattatatgccatctatgaaaagatttcggaaggaggaggaatcagagggagccatttggtga

SEQ ID NO: 15476 - RNA, 9873 nt, synthetic construct
  misc_feature 1..9873: note = derived and/or modified CDS sequence (opt3) from DENV-3__FJ182015__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtacctggccggagcgggcttagctttttctatcatgaagtccgtcgggactggaaaaagaggcacaggtagccaaggggagacccttggagaaaagtggaagaaaaagctgaatcagctctcaaggaaagagttcgacctatataagaaaagtggcataacggaggttgatcggaccgaagcaaaggagggtctgaaacgaggcgaaatcacacatcacgccgtgtctagagggtccgctaagttgcagtggtttgtcgagcgcaacatggtgattcccgaaggaagggtaatcgacctgggctgtgggcggggaggctggagctactattgcgccggtctcaagaaagtgactgaggttcgtgggtacaccaagggaggccctggccatgaggaaccggtgcccatgtcaacatacgggtggaatattgtcaaacttatgagtggaaaggatgtgttctatctgccacctgagaaatgtgacactttgctgtgcgatatcggtgaaagctccccctctcctaccgtcgaggagagcagaacaattagggtgctcaagatggttgaaccatggttaaagaacaatcagttctgtatcaaagtactgaacccctacatgcctaccgtgatagagcaccttgaacgcctgcaacggaagcacggcgggatgctagtccgaaatccactctccagaaactcaactcatgagatgtattggatttctaatggaacgggcaacatcgtggcaagtgttaatatggtgtcgaggctgttgctgaaccgctttacaatgacccaccggagacccactatcgaaaaagacgtcgatctcggtgccgggacccgtcatgtgaacgctgagccggagacacctaatatggacgtaattggagaaaggataaagcggatcaaagaggaacacaacagcacgtggcactacgacgatgagaatccatataagacctgggcgtaccatggctcctatgaagtgaaggccactggctctgcatcaagcatgattaacggggttgtcaaacttctgacaaagccctgggacgtggtgcctatggtcacccagatggctatgactgatacaaccccattcggacagcaacgcgtttttaaagagaaggtggacacacgaactcccagatccatgccgggtaccaggcgggtaatgggcatcacggccgagtggttatggcgcaccctggggagaaataaaaagcctaggttgtgcacacgagaagagttcactaagaaagtgcggaccaacgcagccatgggagctgtctttacagaagagaatcagtgggatagtgccaaggcggcagtggaagacgaggatttctggaaactcgttgaccgtgagagagaactgcacaagctaggcaaatgtggttcttgcgtgtacaacatgatggggaagcgcgagaagaaacttggagaatttggcaaagccaaaggcagcagggctatttggtacatgtggctgggggcccggtatctcgagttcgaggcactgggatttttgaatgaagatcattggttctcaagagagaactcctacagtggtgtcgaaggcgaggggctgcacaagctcggatatatccttcgcgacataagcaaaatccccggcggtgctatgtacgccgatgacactgctgggtgggacaccaggattacggaagatgacctgcataatgaggagaagatcacacagcagatggatccagaacaccgacaattagccaacgcaatttttaaactgacctatcagaataaggtggtaaaggttcagcggcctactcccacaggaaccgtgatggacatcatatctagaaaagatcagaggggctccggccaagtcgggacttacggattgaacaccttcacaaatatggaggcgcagctcattcgccagatggaaggtgagggcgtgctgtcaaaggccgacctagaaaacccacaccttcccgagaaaaagatcacgcagtggctggagaccaaaggggtggaacgtctcaagcggatggctatcagcggagatgactgcgtcgttaagcctattgatgacagatttgccaacgcactgttggctttaaatgatatgggcaaagtgaggaaggacataccacaatggcagccgtcgaaaggttggcatgattggcagcaggtacccttctgttctcaccatttccacgagctgatcatgaaggacgggcgcaaactcgtggtcccttgccgaccacaagacgaacttattggacgggccagaatcagtcagggcgcaggctggtccctgagggagactgcctgtctagggaaggcgtatgctcagatgtggagcctgatgtactttcaccgcagagatctccggttggcctcaaacgcaatttgctccgccgtgcccgttcattgggtgcctacatctaggaccacttggagcatccacgctcatcaccaatggatgacaaccgaagacatgctgacggtctggaatcgtgtgtggatagaggataacccatggatggaggacaagacacccgtaaccacttgggaaaatgttccttaccttggaaaacgagaggatcagtggtgtggtagtctgatcggcctcacctcccgcgccacatgggcacagaacattccgactgctatccagcaagtgaggagcttaattgggaatgaagagttcctggactatatgccatctatgaagcggtttaggaaagaggaagagtcagaaggagccatctggtga

SEQ ID NO: 15477 - RNA, 9873 nt, synthetic construct
  misc_feature 1..9873: note = derived and/or modified CDS sequence (opt3) from DENV-3__EU569688__SS-prME
  source 1..9873: mol_type = other RNA
accagcctgtgcctcatgatgatccttcccgcagctctggcattccacttgacctccagggacggagagcctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagctgagccggaagacatcgattgctggtgtaacctgaccagtacatgggttacctatgggacttgcaatcaggccggagagcaccgccgagacaagcgtagcgtggcacttgcaccacatgtcggcatgggtctggatacaagaacccagacgtggatgtccgctgagggggcatggagacaggtggaaaaagtcgagacttgggccttgcggcaccctggattcaccattctcgctctgtttctggcccattacatcggcacatctctcactcagaaggtggttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcagctggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacaccattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggaagtctacacccagttgtgtgaccaccgcctcatgtcagccgctgtgaaggatgagagagccgttcacgcagacatgggatactggattgagagtcagaaaaacggcagctggaagctggaaaaagcgtccctaatcgaggtgaagacttgcacctggcctaagtctcatacactgtggtcgaatggtgtactcgaaagcgatatgataatcccaaaatccctggccggcccgatttcacagcacaactataggcccgggtaccatactcaaaccgctggaccttggcaccttggcaagttggagctggactttaattattgcgaggggacaacggtcgtgatcaccgaaaactgtggaactcgtggcccaagtttacggacaaccactgtgtctggtaaactcattcacgagtggtgctgtcgaagctgcacactgccccctcttagatacatgggggaagatggatgttggtatggcatggagatcaggccaatatccgaaaaggaggagaatatggtcaaatcactggttagcgccggttctggcgaagtggacaacttcaccatgggggtattgtgcctcgcaattctgtttgaggaagtgatgcgcggaaagttcggcaagaaacatatgatcgctggggtcttctttacgttcgtgctactgctctccggacagatcacttggcgggatatggcccacaccctgattatgatcggcagtaatgcaagcgacagaatgggtatgggggttacataccttgccttgattgctacctttaagatacagcccttcctggcgttaggatttttcctcaggaaactgacttctcgcgagaaccttctgctaggcgtgggcctcgccatggcaacaaccctgcaattgccggaagatatcgagcagatggctaatgggattgccctgggattaatggccctcaagctgatcacacagtttgagacttatcagctttggaccgctctgatttccttgacgtgttcaaacacaatcttcaccctcactgtcgcatggcgaaccgccacactgatactagcgggtgtgagtctgcttcctgtttgccaaagctcgtccatgcggaaaactgactggctcccaatgaccgtggctgccatgggcgtaccccctctgcccttgtttatcttctctctgaaggatacgttaaagcgtagaagctggccactcaatgaaggggtaatggcagtgggactggtttcaattcttgccagttccctgttgaggaacgacgtgcctatggctggccccctcgtcgccggtgggctgctaatcgcctgttacgtgattacaggaacctctgcggatctgactgtagagaaagctgccgacgtgacatgggaagaggaagcagagcagaccggcgtcagccataaccttatgatcactgttgacgatgacggcacaatgcgcataaaggatgacgagaccgaaaatattctcacggtgctgttgaaaactgccttactgatcgtgtccgggatctttccatactcaattccggctaccctcctggtctggcacacatggcagaagcagacccaacggagcggagtgctttgggatgttcctagtcccccagagacacagaaagccgaactggaggagggtgtatatagaataaagcagcagggcatcttcgggaaaactcaagtgggagtcggcgtgcagaaggaaggtgtttttcataccatgtggcacgtgacgagaggggcagtcttgacatacaacggaaagcgactagagcccaattgggcttctgtgaaaaaggacctgatttcctatggcggcgggtggcgcctcagcgcccagtggcaaaaaggagaagaggtacaggtcatcgcggtggaacctggtaagaaccccaagaatttccagactatgcccggcaccttccagacaaccactggggagattggagccatcgcactggattttaagcctggcacctcgggttcaccgataatcaaccgggaggggaaggttgtgggactttacggcaatggcgtcgtgaccaagaacgggggatatgtttctggtattgctcaaacgaatgccgaaccagacggccccactcctgagttagaagaggaaatgttcaagaaaagaaacctgaccatcatggatctccacccagggagtggaaagacaaggaaatacttgcccgctattgtgcgtgaggcaatcaagcgccggctgagaaccctcatactggcccctactagggtcgtggccgctgagatggaagaggcgcttaagggcctgccgattcgatatcagacaaccgcaacgaaatccgaacatactggtcgggagatcgtagacttgatgtgccacgccacatttaccatgcgcctactgagccccgtgagagttccaaattacaacctcatcattatggatgaagctcatttcaccgaccctgcctctatcgcagccagggggtacataagcactcgggtcggaatgggcgaggctgcggccatttttatgacagcaacacccccaggcacagctgatgccttccctcagtccaatgcacccatccaggacgaggaacgagacattccagagagatcatggaacagtgggaatgaatggatcactgattttgccggaaagacggtgtggttcgtgccgagcataaaagctggtaacgacattgccaactgtttacgcaagaatggcaaaaaggtcatccaactgtctaggaagacctttgatacagagtatcagaaaactaaacttaacgactgggatttcgtagtgaccacagacatctccgagatgggggcgaattttaaagcagatcgtgttattgaccctcggagatgcctgaagcccgtgatcctcaccgatggaccagaaagggtcattttggccggccccatgcctgtgactgctgcctcagctgcacagcgccgaggtagagttgggcggaacccacagaaagagaatgaccaatacatattcacgggccagcccctgaacaatgatgaagaccacgcccattggaccgaggctaagatgctcctggacaacatcaatacacctgaaggaattatcccggcccttttcgagccagagagggaaaagagtgcagcgatcgatggcgagtatcgcctaaaaggggaaagccgtaagacttttgtggagctgatgagacggggagacttgcccgtctggttagcccacaaagtggcttccgaaggtattaagtacaccgataggaaatggtgcttcgacggccagcgcaacaatcagatactggaggagaacatggatgtagaaatctggacaaaggagggggagaaaaagaaactccgacctagatggctggacgcccggacctattctgatccccttgcactgaaagagtttaaggacttcgctgccggaaggaaatcgattgcactcgatttggtgactgaaatcggccgcgttccaacacacctggcccatagaacgaggaatgctctagacaacctggtcatgctccacaccagcgagcatggtgggaaggcgtaccggcacgccgtggaggaacttcctgagactatggaaacactgttattgctgggcctcatgattctgcttaccggaggcgcaatgctgtttctcatctcagggaaaggaataggtaagacctccatcggcttgatttgtgtgatcgctagttctgggatgctgtggatggccgagattcccttacaatggatcgccagcgcaatagtcctagagttctttatgatggttctgctcattccagaacctgagaagcagcgtacaccgcaggataatcaacttgcttatgtggtaatcggcattctgactttggccgcgatcatagctgccaacgaaatgggcctgctcgagacgaccaaacgcgacctgggtatgtccaaggaacccggggtggtctcaccaacatcttaccttgatgtggacctccaccctgcaagcgcctggactctgtacgctgttgcaaccacagtgatcacccccatgttgcgacatactattgagaatagtacggccaacgtctccctggcggctatcgccaaccaggcagtagtgttaatgggcctagacaaaggatggccaattagcaagatggatctgggcgttcctctccttgccctggggtgctattctcaggtgaatcccttgacactgaccgctgccgtcctcctgcttatcactcactacgcaataattggaccgggcttacaggctaaagccaccagagaggcgcaaaagaggacagccgcaggtatcatgaagaacccaactgtggacgggatcatgaccattgatctggaccctgtcatctatgattcaaaattcgaaaagcagctcggacaggtgatgttgctggttctatgtgctgtgcagctgctccttatgcggacatcctgggccctgtgcgaggcattgacgctggctaccggccccataactacactctgggaaggtagtccaggcaaattttggaataccactattgccgtaagcatggccaacatcttccgcgggtcgtacctggcgggagctggcttagcattttctattatgaagtccgtggggacaggaaaaagaggcaccggtagccaaggggagacgcttggagaaaagtggaagaaaaagctgaatcagctctcaaggaaagagttcgacctatataagaaaagtggcatcaccgaggtcgatcggacagaagccaaggagggtctgaaacgaggcgaaataactcatcacgctgtttctagagggtccgccaagttgcagtggtttgtggagcgcaacatggtcatccccgaaggaagggtgattgacctgggctgtgggcggggaggctggagctactattgcgcaggtctcaagaaagtaaccgaggtgcgtgggtacacaaagggaggccctggccatgaggaaccggttcccatgtcaacttacgggtggaatatcgtgaaacttatgagtggaaaggatgtcttctatctgccacctgagagatgtgacaccttgctgtgcgatattggtgaaagctccccctctcctacagtggaggagagcaggaccatccgcgtcctcaaaatggtggaaccatggttaaagaacaatcagttctgtattaaggttctgaacccctacatgcctactgtaatcgagcaccttgaacggctgcaacgaaaacacggcgggatgctagtgagaaatccactctccaggaactcaacgcatgagatgtattggatatctaatggaacaggcaacattgtcgccagtgtgaatatggtttcgcgcctgttgctgaaccggtttaccatgactcacagacgtcccaccatcgaaaaggacgtggatctcggtgctgggacaaggcatgtcaacgcggagccggagacgcctaatatggacgtgatcggagaacggattaaacgcataaaggaggaacacaacagcacctggcactacgacgatgagaatccatataaaacttgggcctaccatggctcctatgaagtaaaggcaacaggctctgcttcaagcatgatcaacggggtggttaaacttctgaccaaaccctgggacgtcgtgcctatggtgactcagatggccatgacagataccacaccattcggacagcaacgagtctttaaggagaaagttgacactagaacccccaggtccatgccgggtacgcggcgcgtgatgggcattaccgcagagtggttatggagaacactggggaggaataagaaacctcgattgtgcactcgggaagagttcaccaagaaggtacgtacaaacgccgctatgggagccgtgtttactgaagagaatcagtgggatagtgcgaaagcagccgtcgaagacgaggatttctggaagctcgtggacagagagcgcgaactgcacaaactaggcaagtgtggttcttgcgtttacaacatgatggggaaaagggagaagaaacttggagaatttggcaaggctaagggcagccgggccatctggtacatgtggctgggggcaagatatctcgagttcgaggctctgggatttttgaatgaagatcattggttctcacgcgagaactcctacagtggtgtggaaggcgaggggctgcacaaactcggatatattcttagggacatcagcaagatacccggcggtgccatgtacgctgatgacaccgccgggtgggacacgcgaatcacagaagatgacctgcataatgaggagaaaattacccagcagatggatccagaacaccggcaattagcaaacgcgatctttaagctgacttatcagaataaagtcgtgaaggtacagagacctacacccaccggaactgttatggacattatctctaggaaggatcagcgcggctccggccaagtggggacctacggattgaacacattcacgaatatggaggcccagctcatacgtcagatggaaggtgagggcgtcctgtcaaaagctgacctagaaaacccacaccttcccgagaagaaaattacccagtggctggagactaagggggtggaacggctcaaaagaatggccatcagcggagatgactgcgtggtcaagcctatcgatgacaggtttgcaaacgctctgttggccttaaatgatatgggcaaggttcgcaaagacattccacaatggcagccgtcgaagggttggcatgattggcaacaggtgcccttctgttctcaccatttccacgagctgataatgaaagacgggcgaaagctcgtagtgccttgccggccacaagacgaacttatcggaagggcaaggattagtcagggcgccggctggtccctgcgcgagacagcgtgtctagggaaggcttatgcccagatgtggagcctgatgtactttcacagacgggatctcaggttggcatcaaacgccatctgctccgctgtccccgtgcattgggttcctacctctcgtactacatggagcattcacgcccatcaccaatggatgaccacggaagacatgctgacagtgtggaatcgagtctggatcgaggataacccatggatggaggacaagacccccgtgactacctgggaaaatgtaccttaccttggaaagcgcgaggatcagtggtgtggtagtctgataggcctcacatccagagcaacttgggctcagaacatcccgaccgccattcagcaagttcggagcttaatcgggaatgaagagttcctggactatatgccatctatgaaaaggtttcgcaaggaggaagagtcagaaggagcgatttggtga

SEQ ID NO: 15478 - RNA, 9873 nt, synthetic construct
  misc_feature 1..9873: note = derived and/or modified CDS sequence (opt3) from DENV-3__EU529686__SS-prME
  source 1..9873: mol_type = other RNA
accagcctgtgcctcatgatgatccttccagccgctctggcattccacttgacatccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtacctggccggagcgggcttagctttttctatcatgaagtccgtcgggactggaaaaagaggcacaggtagccaaggggagacccttggagaaaagtggaagaaaaagctgaatcagctctcaaggaaagagttcgacctatataagaaaagtggcataacggaggttgatcggaccgaagcaaaggagggtctgaaacgaggcgaaatcacacatcacgccgtgtctagagggtccgctaagttgcagtggtttgtcgagcgcaacatggtgattcccgaaggaagggtaatcgacctgggctgtgggcggggaggctggagctactattgcgccggtctcaagaaagtgactgaggttcgtgggtacaccaagggaggccctggccatgaggaaccggtgcccatgtcaacatacgggtggaatattgtcaaacttatgagtggaaaggatgtgttctatctgccacctgagaaatgtgacactttgctgtgcgatatcggtgaaagctccccctctcctaccgtcgaggagagcagaacaattagggtgctcaagatggttgaaccatggttaaagaacaatcagttctgtatcaaagtactgaacccctacatgcctaccgtgatagagcaccttgaacgcctgcaacggaagcacggcgggatgctagtccgaaatccactctccagaaactcaactcatgagatgtattggatttctaatggaacgggcaacatcgtggcaagtgttaatatggtgtcgaggctgttgctgaaccgctttacaatgacccaccggagacccactatcgaaaaagacgtcgatctcggtgccgggacccgtcatgtgaacgctgagccggagacacctaatatggacgtaattggagaaaggataaagcggatcaaagaggaacacaacagcacgtggcactacgacgatgagaatccatataagacctgggcgtaccatggctcctatgaagtgaaggccactggctctgcatcaagcatgattaacggggttgtcaaacttctgacaaagccctgggacgtggtgcctatggtcacccagatggctatgactgatacaaccccattcggacagcaacgcgtttttaaagagaaggtggacacacgaactcccagatccatgccgggtaccaggcgggtaatgggcatcacggccgagtggttatggcgcaccctggggagaaataaaaagcctaggttgtgcacacgagaagagttcactaagaaagtgcggaccaacgcagccatgggagctgtctttacagaagagaatcagtgggatagtgccaaggcggcagtggaagacgagaacttctggaaactcgttgatcgtgagagagaactgcacaagctaggcaaatgtggttcttgcgtgtacaatatgatggggaagcgcgagaagaaacttggagaatttggcaaagccaaaggcagcagggctatttggtacatgtggctgggggcccggtatctcgagttcgaggcactgggatttttgaacgaagaccattggttctcaagagaaaattcctacagtggtgtcgagggcgaggggctgcacaagctcggatatatccttcgcgatataagcaaaatccccggcggtgctatgtacgccgacgatactgctgggtgggacaccaggattacggaagacgatctgcataacgaggagaagatcacacagcagatggacccagaacaccgacaattagccaatgcaatttttaaactgacctatcagaacaaggtggtaaaggttcagcggcctactcccacaggaaccgtgatggatatcatatctagaaaagaccagaggggctccggccaagtcgggacttacggattgaataccttcacaaacatggaggcgcagctcattcgccagatggaaggtgagggcgtgctgtcaaaggccgatctagaaaacagccaccttccagagaaaaagatcacgcagtggctggagaccaaaggggtggaacgtctcaagcggatggctatctcgggagacgattgcgtcgttaagcccattgacgatagatttgccaatgcactgttggctttaaacgacatgggcaaagtgaggaaggatatacctcaatggcagccatctaaaggttggcatgactggcagcaggtaccgttctgtagtcaccatttccacgagctgatcatgaaggatgggcgcaaactcgtggtcccctgccgacctcaagacgaacttattggacgggccagaatctcccagggcgcaggctggagcctgagggagactgcctgtctagggaaggcgtatgctcagatgtggtcactgatgtactttcaccgcagagacctccggttggcctccaatgcaatttgctctgccgtgccagttcattgggtgcccacaagcaggaccacttggagtatccacgctcatcaccaatggatgacaaccgaagatatgctgacggtctggaaccgtgtgtggatagaggacaatccttggatggaggataagacaccagtaaccacttgggaaaacgttccctaccttggaaaacgagaggaccagtggtgtggttccctgatcggcctcaccagccgcgccacatgggcacagaatattcctactgctatccagcaagtgagatctttaattgggaacgaagagttcctggattatatgccgtcaatgaagcggtttaggaaagaggaagagagtgaaggagccatctggtga

SEQ ID NO: 15479 - RNA, 9873 nt, synthetic construct
  misc_feature 1..9873: note = derived and/or modified CDS sequence (opt3) from DENV-3__EU529687__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgttaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaagacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaaaaggacatcccagagcgatcatggaacagtgggaatgaatggataacagattttgcaggaaaaactgtgtggttcgtcccgagcattaaggccggtaacgacatcgctaactgtttaaggaagaatggcaagaaggtaatccaactgtctcgcaaaacgtttgataccgagtatcagaagacaaaacttaacgactgggatttcgtggttactaccgacatttccgagatgggggccaattttaaggcggatagggtgatcgaccctcgtcggtgcctgaaacccgtcattctcacagatggaccagaaagagtgatattggcaggccccatgcctgttaccgccgcttcagccgctcagaggcgcggtcgagtggggagaaacccacagaaggagaatgaccaatacatcttcactggccagcccctgaacaatgatgaagaccacgcacattggacggaggccaagatgctcctggacaacattaatacccctgaaggaatcatcccggctcttttcgagccagagcgggagaaaagtgccgcaattgatggcgagtataggctaaagggggaaagccgcaaaacatttgtcgagctgatgcgtagaggagacttgcccgtgtggttagcgcacaaggtagcctccgaaggtataaaatacactgatcggaagtggtgcttcgacggccagaggaacaatcagatcctggaggagaacatggatgtggaaatttggaccaaagagggggaaaagaagaaactccgccctcgatggctggacgctagaacatattctgatccccttgccctgaaggagtttaaagacttcgcagctggacggaagtcgatcgccctcgatttggttaccgaaattggcagggtcccaagccacctggcacatcgcactagaaatgccctagacaacctggtgatgctccacacatcagagcatggtgggaaggcttacaggcacgcggtggaggaacttcctgagacgatggaaaccctgttattgctgggcctcatgatcctgcttactggaggcgccatgctgtttctcatatccgggaagggaatcggtaagacaagtattggcttgatctgtgtcattgcatctagcgggatgctgtggatggctgagatccccttacaatggatagcctccgccattgttctagagttctttatgatggtgctgctcatcccagaacctgagaaacagcggaccccgcaggataatcaacttgcatatgtagtgattggaatcctgaccttggctgccataatcgcggctaacgaaatgggcctgctcgagacaactaagcgtgacctgggtatgtcaaaagaacccggggtcgtgtctccaacgagctaccttgatgttgacctccaccctgccagtgcatggaccctgtacgccgtggctacaactgtcattacccccatgttgcgccatacaatcgaaaattccaccgcaaacgtaagcctggccgcgattgctaaccaggccgtggttttaatgggcctagacaagggatggccaatctctaaaatggatctgggcgtgcctctccttgcactggggtgctattcacaggtcaatcccttgactctgacggccgctgtgctcctgcttataacacactacgccattatcggaccgggcttacaggcaaaggctacccgagaggcccaaaagagaactgcggccggtatcatgaaaaacccaaccgtcgacgggattatgacaatcgatctggaccctgtgatatatgattccaagttcgaaaaacagctcggacaggttatgttgctggtgctatgtgcagtacagctgctccttatgaggacaagttgggctctgtgcgaggccttgaccctggcaacaggccccattacgaccctctgggaaggtagcccaggcaagttttggaatactacaatcgctgtgtcgatggccaacattttccgggggtcttacctggccggagcgggcttagctttttccatcatgaaaagcgtcgggaccggaaagcgcggcactggttcacaaggggagacacttggagaaaagtggaaaaagaaactgaatcagctcagtagaaaggagttcgacctatataaaaagtctggcataaccgaggttgataggacggaagcaaaagagggtctgaagcggggcgaaatcacccatcacgccgtgtcccgagggagcgctaagttgcagtggtttgtcgagagaaacatggtgattcccgaaggacgcgtaatcgacctgggctgtgggaggggaggctggtcatactattgcgccggtctcaaaaaggtgacagaggttcgggggtacactaaaggaggccctggccatgaggaaccggtgcccatgagtacctacgggtggaatattgtcaaacttatgagcggaaaagatgtgttctatctgccacctgagaagtgtgacacattgctgtgcgatatcggtgaatcctctcccagccctactgtcgaggagtcccgtaccattagagtgctcaagatggttgaaccatggctgaaaaacaatcagttctgtatcaaggtactaaacccctacatgcctacagtgatagagcaccttgaaaggctgcaacgcaaacacggcgggatgctagtccggaatccactctcacgaaactctacccatgagatgtattggattagtaatggaactggcaacatcgtggcatcggttaatatggtgagcagactgttgctgaacaggtttacgatgacacaccgccggcccaccatcgaaaaggacgtcgatctcggtgccgggactagacatgtgaacgctgagccggagacccctaatatggacgtaattggagaacgtataaaaaggatcaaggaggaacacaactccacatggcactacgacgatgagaatccatataagacgtgggcgtaccatggctcttatgaagtgaaagccaccggctcagcaagctccatgattaacggggttgtcaaacttctgactaaaccctgggacgtggtgcctatggtcacacagatggctatgaccgatactacaccattcggacagcaacgggtttttaaggagaaagtggacacccgcacaccccgaagtatgccgggtactagaagggtaatgggcatcaccgccgagtggttatggcggacgctggggcgcaataagaagcctagattgtgcaccagggaagagttcactaaaaaggtgcgaactaacgcagccatgggagctgtctttaccgaagagaatcagtgggattctgccaaagcggcagtggaagacgaggatttctggaagctcgttgaccgggagcgtgaactgcacaaactaggcaagtgtggtagctgcgtgtacaacatgatggggaaaagagagaagaaacttggagaatttggcaaagccaagggctcacgcgctatttggtacatgtggctgggggccaggtatctcgagttcgaggcactgggatttttgaatgaagatcattggttctcccgggagaacagttacagcggtgtcgaaggcgaggggctgcacaaactcggatatatccttagagacatatctaagatccccggcggtgctatgtacgccgatgacacagctgggtgggacactcgcattaccgaagatgacctgcataatgaggagaaaatcacgcagcagatggatccagaacacaggcaattagccaacgcaatttttaagctgacatatcagaataaggtggtaaaagttcagcgacctacccccactggaacagtgatggacatcatatcccggaaggatcagagaggctcaggccaagtcgggacctacggattgaacactttcaccaatatggaggcgcagctcattaggcagatggaaggtgagggcgtgctgagcaaagccgacctagaaaacccacaccttcccgagaagaaaatcacacagtggctggagacgaagggggtggaacgcctcaagcgtatggctatctcgggagatgactgcgtcgttaaacctattgatgaccggtttgccaacgcactgttggctttaaatgatatgggcaaggtgagaaaagacataccacaatggcagccgtctaagggttggcatgattggcagcaggtacccttctgtagtcaccatttccacgagctgatcatgaaagacgggaggaagctcgtggtcccttgccgcccacaagacgaacttattggacgagcccggatctcccagggcgcaggctggagcctgagagagaccgcctgtctagggaaggcgtatgctcagatgtggtcactgatgtactttcacaggcgcgatctcagattggcctccaacgcaatttgctctgccgtgcccgttcattgggtgcctactagccggacaacctggagtatccacgctcatcaccaatggatgactacagaagacatgctgaccgtctggaatagggtgtggatagaggataacccatggatggaggacaaaacgcccgtaacaacctgggaaaatgttccttaccttggaaagcgtgaggatcagtggtgtggttccctgatcggcctcactagccgagccacctgggcacagaacattccgacagctatccagcaagtgcgctctttaattgggaatgaagagttcctggactatatgccatcaatgaaaagatttcggaaggaggaagagagtgaaggagccatctggtga

SEQ ID NO: 15480 - RNA, 9873 nt, synthetic construct
  misc_feature 1..9873: note = derived and/or modified CDS sequence (opt3) from DENV-3__KF955449__SS-prME
  source 1..9873: mol_type = other RNA
accagcctgtgcctcatgatgatccttccagccgctctggcattccacttgacttccagggacggagaacctaggatgattgtggggaagaacgaacggggaaagtctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcgtcttactgatgcttgtgaccccatcgatgacaatgcgctgtgtaggcgttgggaacagagactttgtggaaggattgtcaggtgccacctgggtcgatgtggtgctggagcacggcgggtgcgtcacgactatggcgaagaataaacccacactagacatcgagctccagaagaccgaagcaactcagctggccacacttaggaaactgtgtattgagggaaagatcaccaacattacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccaaaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaaattcctttctccacagaggacggccaaggtaaggctcataacgggcgtcttatcactgcgaatccagtagtcaccaaaaaggaggaacccgtgaacatagaggcagaaccgcctttcggcgagtcaaatattgttatcggaatcggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattccaagaacacatcaatgagttttagctgcatcgcgattggaataatcaccctgtatttaggcgctgtcgtgcaggccgacatgggttgtgtgattaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcgaagtggacaacttcacaatgggggtcttgtgcctcgccattctgtttgaggaagtgatgcgcggaaagttcggcaagaaacatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaagatacagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaaaacagactggctcccaatgactgtagcggctatgggcgtgccccctctgcccttgtttatcttctctctgaaggataccttaaagcgtagaagctggccactcaatgaaggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgagaaagcggctgacgttacttgggaagaggaagccgagcagacaggcgtgagccataaccttatgatcaccgtggacgatgacggcactatgcgcataaaggatgacgagacagaaaatattctcaccgtcctgttgaaaacggcattactgatcgtgtccgggatctttccatactcaattccggccactctcctggtttggcacacctggcagaagcagacacaacggagcggagtactttgggatgtgcctagtcccccagagacccagaaagctgaactggaggagggtgtctatagaataaagcagcagggcatcttcgggaaaacacaagtgggagttggcgtgcagaaggaaggtgtctttcatactatgtggcacgtgaccagaggggccgtattgacgtacaacggaaagcgactagagcccaattgggcatctgtcaaaaaggacctgatttcctatggcggcgggtggcgcctcagcgctcagtggcaaaaaggagaagaggtgcaggttatcgccgtggaacctggtaagaaccccaagaatttccagacaatgcccggcactttccagaccacaaccggggagattggagcgatcgccctggattttaagcctggcacttcgggttcaccgataatcaaccgggaggggaaggtcgtgggactttacggcaatggcgttgtgaccaaaaacgggggatatgtctctggtattgcacaaacaaatgctgaaccagacggccccacgcctgagttagaagaggaaatgttcaagaaaagaaacctgactatcatggatctccacccagggagtggaaagaccaggaaatacttgcccgccattgtgcgtgaggctatcaagcgccggctgagaacactcatactggcacctaccagggtagtggccgccgagatggaagaggctcttaagggcctgccgattcgatatcagactacagcgaccaaatccgaacatacgggtcgggagatcgttgacttgatgtgccacgcaacttttacaatgcgcctactgagccccgtcagagtgccaaattacaacctcatcattatggatgaagcccatttcaccgaccctgcttctatcgccgcaagggggtacataagcacccgggtgggaatgggcgaggccgctgcgatttttatgactgccacacccccaggcaccgcagatgctttccctcagtccaatgcccccatccaggacgaggaacgagacattccagagagatcatggaacagtgggaatgaatggatcacagattttgcaggaaagactgtctggttcgtaccgagcataaaagccggtaacgacattgctaactgtttacgcaagaatggcaaaaaggtgatccaactgtctaggaagacgtttgataccgagtatcagaaaacaaaacttaacgactgggatttcgttgtgactaccgacatctccgagatgggggccaattttaaagcggatcgtgtcattgaccctcggagatgcctgaagcccgtgatcctcacagatggaccagaaagggttattttggcaggccccatgcctgtgaccgccgcttcagccgctcagcgccgaggtagagtcgggcggaacccacagaaagagaatgaccaatacatattcactggccagcccctgaacaatgatgaagaccacgcacattggacggaggccaagatgctcctggacaacatcaatacccctgaaggaattatcccggctcttttcgagccagagagggaaaagagtgccgcaatcgatggcgagtatcgcctaaaaggggaaagccgtaagacatttgtggagctgatgagacggggagacttgcccgtatggttagcgcacaaagtggcctccgaaggtattaagtacactgataggaaatggtgcttcgacggccagcgcaacaatcagatactggaggagaacatggatgttgaaatctggaccaaggagggggagaagaagaagctccgacctagatggctggacgctcggacatattctgatccccttgccctgaaagagtttaaggacttcgcagctggaaggaaatcgattgccctcgatttggtcaccgaaatcggccgcgtgccaagccacctggcacatagaactaggaatgccctagacaacctggtgatgctccacacatcagagcatggtgggaaggcttaccggcacgcggtcgaggaacttcctgagacgatggaaaccctgttattgctgggcctcatgattctgcttactggaggcgccatgctgtttctcatctccgggaaaggaataggtaagacaagtatcggcttgatttgtgttatcgcatctagcgggatgctgtggatggctgagattcccttacaatggatcgcctccgccatagtgctagagttctttatgatggtactgctcattccagaacctgagaagcagcgtaccccgcaggataatcaacttgcatatgtggtcatcggcattctgaccttggctgccatcatagcggctaacgaaatgggcctgctcgagacaactaaacgcgacctgggtatgtcaaaggaacccggggtggtttctccaacgagctaccttgatgtggacctccaccctgccagtgcatggaccctgtacgccgtcgctacaactgtaatcacccccatgttgcgacatacaattgaaaattccaccgcaaacgtgagcctggccgcgatcgctaaccaggccgttgtgttaatgggcctagacaaaggatggccaatttctaagatggatctgggcgtccctctccttgcactggggtgctattcacaggtgaatcccttgactctgacggccgctgtcctcctgcttatcacacactacgccataattggaccgggcttacaggcaaaagctaccagagaggcccaaaagaggactgcggccggtatcatgaagaacccaaccgtggacgggatcatgacaattgatctggaccctgttatctatgattccaaattcgagaagcagctcggacaggtgatgttgctggtactatgtgcagtgcagctgctccttatgcggacaagttgggctctgtgcgaggccttgaccctggcaacaggccccataacgaccctctgggaaggtagcccaggcaaattttggaatactacaattgctgtctcgatggccaacatcttccgcgggtcttacctggccggagcgggcttagctttttccattatgaaaagcgttgggaccggaaaaagaggcactggttcacaaggggagacacttggagaaaagtggaagaaaaagctgaatcagctcagtaggaaagagttcgacctatataagaaatctggcatcaccgaggtggatcggacggaagcaaaggagggtctgaaacgaggcgaaataacccatcacgccgtctccagagggagcgctaagttgcagtggtttgtggagcgcaacatggtaatccccgaaggaagggtgattgacctgggctgtgggcggggaggctggtcatactattgcgccggtctcaagaaagttacagaggtgcgtgggtacactaagggaggccctggccatgaggaaccggtccccatgagtacctacgggtggaatatcgtgaaacttatgagcggaaaggatgtcttctatctgccacctgagaaatgtgacacattgctgtgcgatattggtgaatcctctcccagccctactgtggaggagtccagaaccatcagggttctcaagatggtagaaccatggttaaagaacaatcagttctgtattaaagtgctgaacccctacatgcctacagtcatcgagcaccttgaacgcctgcaacggaagcacggcgggatgctagtgcgaaatccactctcaagaaactctacccatgagatgtattggataagtaatggaactggcaacattgttgcatcggtgaatatggtcagcaggctgttgctgaaccgctttacgatgacacaccggagacccaccatcgaaaaagacgtggatctcggtgccgggactcgtcatgtaaacgctgagccggagacccctaatatggacgtgatcggagaaaggattaagcggataaaagaggaacacaactccacatggcactacgacgatgagaatccatataagacgtgggcgtaccatggctcttatgaagttaaggccaccggctcagcaagctccatgatcaacggggtcgtgaaacttctgactaagccctgggacgtggtccctatggttacacagatggctatgaccgatactacaccattcggacagcaacgcgtgtttaaagagaaggtagacacccgaacacccagaagtatgccgggtactaggcgggtgatgggcattaccgccgagtggttatggcgcacgctggggagaaataaaaagcctaggttgtgcacccgagaagagttcacaaagaaagtccggactaacgcagccatgggagctgtgtttaccgaagagaatcagtgggattctgccaaggcggcagttgaagacgaggatttctggaaactcgtggaccgtgagagagaactgcacaagctaggcaaatgtggtagctgcgtctacaacatgatggggaagcgcgagaagaaacttggagaatttggcaaagccaaaggctcaagggctatctggtacatgtggctgggggcccggtatctcgagttcgaggcactgggatttttgaatgaagatcattggttctccagagagaacagttacagcggtgtggaaggcgaggggctgcacaagctcggatatattcttcgcgacatctctaaaatacccggcggtgctatgtacgccgatgacacagctgggtgggacactaggatcaccgaagatgacctgcataatgaggagaagattacgcagcagatggatccagaacaccgacaattagccaacgcaatctttaaactgacatatcagaataaggtagttaaggtgcagcggcctacccccactggaacagtcatggacattatctccagaaaagatcagaggggctcaggccaagtggggacctacggattgaacactttcaccaatatggaggcgcagctcatacgccagatggaaggtgagggcgtgctgagcaaggccgacctagaaaacccacaccttcccgagaaaaagattacacagtggctggagacgaaaggggtcgaacgtctcaagcggatggctatctcgggagatgactgcgttgtgaagcctatcgatgacagatttgccaacgcactgttggctttaaatgatatgggcaaagtaaggaaggacattccacaatggcagccgtctaaaggttggcatgattggcaacaggtgcccttctgtagtcaccatttccacgagctgataatgaaggacgggcgcaaactcgtcgtgccttgccgaccacaagacgaacttatcggacgggccagaatttcccagggcgcaggctggagcctgagggagaccgcctgtctagggaaggcgtatgctcagatgtggtcactgatgtactttcaccgcagagatctccggttggcctccaacgcaatctgctctgccgttcccgtgcattgggtccctactagcaggacaacctggagtattcacgctcatcaccaatggatgactacagaagacatgctgaccgtgtggaatcgtgtatggatcgaggataacccatggatggaggacaagacgcccgttacaacctgggaaaatgtgccttaccttggaaaacgagaggatcagtggtgtggttccctgataggcctcactagccgcgccacctgggcacagaacatcccgacagctattcagcaagtcagatctttaatcgggaatgaagagttcctggactatatgccatcaatgaagcggtttaggaaagaggaagagagtgaaggagccatttggtga

SEQ ID NO: 15481 - RNA, 9873 nt, synthetic construct
  misc_feature 1..9873: note = derived and/or modified CDS sequence (opt3) from DENV-3__FJ373303__SS-prME
  source 1..9873: mol_type = other RNA
accagcctgtgcctcatgatgatccttccagccgctctggcattccacttgacttccagggacggagaacctaggatgattgtggggaagaacgaacggggaaagtctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacgtgaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcgaagtggacaacttcacaatgggggtcttgtgcctcgccattctgtttgaggaagtgatgcgcggaaagttcggcaagaaacatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaagatacagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaaaacagactggctcccaatgactgtagcggctatgggcgtgccccctctgcccttgtttatcttctctctgaaggataccttaaagcgtagaagctggccactcaatgaaggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgagaaagcggctgacgttacttgggaagaggaagccgagcagacaggcgtgagccataaccttatgatcaccgtggacgatgacggcactatgcgcataaaggatgacgagacagaaaatattctcaccgtcctgttgaaaacggcattactgatcgtgtccgggatctttccatactcaattccggccactctcctggtttggcacacctggcagaagcagacacaacggagcggagtactttgggatgtgcctagtcccccagagacccagaaagctgaactggaggagggtgtctatagaataaagcagcagggcatcttcgggaaaacacaagtgggagttggcgtgcagaaggaaggtgtctttcatactatgtggcacgtgaccagaggggccgtattgacgtacaacggaaagcgactagagcccaattgggcatctgtcaaaaaggacctgatttcctatggcggcgggtggcgcctcagcgctcagtggcaaaaaggagaagaggtgcaggttatcgccgtggaacctggtaagaaccccaagaatttccagacaatgcccggcactttccagaccacaaccggggagattggagcgatcgccctggattttaagcctggcacttcgggttcaccgataatcaaccgggaggggaaggtcgtgggactttacggcaatggcgttgtgaccaaaaacgggggatatgtctctggtattgcacaaacaaatgctgaaccagacggccccacgcctgagttagaagaggaaatgttcaagaaaagaaacctgactatcatggatctccacccagggagtggaaagaccaggaaatacttgcccgccattgtgcgtgaggctatcaagcgccggctgagaacactcatactggcacctaccagggtagtggccgccgagatggaagaggctcttaagggcctgccgattcgatatcagactacagcgaccaaatccgaacatacgggtcgggagatcgttgacttgatgtgccacgcaacttttacaatgcgcctactgagccccgtcagagtgccaaattacaacctcatcattatggatgaagcccatttcaccgaccctgcttctatcgccgcaagggggtacataagcacccgggtgggaatgggcgaggccgctgcgatttttatgactgccacacccccaggcaccgcagatgctttccctcagtccaatgcccccatccaggacgaggaacgagacattccagagagatcatggaacagtgggaatgaatggatcacagattttgcaggaaagactgtctggttcgtaccgagcataaaagccggtaacgacattgctaactgtttacgcaagaatggcaaaaaggtgatccaactgtctaggaagacgtttgataccgagtatcagaaaacaaaacttaacgactgggatttcgttgtgactaccgacatctccgagatgggggccaattttaaagcggatcgtgtcattgaccctcggagatgcctgaagcccgtgatcctcacagatggaccagaaagggttattttggcaggccccatgcctgtgaccgccgcttcagccgctcagcgccgaggtagagtcgggcggaacccacagaaagagaatgaccaatacatattcactggccagcccctgaacaatgatgaagaccacgcacattggacggaggccaagatgctcctggacaacatcaatacccctgaaggaattatcccggctcttttcgagccagagagggaaaagagtgccgcaatcgatggcgagtatcgcctaaaaggggaaagccgtaagacatttgtggagctgatgagacggggagacttgcccgtatggttagcgcacaaagtggcctccgaaggtattaagtacactgataggaaatggtgcttcgacggccagcgcaacaatcagatactggaggagaacatggatgttgaaatctggaccaaggagggggagaagaagaagctccgacctagatggctggacgctcggacatattctgatccccttgccctgaaagagtttaaggacttcgcagctggaaggaaatcgattgccctcgatttggtcaccgaaatcggccgcgtgccaagccacctggcacatagaactaggaatgccctagacaacctggtgatgctccacacatcagagcatggtgggaaggcttaccggcacgcggtcgaggaacttcctgagacgatggaaaccctgttattgctgggcctcatgattctgcttactggaggcgccatgctgtttctcatctccgggaaaggaataggtaagacaagtatcggcttgatttgtgttatcgcatctagcgggatgctgtggatggctgagattcccttacaatggatcgcctccgccatagtgctagagttctttatgatggtactgctcattccagaacctgagaagcagcgtaccccgcaggataatcaacttgcatatgtggtcatcggcattctgaccttggctgccatcatagcggctaacgaaatgggcctgctcgagacaactaaacgcgacctgggtatgtcaaaggaacccggggtggtttctccaacgagctaccttgatgtggacctccaccctgccagtgcatggaccctgtacgccgtcgctacaactgtaatcacccccatgttgcgacatacaattgaaaattccaccgcaaacgtgagcctggccgcgatcgctaaccaggccgttgtgttaatgggcctagacaaaggatggccaatttctaagatggatctgggcgtccctctccttgcactggggtgctattcacaggtgaatcccttgactctgacggccgctgtcctcctgcttatcacacactacgccataattggaccgggcttacaggcaaaagctaccagagaggcccaaaagaggactgcggccggtatcatgaagaacccaaccgtggacgggatcatgacaattgatctggaccctgttatctatgattccaaattcgagaagcagctcggacaggtgatgttgctggtactatgtgcagtgcagctgctccttatgcggacaagttgggctctgtgcgaggccttgaccctggcaacaggccccataacgaccctctgggaaggtagcccaggcaaattttggaatactacaattgctgtctcgatggccaacatcttccgcgggtcttacctggccggagcgggcttagctttttccattatgaaaagcgttgggaccggaaaaagaggcactggttcacaaggggagacacttggagaaaagtggaagaaaaagctgaatcagctcagtaggaaagagttcgacctatataagaaatctggcatcaccgaggtggatcggacggaagcaaaggagggtctgaaacgaggcgaaataacccatcacgccgtctccagagggagcgctaagttgcagtggtttgtggagcgcaacatggtaatccccgaaggaagggtgattgacctgggctgtgggcggggaggctggtcatactattgcgccggtctcaagaaagttacagaggtgcgtgggtacactaagggaggccctggccatgaggaaccggtccccatgagtacctacgggtggaatgtggtcaaacttatgagcggaaaggatgtgttctatctgccacctgagaaatgtgacacattgctgtgcgatatcggtgaatcctctcccagccctactgttgaggagtccagaaccattagggtactcaagatggtggaaccatggttaaagaacaatcagttctgtatcaaagtcctgaacccctacatgcctacagtgattgagcaccttgaacgcctgcaacggaagcacggcgggatgctagttcgaaatccactctcaagaaactctacccatgagatgtattggatcagtaatggaactggcaacatagtggcatcggtcaatatggtgagcaggctgttgctgaaccgctttacgatgacacaccggagacccaccattgaaaaagacgtagatctcggtgccgggactcgtcatgtgaacgctgagccggagacccctaatatggacgttatcggagaaaggatcaagcggattaaagaggaacacaactccacatggcactacgacgatgagaatccatataagacgtgggcgtaccatggctcttatgaagtcaaggccaccggctcagcaagctccatgataaacggggtggtgaaacttctgactaagccctgggacgtcgttcctatggtgacacagatggctatgaccgatactacaccattcggacagcaacgcgtatttaaagagaaggtggacacccgaacacccagaagtatgccgggtactaggcgggtcatgggcatcaccgccgagtggttatggcgcacgctggggagaaataaaaagcctaggttgtgcacccgagaagagttcacaaagaaagtgcggactaacgcagccatgggagctgtttttaccgaagagaatcagtgggattctgccaaggcggcagtggaagacgaggatttctggaaactcgtcgaccgtgagagagaactgcacaagctaggcaaatgtggtagctgcgtgtacaacatgatggggaagcgcgagaagaaacttggagaatttggcaaagccaaaggctcaagggctatttggtacatgtggctgggggcccggtatctcgagttcgaggcactgggatttttgaatgaagatcattggttctccagagagaacagttacagcggtgtagaaggcgaggggctgcacaagctcggatatatccttcgcgacatttctaaaatccccggcggtgctatgtacgccgatgacacagctgggtgggacactaggataaccgaagatgacctgcataatgaggagaagatcacgcagcagatggatccagaacaccgacaattagccaacgcaatttttaaactgacatatcagaataaggttgtgaaggtccagcggcctacccccactggaacagtgatggacatcatttccagaaaagatcagaggggctcaggccaagtggggacctacggattgaacactttcaccaatatggaggcgcagctcatccgccagatggaaggtgagggcgtcctgagcaaggccgacctagaaaacccacaccttcccgagaaaaagataacacagtggctggagacgaaaggggttgaacgtctcaagcggatggctatttcgggagatgactgcgtggtaaagcctatcgatgacagatttgccaacgcactgttggctttaaatgatatgggcaaagtgaggaaggacatcccacaatggcagccgtctaaaggttggcatgattggcagcaggtccccttctgtagtcaccatttccacgagctgattatgaaggacgggcgcaaactcgtggttccttgccgaccacaagacgaacttataggacgggccagaatctcccagggcgcaggctggagcctgagggagaccgcctgtctagggaaggcgtatgctcagatgtggtcactgatgtactttcaccgcagagatctccggttggcctccaacgcaatttgctctgccgtgcccgtccattgggtgcctactagcaggacaacctggagtatccacgctcatcaccaatggatgactacagaagacatgctgaccgtatggaatcgtgtttggattgaggataacccatggatggaggacaagacgcccgtgacaacctgggaaaatgtcccttaccttggaaaacgagaggatcagtggtgtggttccctgatcggcctcactagccgcgccacctgggcacagaacataccgacagctatccagcaagtgagatctttaattgggaatgaagagttcctggactatatgccatcaatgaagcggtttaggaaagaggaagagagtgaaggagccatctggtga

SEQ ID NO: 15482 - RNA, 9873 nt, synthetic construct
  misc_feature 1..9873: note = derived and/or modified CDS sequence (opt3) from DENV-3__KF955451__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggagttggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattccaagaacacatcaatgagttttagctgcatcgcgattggaataatcaccctgtatttaggcgtcgtggtgcaggctgacatgggttgtgtcattaattggaaagggaaggagctgaagtgcggatccggcatcttcgttactaacgaggtgcatacatggaccgaacagtacaaatttcaagccgattctcccaagcggctagcaactgccattgctggtgcctgggagaatggcgtgtgtgggatccgaagcaccacacgcatggaaaacctcctgtggaaacagatagcaaatgagcttaactatatcttgtgggaaaataacattaagctgacggtagtcgtgggagacatcattggcgttctcgagcaggggaaaagaaccctgactccacagcctatggagttaaagtactcatggaaaacatggggaaaggctaagatcgtgaccgccgaaacacaaaacagttccttcataattgatggccccaatactccagagtgccccagcgcgtctagggcctggaacgtctgggaagtggaggactatggttttggggttttcaccacgaatatctggctgaaacttcgggaagtgtacacacagttgtgtgaccaccgcctcatgtcagctgcagtaaaggatgagagagccgtccacgctgacatgggatactggattgagagtcagaaaaacggcagctggaagctggaaaaagcctccctaatcgaggtgaagacctgcacttggcctaagtctcataccctgtggtcgaatggtgtgctcgaaagcgatatgataatcccaaaatccctggcaggcccgatttcacagcacaactataggcccgggtaccatacacaaactgcgggaccttggcaccttggcaagttggagctggactttaattattgcgaggggaccacagtcgttatcacggaaaactgtggaacccgtggcccaagtttacggactacaaccgtgtctggtaaactcattcacgagtggtgctgtcgaagctgcactctgccccctcttagatacatgggggaagatggatgttggtatggcatggagatcaggccaatatccgaaaaggaggagaatatggtaaaatcactggtgagcgccggttctggcgaagtcgacaacttcacaatgggggtgttgtgcctcgctattctgtttgaggaagttatgcgcggaaagttcggcaagaaacatatgatcgccggggtgttctttaccttcgtcctactgctctccggacagatcacgtggcgggatatggcacacactctgattatgatcggcagtaatgctagcgacagaatgggtatgggggtgacctaccttgccttgattgcaacatttaagatacagcccttcctggccttaggatttttcctcaggaaactgacctctcgcgagaaccttctgctaggcgttggcctcgctatggcgactacactgcaattgccggaagatgtggagcagatggccaatgggatcgcactgggattaatggctctcaagctgattacccagtttgagacatatcagctttggactgccctgatctccttgacctgttcaaacacgattttcacactcaccgtcgcctggcgaactgctaccctgatcctagcaggtgtaagtctgcttcctgtgtgccaaagctcgtccatgcggaaaacagactggctcccaatgactgttgccgcgatgggcgtgccccctctgcccttgtttatattctctctgaaggataccttaaagcgtagaagctggccactcaatgaaggggtcatggctgtgggactggtatcaatccttgccagttccctgttgaggaacgacgtgcctatggcaggccccctcgtcgccggtgggctgctaattgcttgttacgttatcacgggaacatctgcagatctgaccgtggagaaagccgcggacgtgacttgggaagaggaagctgagcagacaggcgtcagccataaccttatgattaccgtggacgatgacggcactatgcgcatcaaggatgacgagacagaaaatatactcaccgttctgttgaaaacggccttactgattgtatccgggatctttccatactcaatcccggcaactctcctggtgtggcacacctggcagaagcagacacaacggagcggagtcctttgggatgtgcctagtcccccagagacccagaaagccgaactggaggagggtgtttatagaattaagcagcagggcatattcgggaaaacacaagtgggagtcggcgtgcagaaggaaggtgtatttcatactatgtggcacgtcaccaggggggctgtgttgacgtacaacggaaagcgactagagcccaattgggcctctgttaaaaaggacctgatctcctatggcggcgggtggcgcctcaacgcacagtggcaaaaaggagaagaggtgcaggtcattgctgtggaacctggtaagaatccaaaaaacttccagacaatgcccggcactttccagaccacaaccggggagatcggagccattgcgctggattttaagcctggcactagcggttcgccgatcataaatcgggaggggaaggttgtgggactttacggcaacggcgtcgtgaccaaaaatgggggatatgtatcaggtatcgcccaaacaaacgcagaaccagacggccccacgcctgagttagaagaggaaatgttcaagaaaagaaatctgactattatggatctccacccagggtctggaaagaccaggaaatacttgcccgctatcgtgcgtgaggccattaagcgccggctgagaacactcatcctggctcctaccagggttgtcgcagccgagatggaagaggcccttaagggcctgccgatacgatatcagactacagctaccaaaagtgaacatacgggtcgggagattgtggacttgatgtgccacgcgacttttacaatgcgcctactgtcccccgtgagagtcccaaactacaatctcatcatcatggatgaagcacatttcaccgaccctgccagcattgctgccagggggtacatctctacccgggtaggaatgggcgaggcagccgctatatttatgactgcgacacccccaggcaccgccgatgcattccctcagagcaacgctcccattcaggacgaggaacgagacatcccagagagatcctggaattcagggaacgaatggattacagattttgccggaaagactgtgtggttcgttccgagtatcaaagcaggtaacgacatagccaattgtttacgcaagaacggcaaaaaggtgattcaactgagcaggaagacgtttgataccgagtatcagaaaacaaagcttaatgactgggatttcgtcgtgactaccgacatctctgagatgggggctaactttaaagccgatcgtgttatcgaccctcggagatgcctgaagcccgtgattctcacagatggaccagaaagggtcatcttggcgggccccatgcctgtgaccgcagcctccgctgcccagcgccgaggtagagtagggcggaatccacagaaagagaacgaccaatacattttcactggccagcccctgaataacgatgaagaccacgctcattggacggaggcaaagatgctcctggacaatataaacacccctgaaggaatcattccggcccttttcgagccagagagggaaaagtcagctgccatcgatggcgagtatcgcctaaaaggggaaagtcgtaagacatttgtggagctgatgagacggggagacttgcccgtttggttagcacacaaagtcgcgagcgaaggtatcaagtacactgataggaaatggtgcttcgacggccagcgcaataaccagattctggaggagaatatggatgtggaaatatggaccaaggagggggaaaaaaagaagctccgacctagatggctggacgcccggacatattccgatccccttgctctgaaagagtttaaggacttcgccgcaggaaggaaatctatcgctctcgatttggtgaccgaaattggccgcgtcccaactcacctggcccatagaacaaggtcggcactagacaacctggttatgctccacacgagcgagcatggtgggaaggcctaccggcacgctgtggaggaacttcctgagaccatggaaactctgttattgctgggcctcatgatcctgcttacaggaggcgcgatgctgtttctcatttcagggaaaggaatcggtaagacctccataggcttgatctgtgtaattgccagttctgggatgctgtggatggcagagatccccttacaatggattgctagcgccatcgtgctagagttctttatgatggtcctgctcataccagaacctgagaagcagcgtaccccgcaggataatcaacttgcctatgtggttattggaatcctgacattggcagctattatcgccgcgaacgaaatgggcctgctcgagactacgaaacgcgacctgggtatgtccaaggaacccggggtggtctcaccaacctcttaccttgatgtagacctccaccctgctagcgcctggacactgtacgcagtggccactaccgttataacacccatgttgcgacataccatcgagaatagtactgctaacgtgtccctggcagccattgcgaaccaggctgtcgtgttaatgggcctagacaaaggatggccaatcagcaagatggatctgggcgtccctctccttgccctggggtgctattctcaggtgaatcccttgacgctgacagcagccgttctcctgcttattacccactacgctatcataggaccgggcttacaggccaaagcaactagagaggctcaaaagaggaccgccgcgggtattatgaagaacccaacagtggacgggatcatgactatcgatctggaccctgtaatttatgattcaaaattcgaaaagcagctcggacaggtgatgttgctggtcctatgtgccgttcagctgctccttatgcggacctcctgggcactgtgcgaggctttgacactggccacgggccccatcaccactctctgggaaggtagtccaggcaaattttggaatacaaccatagcagtgagcatggctaacattttccgcgggtcgtacctggccggagccggcttagcgttttctatcatgaagtccgtcgggactggaaaaagaggcacaggtagccaaggggagacccttggagaaaagtggaagaggaaactgaatcagctctcacggaaggagttcgacctatataaaaagagtggcattacggaggtggatcgaaccgaagctaaagagggtctgaagagaggcgaaatcacacatcacgcagtatctcgcgggtccgccaaattgcagtggtttgtggagaggaacatggttatacccgaaggacgggtgatcgacctgggctgtgggcgtggaggctggagctactattgcgctggtctcaagaaggtcactgaggtgagagggtacaccaaaggaggccctggccatgaggaaccggtccccatgtcaacatacgggtggaatattgtgaagcttatgagtggaaaagatgttttctatctgccacctgagaagtgtgacactttgctgtgcgatatcggtgaaagctccccctctcctaccgtagaggagagcaggacaattcgcgtgctcaaaatggtcgaaccatggttaaagaacaatcagttctgtatcaaggtgctgaacccctacatgcctaccgttattgagcaccttgaacggctgcaacgaaaacacggcgggatgctagtgagaaatccactctccaggaactcaactcatgagatgtattggatctctaatggaacgggcaacatagtcgccagtgtgaatatggtatcgcgcctgttgctgaaccggtttacaatgacccacagacgtcccactattgaaaaggacgtggatctcggtgcagggaccaggcatgttaacgccgagccggagacacctaatatggacgtcatcggagaacggatcaaacgcattaaggaggaacacaacagcacgtggcactacgacgatgagaatccatataaaacctgggcttaccatggctcctatgaagtgaaggcgactggctctgcctcaagcatgataaacggggtggtcaagcttctgacaaaaccctgggacgttgtgcctatggtaacccagatggcaatgactgatacaaccccattcggacagcaacgagtgtttaaggagaaagtcgacacaagaactcccaggccgatgcctggtacccggcgcgtgatgggcatcacggctgagtggttatggagaaccctggggaggaataagaaaccccgattgtgcacacgggaagagttcactaagaaggttcgtaccaacgccgcaatgggagccgtgtttacagaagagaatcagtgggattccgctaaagccgcggtcgaagacgaggatttctggaagctcgtggacagagagcgcgaactgcacaaactaggcaagtgtggtagttgcgtatacaacatgatggggaaaagggagaagaaacttggagaatttggcaaggcaaagggctctcgggccatttggtacatgtggctgggggctagatatctcgagttcgaggccctgggatttttgaatgaagatcattggttcagccgcgagaactcatactccggtgttgaaggcgaggggctgcacaaactcggatatatccttagggacattagtaagatcccaggcggtgcaatgtacgctgatgacactgccgggtgggacacccgaataacggaagatgacctgcataatgaggagaaaatcacacagcagatggatcctgaacaccggcaattagctaacgccatttttaagctgacctatcagaataaagtggtcaaggtgcagagacccactccaacaggaaccgtgatggacatcattagcaggaaggatcagcgcggctctggccaagtcgggacttacggattgaacaccttcacaaatatggaggcacagctcatccgtcagatggaaggtgagggcgttctgtccaaagcggacctagaaaacccccacctttcagagaagaaaataacgcagtggctggagaccaagggggtggaacggctcaaaagaatggccattagcggagatgactgcgtagtgaagcctatcgatgacaggtttgctaacgccctgttggcattaaatgatatgggcaaggtccgcaaagacatcccacaatggcagccgtcgaagggttggcatgattggcagcaggtgcccttctgttctcaccatttccacgagctgattatgaaagacgggcgaaagctcgttgtgccttgccggccacaagacgaacttataggaagagctaggatcagtcagggcgccggctggtccctgcgcgagactgcatgtctagggaaagcctatgcgcagatgtggagcctgatgtactttcacagacgggatctcaggttggcttcaaacgccatttgctccgcagtccccgtgcattgggtacctacatctcgtaccacttggagcatccacgcccatcaccaatggatgacaaccgaagacatgctgacggtttggaatcgagtgtggattgaggataacccatggatggaggacaagacacccgtcaccacttgggaaaatgtgccttaccttggaaagcgcgaggatcagtggtgtggtagtctgatcggcctcacctccagagctacatgggcccagaacataccgactgcaatccagcaagttcggagcttaattgggaatgaagagttcctggactatatgccatctatgaaaaggtttcgcaaggaggaagagtcagaaggagctatctggtga

SEQ ID NO: 15483 - RNA, 9873 nt, synthetic construct
  misc_feature 1..9873: note = derived and/or modified CDS sequence (opt3) from DENV-3__KF955453__SS-prME
  source 1..9873: mol_type = other RNA
accagcctgtgcctcatgatgatccttcccgcaacactggctttccacttgacttccagggacggcgaacctaggatgattgtggggaagaacgaacggggaaaatctttactgtttaagacggcatcaggtataaatatgtgtaccctaatcgccatggatctcggcgagatgtgcgacgatacagtaacttacaaatgtccacatattaccgaagttgagccggaagacatcgattgctggtgtaacctgacaagcacctgggtgacttatgggacatgcaatcaggcgggagagcaccgccgagacaagcgtagcgtagctcttgcaccacatgtgggcatgggtctggataccagaacgcagacttggatgtccgcagagggggcctggaggcaggtcgaaaaagtggagacctgggctttgcggcaccctggattcacaattctcgcactgtttctggcccattacatcggcacttctctcacccagaaggttgtgatattcatcttactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacattgagctccagaagactgaagcgacacagctggcaacccttaggaaactgtgtatcgagggaaagattacgaacatcaccacagatagccggtgccctactcagggcgaagccgtcttgccagaggaacaggaccagaattatgtttgtaaacacacctacgtggatcgcggttgggggaacggatgcggcctcttcggcaaggggagtctggtaacatgcgctaagtttcaatgtttagagcccatagagggaaaagtggtccagtatgaaaatctgaagtacactgtgattatcaccgttcatacaggtgaccagcaccaggtgggcaacgagacccaaggggtcactgccgaaattacgcctcaggcatccacaaccgaggctactctcccagaatatggaacccttggcctggagtgctctccgcgaacaggtttggacttcaatgagatgatcctactgaccatgaaaaacaaggcctggatggtgcatagacagtggtttttcgatctccccctgccttggactagcggggcgacaacggaaaccccaacttggaataggaaagagcttctggtaacatttaagaacgcccacgccaagaagcaagaagttgtggtcttgggctcccaggagggagctatgcacaccgccctcacaggcgctactgaaatccaaaattcagggggaaccagtattttcgccggtcatctgaagtgtcggttaaaaatggacaagctggagctaaaaggcatgagctacgcaatgtgcacgaacacctttgtgctcaagaaagaggtctctgaaacacagcacgggactatactgatcaaggtggagtacaagggagaagatgttccctgtaaaattcctttctccaccgaggacggccaaggtaaggcccataacgggcgtcttatcacagctaatccagtggtaactaaaaaggaggaacccgtcaacatagaggcggaaccgcctttcggcgagtcaaatattgtgatcggaatcggcgataacgcattgaaaattaattggtataagaaggggagcagtatcggaaaaatgtttgaagccaccgctcgcggtgccagaaggatggcaattctgggcgacacggcctgggatttcgggtctgttggaggcgtgctcaactccctgggtaagatggtccaccagatatttgggagcgcttacacagcccttttctcgggcgtgtcttgggtaatgaaaatcggaattggcgtgctgttgacctggatcgggctcaattccaagaacacttcaatgagttttagctgcatcgcaattggaataatcacactgtatttaggcgcggttgtccaggctgacatgggttgtgtgattaattggaaagggaaggagctgaagtgcggatccggcatcttcgtgaccaacgaggtccatacttggaccgaacagtacaaatttcaagccgattctcccaagcggctagcaacagccattgctggtgcctgggagaatggcgtttgtgggatccgaagcacgacccgcatggaaaacctcctgtggaaacagatagcaaatgagcttaactatatcttgtgggaaaataacattaagctgactgtggtggtaggagacatcattggcgtcctcgagcaggggaaaagaacactgaccccacagcctatggagttaaagtactcatggaaaacatggggaaaggctaagatcgtgactgccgaaacccaaaacagttccttcataattgatggccccaatacgccagagtgccccagcgcgtctagggcctggaacgtttgggaagtggaggactatggttttggggtcttcacaaccaatatctggctgaaacttcgggaagtgtacactcagttgtgtgaccaccgcctcatgtcagctgcagttaaggatgagagagccgtgcacgctgacatgggatactggattgagagtcagaaaaacggcagctggaagctggaaaaagcctccctaatcgaggtaaagacctgcacatggcctaagtctcatactctgtggtcgaatggtgtcctcgaaagcgatatgataatcccaaaatccctggcaggcccgatttcacagcacaactataggcccgggtaccatacccaaacagcgggaccttggcaccttggcaagttggagctggactttaattattgcgaggggacgaccgtggtgatcactgaaaactgtggaacacgtggcccaagtttacggaccactacagtctctggtaaactcattcacgagtggtgctgtcgaagctgcaccctgccccctcttagatacatgggggaagatggatgttggtatggcatggagatcaggccaatatccgaaaaggaggagaatatggttaaatcactggtgagcgccggttctggcgaagtagacaacttcacgatgggggtgttgtgcctcgctattctgtttgaggaagtcatgcgcggaaagttcggcaagaaacatatgatcgccggggtgttctttactttcgttctactgctctccggacagatcacctggcgggatatggcacacacactgattatgatcggcagtaatgctagcgacagaatgggtatgggggtgacctaccttgccttgattgcaacttttaagatacagcccttcctggccttaggatttttcctcaggaaactgacatctcgcgagaaccttctgctaggcgtcggcctcgctatggcgaccacactgcaattgccggaagatatcgagcagatggccaatgggattgcactgggattaatggctctcaagctgatcactcagtttgagacctatcagctttggacggccctgatttccttgacatgttcaaacaccatcttcactctcaccgtggcctggcgaacagctactctgatactagccggtgttagtctgcttcctgtgtgccaaagctcgtccatgcggaaaaccgactggctcccaatgacggtcgccgcgatgggcgtaccccctctgcccttgtttatcttcaatctgaaggatacattaaagcgtagatcttggccactcaacgaaggggtgatggctgttggactggtgagcattcttgcctcaagtctgttgaggaacgacgtccctatggcaggccccctcgtggccggtgggctgctaatcgcttgttacgtaattaccggaacttccgcagatctgacagtggagaaagccgcggacgtcacctgggaagaggaagctgagcagactggcgtttctcataatcttatgatcacagtggacgatgacggcaccatgcgcataaaggatgacgagacggaaaacattctcactgtgctgttgaaaaccgccttactgatcgtcagcgggatctttccatactccattccggcaacactcctggtgtggcacacctggcagaagcagacacaacggtcaggagttctttgggatgtacctagtcccccagagactcagaaagccgaactggaggagggtgtgtatagaataaagcagcagggcatcttcgggaaaacccaagtcggagtgggcgttcagaaggaaggtgtgtttcatacgatgtggcacgtcacaagaggggctgtgttgacttacaatggaaagcgactagagcccaactgggccagtgtcaagaaggacctgatttcttatggcggcgggtggcgcctctccgcacagtggcaaaaaggagaagaggtccaggtgatcgctgttgaacctggtaagaatcccaaaaatttccagaccatgcccggcacattccagaccactaccggggagattggagccatcgcgctggattttaagcctggcacaagcggttcgccgataatcaatcgggaggggaagattgtgggactttacggcaacggcgtcgtgacgaaaaatgggggatatgtttcaggtatcgcccaaactaacgcagaaccagacggccccacccctgagttagaagaggaaatgttcaagaaaagaaatctgacaattatggatctccacccagggtctggaaagaccaggaaatacttgcccgctatcgtgcgtgaggccataaagcgccggctgagaactctcattctggctcctacaagggtcgtggcagccgagatggaagaggcccttaagggcctgccgatccgatatcagaccacggctactaaaagtgaacatacaggtcgggagatcgtagacttgatgtgccacgcgacctttaccatgcgcctactgtcccccgtgagagttccaaactacaatctcattatcatggatgaagcacatttcactgaccctgccagcatagctgccagggggtacatttctacacgggtcggaatgggcgaggcagccgctatctttatgaccgcgacacccccaggcactgccgatgcattccctcagagcaacgctcccattcaggacgaggaacgagacatcccagagagatcctggaactcagggaacgaatggataacggattttgccggaaagaccgtgtggttcgtgccgagtattaaagcaggtaacgacatcgccaattgtttacgcaagaacggcaaaaaggtcatccaactgagcaggaagacatttgatactgagtatcagaaaaccaaacttaatgactgggatttcgtagtgacaaccgacatttctgagatgggggctaactttaaagccgatcgtgttatcgaccctcggagatgcctgaagcccgtgattctcactgatggaccagaaagggtcatattggcgggccccatgcctgtgacggcagcctccgctgcccagcgccgaggtagagttgggcggaatccacagaaagagaacgaccaatacatcttcaccggccagcccctgaataacgatgaagaccacgctcattggacagaggcaaagatgctcctggacaatattaacactcctgaaggaatcatcccggcccttttcgagccagagagggaaaagtcagctgccattgatggcgagtatcgcctaaaaggggaaagtcgtaagacctttgtggagctgatgagacggggagacttgcccgtctggttagcacacaaagtggcgagcgaaggtataaagtacacagataggaaatggtgcttcgacggccagcgcaataaccagatcctggaggagaatatggatgtagaaatttggaccaaggagggggagaaaaagaagctccgacctagatggctggacgcccggacttattccgatccccttgctctgaaagagtttaaggacttcgccgcaggaaggaaatctatcgctctcgatttggtgacagaaattggccgcgttccaacgcacctggcccatagaaccaggaacgcactagacaatctggtcatgctccacacttcggagcatggtgggaaggcctaccggcacgctgtggaggaacttcctgagacaatggaaaccctgttattgctgggcctcatgatcagcctgaccggaggcgcgatgctttttctgatatcagggaaaggaatcggtaagacatccattggcctcatctgtgtgattgccagttctgggatgttgtggatggcagagatccccctgcaatggatagctagcgccattgtcttagagttctttatgatggttctactgatcccagaacctgagaagcagcgtactccgcaggataaccaactcgcctatgtggtaattggaatccttacgctggcagctataatcgccgcgaatgaaatgggcttgctggagaccacaaaacgcgacctcggtatgtccaaggaacccggggtggtctcaccaacttcttacctggatgtggaccttcaccctgctagcgcctggaccctctacgcagttgccacaaccgtgattactcccatgctgcgacatacgatcgagaacagtacagctaacgtctccttggcagccattgcgaatcaggctgtagtgctgatgggcttagacaaaggatggccaatcagcaagatggatctaggcgttcctctgctcgcccttgggtgctattctcaggtgaaccccctgaccttgactgcagccgtcctgctcctgataacccactacgctattatcggaccgggccttcaggccaaagcaacaagagaggctcaaaagaggactgccgcgggtatcatgaagaatccaaccgtggacgggattatgacaatcgatttagaccctgtcatatatgattcaaaattcgaaaagcagctgggacaggtgatgctcttggttctgtgtgccgtgcagctactgctcatgcggacgtcctgggcactttgcgaggctctgaccttggccactggccccattacaaccctgtgggaaggtagtccaggcaaattttggaacactacaatcgcagtaagcatggctaatattttccgcgggtcgtacctcgccggagccggcctggcgttttctatcatgaagtccgtggggaccggaaaaagaggcacgggtagccaaggggagaccttaggagaaaagtggaagaagaaacttaaccagctgtcaaggaaagagttcgacctctataagaaaagtggcataacagaggtcgatcggactgaagctaaagagggtctaaaacgaggcgaaatcacccatcacgcagtttctagagggtccgccaagctgcagtggtttgtggagcgcaatatggtcattcccgaaggaagggtgatcgacttgggctgtgggcggggaggctggagctactattgcgctggtctgaagaaagtaacagaggtgcgtgggtacactaagggaggccctggccatgaggaaccggttcccatgtcaacctacgggtggaacattgtgaaactcatgagtggaaaggatgtcttctatcttccacctgagaaatgtgacacactgttgtgcgatatcggtgaaagctccccctctcctaccgtggaggagagcagaactattagggtcctgaagatggtggaaccatggctcaagaataaccagttctgtatcaaagttttaaatccctacatgcctacggtaatagagcacctggaacgccttcaacggaagcacggcgggatgctggtgcgaaacccactatccagaaattcaacacatgagatgtattggatttctaacggaaccggcaatatcgtcgccagtgtgaacatggtttcgaggctcctgttgaaccgctttactatgacccaccggagacccacaatcgaaaaagacgtggatctgggtgcagggacgcgtcatgtcaatgccgagccggagacccctaacatggacgtgattggagaaaggataaagcggatcaaagaggaacacaatagcacttggcactacgacgatgagaacccatataagacatgggcttaccatggctcctatgaagtaaaggcgaccggctctgcctcaagcatgattaatggggtggttaaactccttactaagccctgggacgtcgtgcctatggtgacacagatggcaatgaccgatacaactccattcggacagcaacgcgtctttaaagagaaggttgacacccgaacgcccagatccatgccgggtaccaggcgggtgatgggcatcacagctgagtggctgtggcgcactttagggagaaacaaaaagcctaggctgtgcacccgagaagagttcacaaagaaagtacggactaatgccgcaatgggagccgtgtttaccgaagagaaccagtgggatagtgctaaggccgcggtcgaagacgaggatttctggaaattggtggaccgtgagagagaactccacaagctgggcaaatgtggttcttgcgtttacaatatgatggggaagcgcgagaaaaagctaggagaatttggcaaggcaaaaggcagcagggccatttggtacatgtggcttggggctcggtatctggagttcgaggccctcggatttctgaacgaagatcattggttctcaagagaaaattcctacagtggtgtggagggcgaggggttgcacaagctgggatatatcctccgcgacataagcaaaatccccggcggtgcaatgtacgctgatgacacggccgggtgggacacaaggattaccgaagatgaccttcataacgaggagaagatcactcagcagatggatccagaacaccgacaactggctaatgccatttttaaattaacatatcagaacaaggtcgtgaaggtacagcggcctacccccactggaaccgttatggacatcatatctagaaaagatcagaggggctccggccaagtggggacatacggactgaatacgttcaccaacatggaggcacagttgattcgccagatggaaggtgagggcgtcctctcaaaggcggacctggaaaacccacacctacccgagaaaaagatcactcagtggcttgagacaaaaggggtggaacgtctgaagcggatggccatcagcggagatgactgcgtggtcaagcctattgatgacagatttgctaatgccctcctggcattgaacgatatgggcaaagttaggaaggacataccacaatggcagccgtcgaaaggttggcatgattggcaacaggtgcccttctgttctcaccatttccacgagttaatcatgaaggacgggcgcaaactggtagtgccttgccgaccacaagacgaactcattggacgggctagaatcagtcagggcgccggctggtcccttagggagaccgcatgtctggggaaggcctatgcgcagatgtggagcctaatgtactttcaccgcagagatctgcggctcgcttcaaatgccatttgctccgcagtccccgtgcattgggttcctacttctaggacaacctggagcatccacgcccatcaccaatggatgacgacagaagacatgttgaccgtgtggaaccgtgtctggatagaggataatccatggatggaggacaagactcccgtgaccacatgggaaaacgtaccttacctgggaaaacgagaggatcagtggtgtggtagtcttatcggcctgacttcccgcgctacctgggcccagaatattccgacagcaatccagcaagttagaagcctcattgggaacgaagagttcttagactatatgccatctatgaagcggtttaggaaagaggaagagtcagaaggagctatctggtga

SEQ ID NO: 15484 - RNA, 9873 nt, synthetic construct
  misc_feature 1..9873: note = derived and/or modified CDS sequence (opt3) from DENV-3__FJ373304__SS-prME
  source 1..9873: mol_type = other RNA
accagcctgtgcctcatgatgatccttcccgccgctctggcattccacttgacctccagagacggcgagcctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaaggtcgtgcaccagatctttgggagcgcctacaccgcacttttctcgggcgtatcttgggtgatgaaaattggaatcggcgttctgttgacgtggatcgggctcaattccaagaacacatcaatgagttttagctgcattgcgataggaatcattaccctgtatttaggcgctgtcgtgcaggccgacatgggttgtgtgatcaattggaaagggaaggagctgaagtgcggatccggcattttcgtcactaacgaggttcatacatggaccgaacagtacaaatttcaagcagattctcccaagcggctagccactgctatcgccggtgcatgggagaatggcgtgtgtgggatacgaagcaccacacgcatggaaaacctcctgtggaaacagatcgctaatgagcttaactatattttgtgggaaaataacatcaagctgacggtggtagtcggagacaccattggcgtgctcgagcaggggaaaagaactctgacaccacagcctatggagttaaagtactcatggaaaacctggggaaaggccaagatcgttacagcggaaactcaaaacagttccttcataattgatggccccaataccccagagtgccccagcgcctctagggcttggaacgtgtgggaagtcgaggactatggttttggggtgttcacgacaaatatctggctgaaacttcgggaagtttacacccagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacttgcacctggcctaagtctcatacactgtggtcgaatggtgtgctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtcatcaccgaaaactgtggaactcgtggcccaagtttacggacaaccactgtttctggtaaactcattcacgagtggtgctgtcgaagctgcacactgccccctcttagatacatgggggaagatggatgttggtatggcatggagatcaggccaatatccgaaaaggaggagaatatggtgaaatcactggtaagcgctggttctggcgaagtggacaacttcaccatgggggtcttgtgcctcgccattctgtttgaggaagtgatgcgcggaaagttcggcaagaaacatatgatcgcaggggttttctttacgttcgtgctactgctctccggacagatcacttggcgggatatggctcacaccctgattatgatcggcagtaatgccagcgacagaatgggtatgggggtcacataccttgcattgattgccacctttaagatacagcccttcctggctttaggatttttcctcaggaaactgacttctcgcgagaaccttctgctaggcgtgggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgttgcttggcgaaccgcaacactgatactagccggtgtgagtctgcttcctgtctgccaaagctcgtccatgcggaaaactgactggctcccaatgaccgtagcggctatgggcgtgccccctctgcccttgtttatcttctctctgaaggatacgttaaagcgtagaagctggccactcaatgaaggggttatggccgtgggactggtctcaattcttgcaagttccctgttgaggaacgacgtgcctatggccggccccctcgtagctggtgggctgctaatcgcatgttacgtgattacaggaacctctgccgatctgactgtcgagaaagcggctgacgttacatgggaagaggaagccgagcagaccggcgtgagccataaccttatgatcactgtggacgatgacggcacaatgcgcataaaggatgacgagaccgaaaatattctcacggtcctgttgaaaactgcattactgatcgtgtccgggatctttccatactcaattccggccaccctcctggtttggcacacatggcagaagcagacccaacggagcggagtactttgggatgtgcctagtcccccagagacacagaaagctgaactggaggagggtgtctatagaataaagcagcagggcatcttcgggaaaactcaagtgggagttggcgtgcagaaggaaggtgtctttcataccatgtggcacgtgacgagaggggccgtattgacatacaacggaaagcgactagagcccaattgggcatctgtcaaaaaggacctgatttcctatggcggcgggtggcgcctcagcgctcagtggcaaaaaggagaagaggtgcaggttatcgccgtggaacctggtaagaaccccaagaatttccagactatgcccggcaccttccagacaaccactggggagattggagcgatcgccctggattttaagcctggcacctcgggttcaccgataatcaaccgggaggggaaggtcgtgggactttacggcaatggcgttgtgaccaagaacgggggatatgtctctggtattgcacaaacgaatgctgaaccagacggccccactcctgagttagaagaggaaatgttcaagaaaagaaacctgaccatcatggatctccacccagggagtggaaagacaaggaaatacttgcccgccattgtgcgtgaggctatcaagcgccggctgagaaccctcatactggcacctactagggtagtggccgccgagatggaagaggctcttaagggcctgccgattcgatatcagacaaccgcgacgaaatccgaacatactggtcgggagatcgttgacttgatgtgccacgcaacatttaccatgcgcctactgagccccgtcagagtgccaaattacaacctcatcattatggatgaagcccatttcaccgaccctgcttctatcgccgcaagggggtacataagcactcgggtgggaatgggcgaggccgctgcgatttttatgacagccacaccaccaggcacagcagatgctttccctcagtccaatgcccccatccaggacgaggaacgagacattccagagagatcatggaacagtgggaatgaatggatcactgattttgcaggaaagacggtctggttcgtaccgagcataaaagccggtaacgacattgctaactgtttacgcaagaatggcaaaaaggtgatccaactgtctaggaagacctttgatacagagtatcagaaaactaaacttaacgactgggatttcgttgtgaccacagacatctccgagatgggggccaattttaaagcggatcgtgtcattgaccctcggagatgcctgaagcccgtgatcctcaccgatggaccagaaagggttattttggcaggccccatgcctgtgactgccgcttcagccgctcagcgccgaggtagagtcgggcggaacccacagaaagagaatgaccaatacatattcacgggccagcccctgaacaatgatgaagaccacgcacattggaccgaggccaagatgctcctggacaacatcaatacacctgaaggaattatcccggctcttttcgagccagagagggaaaagagtgccgcaatcgatggcgagtatcgcctaaaaggggaaagccgtaagacttttgtggagctgatgagacggggagacttgcccgtatggttagcgcacaaagtggcctccgaaggtattaagtacaccgataggaaatggtgcttcgacggccagcgcaacaatcagatactggaggagaacatggatgttgaaatctggacaaaggagggggagaaaaagaagctccgacctagatggctggacgctcggacctattctgatccccttgccctgaaagagtttaaggacttcgcagctggaaggaaatcgattgccctcgatttggtcactgaaatcggccgcgtgccaacacacctggcacatagaacgaggaatgccctagacaacctggtgatgctccacaccagcgagcatggtgggaaggcttaccggcacgcggtcgaggaacttcctgagactatggaaacactgttattgctgggcctcatgattctgcttaccggaggcgccatgctgtttctcatctcagggaaaggaataggtaagacctccatcggcttgatttgtgttatcgcaagttctgggatgctgtggatggctgagattcccttacaatggatcgccagcgccataattctagagttctttatgatggtgctgctcatcccagaacctgagaagcagcgtacaccgcaggataatcaacttgcatatgtagtgattggaatcctgactttggctgccataatcgcggctaacgaaatgggcctgctcgagacgaccaaacgcgacctgggtatgtccaaggaacccggggtcgtgtcaccaacatcttaccttgatgttgacctccaccctgccagcgcatggactctgtacgccgtggctaccacagtcattacccccatgttgcgacatactatcgagaatagtacggcaaacgtatccctggccgcgattgctaaccaggccgtggttttaatgggcctagacaaaggatggccaatcagcaagatggatctgggcgtgcctctccttgcactggggtgctattctcaggtcaatcccttgacactgaccgccgctgtgctcctgcttataactcactacgccattatcggaccgggcttacaggcaaaagctaccagagaggcccaaaagaggacagcggccggtatcatgaagaacccaactgtcgacgggattatgaccatcgatctggaccctgtgatatatgattcaaaattcgaaaagcagctcggacaggttatgttgctggtgctatgtgcagtacagctgctccttatgcggacatcctgggctctgtgcgaggccttgacgctggcaaccggccccattactacactctgggaaggtagtccaggcaaattttggaataccactatcgctgtgagcatggccaacattttccgcgggtcgtacctggccggagcgggcttagctttttctatcatgaagtccgtcgggacaggaaaaagaggcaccggtagccaaggggagacgcttggagaaaagtggaagaaaaagctgaatcagctctcaaggaaagagttcgacctatataagaaaagtggcataaccgaggttgatcggacagaagcaaaggagggtctgaaacgaggcgaaatcactcatcacgccgtgtctagagggtccgctaagttgcagtggtttgtcgagcgcaacatggtgattcccgaaggaagggtaatcgacctgggctgtgggcggggaggctggagctactattgcgccggtctcaagaaagtgaccgaggttcgtgggtacacaaagggaggccctggccatgaggaaccggtgcccatgtcaacttacgggtggaatattgtcaaacttatgagtggaaaggatgtgttctatctgccacctgagaaatgtgacaccttgctgtgcgatatcggtgaaagctccccctctcctacagtcgaggagagcagaaccattagggtgctcaagatggttgaaccatggttaaagaacaatcagttctgtatcaaagtactgaacccctacatgcctactgtgatagagcaccttgaacgcctgcaacggaagcacggcgggatgctagtccgaaatccactctccagaaactcaacgcatgagatgtattggatttctaatggaacaggcaacatcgtggcaagtgttaatatggtgtcgaggctgttgctgaaccgctttaccatgactcaccggagacccaccatcgaaaaagacgtcgatctcggtgccgggacacgtcatgtgaacgctgagccggagacgcctaatatggacgtaattggagaaaggataaagcggatcaaagaggaacacaacagcacctggcactacgacgatgagaatccatataagacttgggcgtaccatggctcctatgaagtgaaggccacaggctctgcatcaagcatgattaacggggttgtcaaacttctgaccaagccctgggacgtggtgcctatggtcactcagatggctatgacagataccacaccattcggacagcaacgcgtttttaaagagaaggtggacactcgaacccccagatccatgccgggtacgaggcgggtaatgggcatcaccgccgagtggttatggcgcacactggggagaaataaaaagcctaggttgtgcactcgagaagagttcaccaagaaagtgcggacaaacgcagccatgggagctgtctttactgaagagaatcagtgggatagtgccaaggcggcagtggaagacgaggatttctggaaactcgttgaccgtgagagagaactgcacaagctaggcaaatgtggttcttgcgtgtacaacatgatggggaagcgcgagaagaaacttggagaatttggcaaagccaaaggcagcagggctatttggtacatgtggctgggggcccggtatctcgagttcgaggcactgggatttttgaatgaagatcattggttctcaagagagaactcctacagtggtgtcgaaggcgaggggctgcacaagctcggatatatccttcgcgacataagcaaaatccccggcggtgctatgtacgccgatgacaccgctgggtgggacacgaggattacagaagatgacctgcataatgaggagaagatcacccagcagatggatccagaacaccgacaattagccaacgcaatttttaaactgacttatcagaataaggtggtaaaggttcagcggcctacacccaccggaactgtgatggacatcatatctagaaaagatcagaggggctccggccaagtcgggacctacggattgaacacattcacgaatatggaggcgcagctcattcgccagatggaaggtgagggcgtgctgtcaaaggccgacctagaaaacccacaccttcccgagaaaaagatcacccagtggctggagactaaaggggtggaacgtctcaagcggatggctatcagcggagatgactgcgtcgttaagcctattgatgacagatttgccaacgcactgttggctttaaatgatatgggcaaagtgaggaaggacataccacaatggcagccgtcgaaaggttggcatgattggcagcaggtacccttctgttctcaccatttccacgagctgatcatgaaggacgggcgcaaactcgtggtcccttgccgaccacaagacgaacttattggacgggccagaatcagtcagggcgcaggctggtccctgagggagacagcctgtctagggaaggcgtatgctcagatgtggagcctgatgtactttcaccgcagagatctccggttggcctcaaacgcaatttgctccgccgtgcccgttcattgggtgcctacctctaggactacatggagcatccacgctcatcaccaatggatgaccacggaagacatgctgacagtctggaatcgtgtgtggatagaggataacccatggatggaggacaagacccccgtaactacctgggaaaatgttccttaccttggaaaacgagaggatcagtggtgtggtagtctgatcggcctcacatcccgcgccacttgggcacagaacattccgaccgctatccagcaagtgaggagcttaattgggaatgaagagttcctggactatatgccatctatgaagcggtttaggaaagaggaagagtcagaaggagccatctggtga

SEQ ID NO: 15485 - RNA, 9873 nt, synthetic construct
  misc_feature 1..9873: note = derived and/or modified CDS sequence (opt3) from DENV-3__EU854291__SS-prME
  source 1..9873: mol_type = other RNA
accagcctgtgcctcatgatgatccttcccgccgctctggcattccacttgacctccagggacggagaacctaggatgattgtggggaagaacgaacggggaaaatctttactgtttaagactgcctcaggtataaatatgtgtacgctaatcgcgatggatctcggcgagatgtgcgacgataccattacatacaaatgtccacatatcactgaagtagagccggaagacattgattgctggtgtaacctgaccagtacatgggttacctatgggacttgcaatcaggctggagagcaccgccgagacaagcgtagcgtggcccttgcaccccatgtaggcatgggtctggatacaagaacccagacgtggatgtccgccgagggggcttggagacaggtggaaaaagtcgagacttgggcattgcggcaccctggattcaccatcctcgccctgtttctggctcattacataggcacatctctcactcagaaggtggttatcttcattttactgatgcttgtgaccccatcgatgacaatgcgctgtgtcggcgtggggaacagagactttgtagaaggattgtcaggtgccacctgggttgatgtggtcctggagcacggcgggtgcgtgacgactatggcgaagaataaacccacactagacatcgagctccagaagaccgaagcaactcaactggccacacttaggaaactgtgtattgagggaaagatcaccaacataacgaccgatagccggtgccctacacagggcgaagctgtgttgccagaggaacaggaccagaattatgtctgtaaacacacttacgttgatcgcggttgggggaacggatgcggcctcttcggcaaggggagtctggtgacctgcgccaagtttcaatgtttagagcccattgagggaaaagtagtgcagtatgaaaatctgaagtacacagtcatcattactgtgcataccggtgaccagcaccaggttggcaacgagacacaaggggtgaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacaaaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgatcaaggtcgagtacaagggagaagatgtgccctgtaaaatacctttctccacagaggacggccaaggtaaggctcataacgggcgtcttattactgcgaatccagttgtgaccaaaaaggaggaacccgtaaacatcgaggcagaaccgcctttcggcgagtcaaatatcgtcattggaatcggcgataacgccttgaaaattaattggtataagaaggggagcagtataggaaaaatgtttgaagctacagcccgcggtgcaagaaggatggccatcctgggcgacactgcttgggatttcgggtctgtgggaggcgttctcaactccctgggtaagatggtgcaccagatttttgggagcgcctacaccgcacttttctcgggcgtctcttgggtgatgaaaatcggaatcggcgtactgttgacgtggattgggctcaattccaagaacacatcaatgagttttagctgcatagcgatcggaattatcaccctgtatttaggcgctgtggttcaggccgacatgggttgtgtcattaattggaaagggaaggagctgaagtgcggatccggcatcttcgtgactaacgaggtgcatacatggaccgaacagtacaaatttcaagcagattctcccaagcggctagccactgctatagccggtgcatgggagaatggcgtctgtgggatccgaagcaccacacgcatggaaaacctcctgtggaaacagattgctaatgagcttaactatatcttgtgggaaaataacattaagctgacggttgtggtgggagacaccatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgcctctagggcttggaacgtgtgggaagttgaggactatggttttggggtgttcacgacaaatatttggctgaaacttcgggaagtctacacccagttgtgtgaccaccgcctcatgtcagcagccgtgaaggatgagagagctgttcacgccgacatgggatactggatcgagagtcagaaaaacggcagctggaagctggaaaaagcatccctaatagaggtgaagacttgcacctggcctaagtctcatacactgtggtcgaatggtgtactcgaaagcgatatgatcattccaaaatccctggcgggcccgatctcacagcacaactataggcccgggtaccatactcaaaccgccggaccttggcaccttggcaagttggagctggactttaattattgcgaggggacaacggtcgtgattaccgaaaactgtggaactcgtggcccaagtttacggacaaccactgtgtctggtaaactcatccacgagtggtgctgtcgaagctgcacactgccccctcttagatacatgggggaagatggatgttggtatggcatggagataaggccagtctccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaagatacagcccttcctggctttaggatttttcctcaggaaactgacttctcgcgagaaccttctgctaggcgtcggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaaaactgactggctcccaatgaccgtcgcggctatgggcgtaccccctctgcccttgtttatcttctctctgaaggatacgttaaagcgtagaagctggccactcaatgaaggggtgatggccgttggactggtgtcaattcttgcaagttccctgttgaggaacgacgtccctatggccggccccctcgtggctggtgggctgctaatcgcatgttacgtaattacaggaacctctgccgatctgactgtggagaaagcggctgacgtcacatgggaagaggaagccgagcagaccggcgttagccataaccttatgatcactgtggacgatgacggcacaatgcgcataaaggatgacgagaccgaaaatattctcacggtgctgttgaaaactgcattactgatcgtctccgggatctttccatactcaattccggccaccctcctggtgtggcacacatggcagaagcagacccaacggagcggagttctttgggatgtacctagtcccccagagacacagaaagctgaactggaggagggtgtgtatagaataaagcagcagggcatcttcgggaaaactcaagtcggagtgggcgttcagaaggaaggtgtgtttcataccatgtggcacgtcacgagaggggccgtgttgacatacaacggaaagcgactagagcccaattgggcatctgtcaagaaggacctgatttcctatggcggcgggtggcgcctcagcgctcagtggcaaaaaggagaagaggtccaggtgatcgccgttgaacctggtaagaaccccaagaatttccagactatgcccggcaccttccagacaaccactggggagattggagcgatcgccctggattttaagcctggcacctcgggttcaccgataatcaaccgggaggggaaggtggtcggactttacggcaatggcgtggttaccaagaacgggggatatgtgtctggtattgcacaaacgaatgctgaaccagacggccccactcctgagttagaagaggaaatgttcaagaaaagaaacctgaccatcatggatctccacccagggagtggaaagacaaggaaatacttgcccgccattgtccgtgaggctatcaagcgccggctgagaaccctcatactggcacctactagggtggtagccgccgagatggaagaggctcttaagggcctgccgattcgatatcagacaaccgcgacgaaatccgaacatactggtcgggagatcgtggacttgatgtgccacgcaacatttaccatgcgcctactgagccccgttagagtcccaaattacaacctcatcattatggatgaagcccatttcaccgaccctgcttctatcgccgcaagggggtacataagcactcgggtgggaatgggcgaggccgctgcgatttttatgacagccacaccaccaggcacagcagatgctttccctcagtccaatgcccccatccaggacgaggaacgagacattccagagagatcatggaacagtgggaatgaatggatcactgattttgcaggaaagacggtgtggttcgtcccgagcataaaagccggtaacgacattgctaactgtttacgcaagaatggcaaaaaggtaatccaactgtctaggaagacctttgatacagagtatcagaaaactaaacttaacgactgggatttcgtggttaccacagacatctccgagatgggggccaattttaaagcggatcgtgtgattgaccctcggagatgcctgaagcccgtcatcctcaccgatggatcagaaagggtgattttggcaggcccaatgcccgttactgccgctagtgccgctcagcgccgaggtagagtggggcggaaccctcagaaagagaatgaccaatacatattcacgggccagccactgaacaatgatgaagaccacgcacattggaccgaggccaagatgctcctggacaacatcaatacacccgaaggaattatccctgctcttttcgagccggagagggaaaagagcgccgcaatcgatggcgagtatcgcctaaaaggggaatcccgtaagacttttgtcgagctgatgagacggggagacttgccagtgtggttagcgcacaaagtagcctctgaaggtattaagtacaccgataggaaatggtgcttcgacggccagcgcaacaatcagatactggaggagaacatggatgtggaaatctggacaaaggagggggagaaaaagaagctccgacccagatggctggacgctcggacctattcggatcctcttgccctgaaagagtttaaggacttcgcagctggaaggaaaagcattgccctcgatttggttactgaaatcggccgcgtccccacacacctggcacatagaacgaggaatgccctagacaacctggtgatgctccacacctcagagcatggtgggaaggcttaccggcacgcggtggaggaacttccagagactatggaaacactgttattgctgggcctcatgattctgcttaccggaggcgccatgctgtttctcatctccgggaaaggaataggtaagaccagtatcggcttgatttgtgtcatcgcatctagcgggatgctgtggatggctgagattcctttacaatggatcgcctccgccatagttctagagttctttatgatggtgctgctcattcccgaaccagagaagcagcgtacacctcaggataatcaacttgcatatgtagtgatcggcattctgactttggctgccacgatcgcggctaacgaaatgggcctgctcgagaccacaaaacgcgacctgggtatgtcaaaggaaccgggggtcgtgtctcccactagctaccttgatgttgacctccacccagccagtgcatggaccctgtacgccgtggctacaaccgtcataactcctatgttgcgacatacgatcgaaaattccacagcaaacgtaagcctggccgcgattgctaaccaggccgtggttttaatgggcctagacaaaggatggcccatctctaagatggatctgggcgtgccactccttgcactggggtgctattcacaggtcaatcctttgaccctgactgccgctgtgctcctgcttattacccactacgccatcataggacccggcttacaggcaaaagctacaagagaggcccaaaagaggactgcggccggtattatgaagaacccgaccgtcgacgggatcatgacaatcgatctggacccagtgatttatgattccaaattcgagaagcagctcggacaggttatgttgctggtgctatgtgcagtacagctgctccttatgcggacgagttgggctctgtgcgaggccttgaccctggcaactggccctatcacaaccctctgggaaggtagccccggcaaattttggaatactacaatagctgtgtcgatggccaacattttccgcgggtcttacctggccggagcgggcttagctttttccatcatgaaaagcgtcgggaccggaaaaagaggcacgggttcacaaggggagacccttggagaaaagtggaagaaaaagctgaatcagctcagtaggaaagagttcgacctatataagaaatctggcattacagaggttgatcggactgaagcaaaggagggtctgaaacgaggcgaaatcacccatcacgccgtgtccagagggagcgctaagttgcagtggtttgtcgagcgcaacatggtgataccagaaggaagggtaatcgacctgggctgtgggcggggaggctggtcatactattgcgccggtctcaagaaagtgacagaggttcgtgggtacactaagggaggccccggccatgaggaacctgtgccgatgagtacctacgggtggaatattgtcaaacttatgagcggaaaggatgtgttctatctgcccccagagaaatgtgacacattgctgtgcgatatcggtgaatcctctcctagccccaccgtcgaggagtccagaactattagggtgctcaagatggttgaaccttggttaaagaacaatcagttctgtatcaaagtactgaacccatacatgcccacggtgattgagcaccttgaacgcctgcaacggaagcacggcgggatgctagtccgaaatcctctctcaagaaactctacacatgagatgtattggatcagtaatggaaccggcaacatagtggcatcggttaatatggtgagcaggctgttgctgaaccgctttactatgacccaccggagaccaacaattgaaaaagacgtcgatctcggtgccgggacgcgtcatgtgaacgctgagcccgagaccccgaatatggacgtaatcggagaaaggatcaagcggattaaagaggaacacaactccacttggcactacgacgatgagaatccttataagacatgggcgtaccatggctcttatgaagtgaaggccaccggctcagcaagctccatgataaacggggttgtcaaacttctgactaagccatgggacgtggtgcccatggtcacacagatggctatgaccgatacaactcctttcggacagcaacgcgtttttaaagagaaggtggacacccgaacgccaagacccatgccgggtaccaggcgggtaatgggcatcacagccgagtggttatggcgcactctggggagaaataaaaagcctaggttgtgcacccgagaagagttcacaaagaaagtgcggactaacgcagccatgggagctgtctttaccgaagagaatcagtgggatagtgccaaggcggcagtggaagacgaggatttctggaaactcgttgaccgtgagagagaactgcacaagctaggcaaatgtggttcttgcgtgtacaacatgatggggaagcgcgagaagaaacttggagaatttggcaaagccaaaggcagcagggctatttggtacatgtggctgggggcccggtatctcgagttcgaggcactgggatttttgaatgaagatcattggttctcaagagagaactcctacagtggtgtcgaaggcgaggggctgcacaagctcggatatatccttcgcgacattagcaaaatccccggcggtgctatgtacgccgatgacacggctgggtgggacacaaggataaccgaagatgacctgcataatgaggagaagatcactcagcagatggatccagaacaccgacaattagccaacgcaatttttaaactgacatatcagaataaggtggtaaaggttcagcggcctacccccactggaaccgtgatggacatcatttctagaaaagatcagaggggctccggccaagtcgggacatacggattgaacacgttcaccaatatggaggcgcagctcatccgccagatggaaggtgagggcgtgctgtcaaaggccgacctagaaaacccacaccttcccgagaaaaagataactcagtggctggagacaaaaggggtggaacgtctcaagcggatggctattagcggagatgactgcgtcgttaagcctatcgatgacagatttgccaacgcactgttggctttaaatgatatgggcaaagtgaggaaggacatcccacaatggcagccgtcgaaaggttggcatgattggcagcaggtacccttctgttctcaccatttccacgagctgattatgaaggacgggcgcaaactcgtggtcccttgccgaccacaagacgaacttataggacgggccagaatcagtcagggcgcaggctggtccctgagggagaccgcctgtctagggaaggcgtatgctcagatgtggagcctgatgtactttcaccgcagagatctccggttggcctcaaacgcaatttgctccgccgtgcccgttcattgggtgcctacttctaggacaacctggagcatccacgctcatcaccaatggatgacgacagaagacatgctgaccgtctggaatcgtgtgtggattgaggataacccatggatggaggacaagactcccgtaaccacatgggaaaatgttccttaccttggaaaacgagaggatcagtggtgtggtagtctgatcggcctcacttcccgcgccacctgggcacagaacataccgacagctatccagcaagtgaggagcttaattgggaatgaagagttcctggactatatgccatctatgaagcggtttaggaaagaggaagagtcagaaggagccatctggtga

SEQ ID NO: 15486 - RNA, 9873 nt, synthetic construct
  misc_feature 1..9873: note = derived and/or modified CDS sequence (opt3) from DENV-3__KF955454__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaggcgatatgatcattccaaaaagcctggcggggccgatctcccagcacaactataggcccggataccatacacaaactgccggcccttggcaccttgggaagttggagctggactttaattattgcgagggaaccacagtggtgattacggaaaactgtggcacccgtggtccatcattacggactacaaccgtcagtgggaaactcatccacgagtggtgctgtcgatcttgcactctgccccctcttagatacatgggagaagatggctgttggtatggtatggagataaggccaattagcgaaaaggaggagaatatggttaaatccctggtgtcagctggcagcggggaagtagacaacttcacaatgggagtgttgtgcctcgccatcctgtttgaggaagtcatgcgcggcaagttcgggaagaaacatatgatcgcaggagtgttctttaccttcgttctactgctctctggccagattacgtggcgggatatggctcacactctgatcatgattggttccaatgccagtgacagaatggggatgggagtgacctaccttgcattgatagccacatttaagatccagcccttcctggctttaggctttttcctcaggaaactgaccagccgcgagaaccttctgctaggcgtcgggctcgcgatggccactacactgcaattgccggaagatattgagcagatggcaaatggaatcgctctgggtttaatggccctcaagctgattacccagtttgagacatatcagctttggactgccctgatctctttgacctgttccaacacgatattcacactcaccgtggcttggcgaactgcaaccctgatcctagccggcgtttcactgcttcctgtgtgccaaagtagctcgatgcggaaaacagactggctcccaatgactgtcgcggctatgggggtaccccctctgcccttgtttattttctccctgaaggataccttaaagcgtagatcttggccactcaatgaaggagtgatggccgttggcctggtgagcatccttgcatcaagtctgttgaggaacgacgtccctatggccggtcccctcgtggctgggggactgctaattgcatgttacgtaatcacgggcacatccgccgatctgaccgtggagaaagcggctgacgtcacttgggaagaggaagccgagcagacaggcgtttctcataaccttatgataaccgtggacgatgacgggactatgcgcattaaggatgacgagacagaaaatatcctcaccgtgctgttgaaaacggcattactgatcgtcagcggaatttttccatactccataccggccactctcctggtgtggcacacctggcagaagcagacacaacggtcaggtgttctttgggatgtacctagccccccagagacccagaaagctgaactggaggagggcgtgtatagaatcaagcagcaggggattttcggaaaaacacaagtcggcgtgggtgttcagaaggaaggggtgtttcatactatgtggcacgtcaccaggggagccgtgttgacgtacaacggcaagcgactagagcccaattgggcaagtgtaaaaaaggacctgatctcttatggcgggggatggcgcctctccgctcagtggcaaaaaggtgaagaggtccaggtgattgccgttgaacctggcaagaacccaaaaaatttccagacaatgcccgggactttccagaccacaaccggagagatcggcgcgatagccctggattttaagcctggtactagcgggtcgccgatcattaaccgggagggaaaggtggtcggcctttacggcaatggggtggttaccaaaaacggaggttatgtgtcaggcatcgcacaaacaaatgctgaaccagacgggcccacgcctgagttagaagaggaaatgttcaagaaaagaaacctgactattatggatctccacccaggatctggcaagaccaggaaatacttgcccgccatcgtccgtgaggctataaagcgccggctgagaacactcattctggcacctaccagggtggtagccgccgagatggaagaggctcttaagggtctgccgatccgatatcagactacagcgaccaaaagtgaacatacggggcgggagatcgtggacttgatgtgccacgcaacttttacaatgcgcctactgtcccccgttagagtcccaaattacaacctcattatcatggatgaagcccatttcaccgaccctgctagcatagccgcaaggggatacatttctacccgggtgggcatgggcgaggccgctgcgatctttatgactgccacacccccagggaccgcagatgctttccctcagagcaatgcccccattcaggacgaggaacgagacatcccagagagatcctggaactcaggaaatgaatggataacagattttgcaggtaagactgtgtggttcgtcccgagtattaaagccggcaacgacatcgctaactgtttacgcaagaatgggaaaaaggtaatccaactgagcaggaagacgtttgataccgagtatcagaaaacaaagcttaacgactgggatttcgtggttactaccgacatttctgagatgggagccaattttaaagcggatcgtgtgatcgaccctcggagatgcctgaagcccgtcattctcacagatggcccagaaagggtgatattggcaggtcccatgcctgttaccgccgcttccgccgctcagcgccgagggagagtgggccggaacccacagaaagagaatgaccaatacatcttcactggacagcccctgaacaatgatgaagaccacgcacattggacggaggccaagatgctcctggacaacattaatacccctgaaggcatcatcccggctcttttcgagccagagagggaaaagtcagccgcaattgatggggagtatcgcctaaaaggagaaagtcgtaagacatttctggagttgatgagacggggtgacttacccgtctggctggcgtacaaagtggccagcgaaggcataaagtatactgataggaaatggtgcttcgacgggcagcgcaacaatcagatcctcgaggagaacatggatgtagaaatttggaccaaggagggagaaaaaaagaagctgcgacctagatggcttgacgctcggacatactccgatcccctggccctcaaagagtttaaggacttcgcagctggcaggaaatctatcgccttggatctggtgaccgaaattggtcgcgttccaactcacctagcacacagaacaaggaatgccctggacaacctcgtcatgcttcatacgtcggagcacgggggcaaggcttatcggcatgcggtggaggaactgcctgagaccatggaaactttattgctgctcggactgatgatccttctgacaggcggggccatgctctttttgataagcggaaaaggtatcggcaagacctcaattgggctgatctgtgtgattgcatccagtggaatgttatggatggctgagatccccctacaatggatagcctctgccattgtcctggagttctttatgatggttctccttatcccagaacctgagaagcagcgtaccccgcaggataatcaactggcatacgtggtaattggcatcttgacactggctgccataatcgcggctaacgaaatgggtctcctggagactacgaaacgcgaccttgggatgagcaaggaacccggcgtggtctccccaacctcatacctcgatgtggacctgcaccctgcctctgcatggacattgtatgccgttgctactaccgtgattacacccatgctgcgacacaccatcgagaatagcactgcaaacgtcagtttagccgcgattgctaaccaggccgtagtgctaatgggactggacaaaggctggccaatctccaagatggatctcggggttcctcttctggcattgggatgctacagccaggtgaatcccctgacgctcacagccgctgtcctgcttttaataacccattatgccattatcggcccgggtctgcaggcaaaagctactagagaggcccaaaagaggaccgcggccgggatcatgaagaacccaacagtggacggaattatgactatcgatctcgaccctgtcatatacgattctaaattcgaaaagcagttgggccaggtgatgctgctagttctgtgtgcagtgcagctccttctgatgcggacctcatgggctttgtgcgaggccctgacactcgcaacgggtcccattaccactctgtgggaaggctccccagggaaattttggaatacaaccatcgctgtaagtatggccaacattttccgcggaagctatttagccggcgcggggcttgctttttcgatcatgaagtctgtgggaactggcaaaagaggtacagggtcccaaggagagaccctgggcgaaaagtggaagaaaaagctcaatcagctaagcaggaaagagttcgacctgtacaagaaatcaggtataacggaggtcgatcgggcagaagccaaggagggcttgaaacgaggggaaatcacccaccatgctgttagtagaggatctgccaagctgcagtggtttgtggagcgcaacatggtcattcccgaaggcagggtgatcgacctcgggtgtggacggggcggttggtcctattactgcgcagggcttaagaaagtaacagaggtgcgtggatacactaagggcggccctgggcacgaggaaccggttcccatgagcacctatggatggaatattgtgaaactgatgtcaggtaaggatgtcttctacttgccacctgagaaatgtgacacactgctctgcgatatcggcgaaagtagcccctcccctactgtggaggagtctagaaccattagggtcttaaagatggtggaaccatggctgaagaacaatcagttctgtatcaaagttcttaacccctatatgcctacagtaatagagcatctggaacgcctacaacggaagcacgggggaatgctcgtgcgaaatccactgagcagaaactccacccacgagatgtactggatttcaaatggcactggtaacatcgtcgcctctgtgaatatggttagtaggttgctgctcaaccgctttacgatgacacatcggagacccaccatcgaaaaagacgtggatcttggggctggaactcgtcacgtcaacgcggagccggagacccctaatatggacgtgattggcgaaaggataaagcggatcaaagaggaacataactcgacatggcactatgacgatgagaatccatacaagacgtgggcctatcacggcagctacgaagtaaaggcaaccgggtccgcttcttcaatgattaacggagtggttaaactgttaactaagccctgggacgtcgtgcctatggtgacacagatggccatgaccgatactacaccattcggtcagcaacgcgtctttaaagagaaggttgacacccgaacacccagaagcatgccgggcactaggcgggtgatggggatcaccgcagagtggctgtggcgcacgttgggaagaaataaaaagcctaggctctgcacccgagaagagttcacaaagaaagtacggactaacgccgctatgggcgccgtgtttaccgaagagaatcagtgggattccgcgaaggcagccgtcgaagacgaggatttctggaaactggtggaccgtgagagagaactacataagcttggtaaatgtgggagttgcgtttacaacatgatgggaaagcgcgagaaaaagctgggcgaatttggcaaggctaaagggtctagggccatttggtatatgtggctcggagcacggtacctggagttcgaggctttgggttttctgaatgaagatcactggttcagcagagagaactcatattccggcgtggaaggggagggactccataagcttggctacatcctgcgcgacataagtaaaatccccggtggggccatgtatgctgatgacacagccggatgggacactaggattaccgaagatgacttacacaatgaggagaagatcacgcagcagatggatccagaacatcgacaactggcaaacgcgatttttaaattgacataccagaataaggtcgtgaaggtacagcggcctacccccactggcacagttatggacatcataagcagaaaagatcagaggggctctgggcaagtgggaacctatggtctcaacactttcaccaatatggaggcccagctgattcgccagatggaaggcgagggggtcctatccaaggctgaccttgaaaacccacacccccctgagaaaaagatcacacagtggctggagacgaaaggagtggaacgtctcaagcggatggccatctcaggcgatgactgcgtggtcaagccaattgatgacagatttgcaaacgctctgttggccttaaatgatatgggtaaagttaggaaggacataccgcaatggcagcccagcaaagggtggcacgattggcagcaggtgcctttctgttcgcatcacttccatgagctgatcatgaaggacggacgcaaactcgtagtgccatgccgaccccaagacgaacttattggccgggcaagaatctctcagggcgccgggtggagtctgagggagaccgcgtgtctaggaaaggcttacgcccagatgtggtccctgatgtactttcaccgcagagatctccggttggcaagcaacgccatttgctcagctgtccctgtgcactgggttccaacttccaggacaacctggtctatccatgcccaccatcaatggatgactacagaagacatgctgaccgtgtggaatcgtgtctggatagaggataacccctggatggaggacaagacgcctgtgacaacctgggaaaatgtaccgtatcttggtaaacgagaggatcagtggtgtggcagcctgatcgggctcactagtcgcgcaacctgggctcagaacattccaacagccatccagcaagttagatccttaattggaaatgaagagttcctggactacatgcccagcatgaagcggtttaggaaagaggaagagtctgaaggcgcgatctggtga

SEQ ID NO: 15487 - RNA, 9873 nt, synthetic construct
  misc_feature 1..9873: note = derived and/or modified CDS sequence (opt3) from DENV-3__EU854292__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcattgggaacagagactttgtagaaggattgtcaggtgccacctgggttgatgtggtcctggagcacggcgggtgcgtgacgactatggcgaagaataaacccacactagacatcgagctccagaagaccgaagcaactcaactggccacacttaggaaactgtgtattgagggaaagatcaccaacataacgaccgatagccggtgccctacacagggcgaagctgccttgccagaggaacaggaccagaattatgtgtgtaaacacacttacgtcgatcgcggttgggggaacggatgcggcctcttcggcaaggggagtctggttacctgcgcaaagtttcaatgtttagagcccattgagggaaaagtggtacagcatgaaaatctgaagtatacagtgatcattactgtccacaccggtgaccagcatcaggtgggcaacgagacacaaggggttaccgctgaaatcactcctcaggcctccacgacagaggcgatcctcccagaatacggaacccttggcctggagtgctctccgcgaactggtttggacttcaatgagatgattctactgaccatgaaaaacaaggcctggatggtgcacagacagtggtttttcgatctccccctgccttggacaagcggggcaaccactgaaacaccaacgtggaataggaaagagcttctggtcacctttaagaacgctcacgccaaaaagcaagaagtggtagttttgggctcccaggagggagctatgcatactgccctcacaggcgcaaccgaaatacagaattcagggggaacaagtatcttcgccggtcacctgaagtgtcggttaaaaatggacaagctggagctaaaaggcatgagctatgctatgtgcactaacacctttgtgctcaagaaagaggtctctgaaacgcagcatgggaccattctgatcaaggtggagtacaagggagaagatgcgccctgtaaaatacctttctccacagaggacggccaaggtaaggcacacaacgggcgtcttattactgccaatccagtcgtgaccaaaaaggaggaacccgttaacatcgaggctgaaccgcctttcggcgagtcaaatatcgtgattggaatcggcgataacgccttgaaaattaattggtacaagaaggggagcagtataggaaaaatgtttgaagcaacagcccgcggtgctagaaggatggccatcctgggcgacactgcatgggatttcgggtctgtaggaggcgtcctcaactccctgggtaagatggtgcatcagatttttgggagcgcgtataccgctcttttctcgggcgtttcttgggtgatgaaaatcggaatcggcgtcctgttgacgtggattgggctcaattccaagaacacatcaatgagttttagctgcatagccatcggaattatcaccctgtacttaggcgcagtggtacaggccgacatgggttgtgtgattaattggaaagggaaggagctgaagtgcggatccggcatcttcgttactaacgaggtccacacatggaccgaacagtataaatttcaagctgattctcccaagcggctagccactgcaatagctggtgcctgggagaatggcgtgtgtgggatccgaagcaccacacgcatggaaaacctcctgtggaaacagattgcgaatgagcttaactacatcttgtgggaaaataacattaagctgacggtggtcgttggagacatcataggcgtgctcgagcaggggaaaagaaccctgactccacagcctatggagttaaagtattcatggaaaacatggggaaaggccaagattgtgaccgctgaaacacaaaacagttccttcatcattgatggccccaatactccagagtgccccagcgcagccagggcttggaacgtatgggaagtcgaggactacggttttggggtgttcaccacgaatatctggctgaaacttcgggaagtttatacacagttgtgtgaccaccgcctcatgtctgccgcagtgaaggatgagagagcggtccatgccgacatgggatactggatagagtcacagaaaaacggcagttggaagctggaaaaagctagcctaatcgaggtgaagacctgcacttggcctaagtcccacaccctgtggtctaatggtgttctcgaatcggatatgattatcccaaaaagcctggccggcccgatttcccagcataaccacaggcccgggtaccacacacaaactgcaggaccttggcatcttggcaagttggagctggactttaattattgcgaggggaccacagtggtaatcacggaaaactgtggaacccgtggcccatcattacggactacaaccgtcagtggtaaactcatacacgagtggtgctgtcgatcttgcactctgccccctcttagatacatgggggaagatggatgttggtatggcatggagattaggccaatcagcgaaaaggaggagaatatggtgaaatccctggtgtcagctggtagcggcaaggtcgacaacttcacaatgggggttttgtgcctcgccatcctgtttgaagaggtgatgcgcggaaagttcggcaaaaagcatatgattgcaggggtattctttaccttcgtgctactgctctctggacagatcacgtggcgggatatggcccacactctgattatgataggctccaatgctagtgacagaatgggtatgggggtcacctaccttgcgttgatcgccacatttaaaattcagcccttcctggcattaggatttttcctcaggaagctgaccagccgcgaaaaccttctgctaggcgtgggcctcgctatggccactacactgcaattgccggaggatatcgaacagatggccaatgggattgctctgggattaatggcactcaaactgatcacccagtttgagacatatcagctttggactgccctgatatctttgacctgttccaacacgatcttcacactcaccgttgcgtggcgaactgctaccctgattctagccggtgtgtcactgcttcctgtctgccaaagtagctcgatgcggaagacagactggctcccaatggcagtggccgctatgggcgttccccctctgcccttgtttatcttctgtctgaaggatactttaaaacgtagatcctggccactcaatgagggggtgatggcagtcggactggtatctattcttgccagctcactgttgaggaacgacgtgcctatggcgggccccctcgttgctggtgggctgctaatcgcctgctacgtgataaccggaacgagtgcagatctgacagtcgaaaaggccgctgacattacctgggaggaagaggccgaacagactggcgtgtcccataaccttatgatcacagtagacgatgacggcaccatgcgcatcaaagatgacgagactgagaatattctcacagtgctgttgaagaccgcattactgatagtctctgggatctttccatatagcattccggctacgctcctggtttggcacacttggcagaaacagacccaacggtccggagtgctttgggatgtgccttcacccccagaaacacagaaggccgagctggaagagggtgtctacagaatcaaacagcagggcattttcgggaagacccaagtgggagttggcgtacagaaggagggtgtgtttcacacaatgtggcatgtcactaggggggcggtgttgacctacaacggaaaacgactagaacccaattgggccagcgttaagaaagacctgatcagttatggcggcgggtggcgcctctctgcacagtggcaaaagggagaggaagtgcaggtcatagctgtggagcctggtaaaaacccaaagaatttccagacgatgcccggcacattccagactaccacaggggaaatcggagccattgctctggattttaagcctggcacctccggtagcccgatcattaaccgggaggggaaagtagtcggactttacggcaatggcgtggttactaagaacgggggatatgtgtcgggtatcgcacaaaccaatgccgagccagacggccccacacctgaattagaggaagagatgttcaaaaagagaaacctgacgataatggatctccacccagggtcaggaaaaactaggaagtacttgcccgccattgtccgtgaagctatcaagcgccggctgagaaccctcatcctggcgcctacaagggtggttgcagccgagatggaggaagctcttaaaggcctgccgattcgatatcagaccactgccacaaagtctgagcataccggtcgggaaatcgtggacttgatgtgtcacgcaacgtttactatgcgcctactgagtcccgtcagagtgccaaattacaacctcataattatggatgaggcccatttcacagaccctgcttccatcgcggccagggggtatattagcacccgggtaggaatgggcgaagcagctgccatctttatgaccgcaactcccccaggcacagccgatgctttccctcagtctaatgcccccatacaggacgaggagcgagacattccagaaagaagctggaactccgggaatgagtggatcaccgattttgcgggaaaaacagtgtggttcgttccgtcaatcaaggcaggtaacgacattgccaactgcttacgcaaaaatggcaagaaggtcatccaactgagtaggaaaacttttgatacggaataccagaagaccaaacttaacgactgggatttcgtggtgacaactgacattagcgagatgggggctaattttaaggccgatcgtgtcatagaccctcggagatgcctgaaacccgtaatcctcaccgatggaccagagagggtgattttggctggccccatgcctgttacagcagcctctgctgcccagcgccgaggtagagtggggcggaacccacacaaggaaaatgaccagtacatcttcaccggccaacccctgaacaatgatgaggaccacgcacattggactgaagcgaagatgctcctggacaacatcaatacgcctgagggaattataccggcccttttcgaaccagagagggagaaatccgctgccatcgatggcgaatatcgcctaaagggggagtcacgtaaaacctttgtcgaactgatgagacggggagacttgcccgtgtggttagcacacaaggttgctagtgagggtattaaatacacagataggaagtggtgtttcgacggccagcgcaacaatcagatcctggaagagaacatggatgtggagatttggactaaagaaggggagaagaagaaactccgacctagatggctggacgcccggacctatagcgatccccttgcactgaaggaatttaaagacttcgccgctggaaggaagtccatcgcgctcgatttggtcacagagataggccgcgtgccatctcatctggcccacagaaccaggaatgcactagacaacctggtaatgctccacacttcggaacatggtgggcgggcttaccgtcacgccgtggaggagcttcctgaaacaatggagacgctgttattgctgggcctcatgatcctgcttaccggaggcgccatgctgtttctcattagcgggaaaggaatcggtaagacttcaattggcttgatctgcgttatagcatccagtgggatgctgtggatggctgaaattcccttacagtggatcgcctctgcgattgtcctagagttctttatgatggtgctgctcatcccagagcctgaaaagcaacgcacaccgcaggataatcagcttgcttatgtggtcataggaatcctgaccttggccgcaattatcgccgctaacgagatgggcctgctcgaaaccacaaaacgagacctgggtatgagcaaggagcccggggttgtgtccccaacttcataccttgatgtagacctccatcctgcatctgcctggacgctgtatgcggtggctaccacagtcattactcccatgttgagacacaccatcgaaaatagcacagccaacgtgagtctggcagccatagctaaccaagccgttgtgttaatgggcctagacaaaggatggccaatttccaagatggatctgggcgtccctctccttgcactggggtgttacagccaggtaaatcccttgaccctgactgctgccgtgctcctgcttatcacgcattacgcgatcattggaccgggcttacaggccaaagcaacaagggaggctcagaagcggaccgccgcaggtatcatgaagaacccaactgttgacgggataatgaccattgatctggaccctgtgatctatgattctaaattcgagaagcaactcggacaggtcatgttgctggtgctatgcgctgtccagctgctccttatgcgcacatcatgggccctgtgtgaagccttgactctggcgaccggccccattacaacgctctgggagggttccccaggcaaattttggaataccactatcgctgtgagtatggcaaacatattcagagggagctacctggccggagctggcttagccttttcgatcatgaagtctgttgggacaggaaaaaggggcaccggttcccagggggaaactcttggagagaagtggaagaaaaagctgaatcaactcagccggaaagaattcgacctatataagaaatcaggcattacagaggtggatcgaaccgaggcaaaggaaggtctgaaaagaggcgagatcacgcaccacgccgtaagtcgcgggtctgctaagttgcagtggtttgtggaaaggaacatggtcattcccgagggacgggttatcgacctgggctgcgggcgtggaggctggtcctactattgtgcgggtctcaagaaagtgaccgaagtcagagggtacacaaagggaggccctggccatgaggagccggtgcccatgagcacttatgggtggaatattgtaaaacttatgtcaggaaaggatgtgttctacctgccacctgaaaaatgcgacaccttgctgtgtgatatcggtgagagtagcccctcccctacagttgaagagtctaggactatacgcgtgctcaagatggtcgagccatggttaaagaacaatcagttctgcattaaagtgctgaacccctacatgcctaccgtcatcgaacaccttgagcggctgcagcgaaagcatggcgggatgctagtgagaaatccactcagcaggaactccacacacgaaatgtattggatctcaaatggaaccggcaacattgttgcctctgtaaatatggtgagtcgcctgttgctgaaccggtttactatgacgcacagacgtcccacaatagagaaagacgtcgatctcggtgcagggaccaggcatgtgaacgctgaaccggagactcctaatatggacgttatcggagagcggattaagcgcatcaaagaagagcacaactcgacctggcattacgacgatgaaaatccatataagacatgggcctaccacggcagctatgaggtgaaggcaacgggctccgcctcttcaatgattaacggggtcgtgaaacttctgaccaagccctgggacgtagtgcctatggttactcaaatggctatgacagataccactccattcggacagcagcgagtctttaaagaaaaggtggacacaagaacccccaggagcatgccgggtacacggcgcgtgatgggcatcactgccgagtggttatggagaaccctggggaggaataaaaagcctcgattgtgtacgcgggaggaattcaccaagaaagtccgtacaaacgcggcaatgggagccgtttttactgaggaaaatcaatgggattccgctaaggccgcagtggaggacgaagatttctggaaactcgtagacagagagcgcgagctgcataagctaggcaaatgcggtagttgcgtgtacaacatgatggggaagagggaaaaaaagcttggagagtttggcaaggctaaaggctctcgggccatatggtatatgtggctgggggctagatacctcgaattcgaggccctgggatttttgaatgaggatcactggttcagccgcgaaaactcatactccggtgtcgagggcgaagggctgcacaagctcggatatatccttagggacattagtaaaatccccggcggtgcaatgtacgcggatgacaccgccgggtgggacacacgaattactgaggatgacctgcataatgaagagaagatcacccagcagatggatccagagcaccggcagttagctaacgccatatttaaactgacgtatcaaaataaggtggttaaggtgcagagacctacacccaccggaactgtcatggacattatcagcaggaaagatcagcgcggctctggccaggtggggacatacggattgaacaccttcactaatatggaagcacaactcatccgtcagatggagggtgaaggcgtactgtccaaggctgacctagagaacccacatcttcccgaaaaaaagattacccagtggctggagacaaaaggggttgagcggctcaagagaatggccatatcaggagatgactgtgtggtcaagcctatcgatgacaggtttgcaaacgccctgttggcgttaaatgatatgggcaaagtgcgcaaggacattccacagtggcaaccgagcaaaggttggcacgattggcagcaggtgcccttctgctcgcaccatttccacgaactgatcatgaaggacgggcgaaaactcgtcgttccttgtcggccacaggacgagcttattggaagagctaggatctctcaaggcgccggctggagtctgaaggaaacggcatgcctagggaaggcctatgctcagatgtggtccctgatgtactttcatcgcagagatctccggttggccagcaacgcaatatgttcagctgtgcccgtacactgggtgcctacctccaggactacatggtctatccatgcccaccaccagtggatgaccactgaggacatgctgacagtctggaatcgtgtgtggattgaagataacccatggatggaggacaaaacccccgttacgacatgggagaatgtgccttatcttggaaagcgagaagatcaatggtgcggtagcctgatcggcctcaccagtcgcgcgacttgggctcagaacattccgaccgccatccagcaggtcagatccttaattgggaatgaggaattcctggactacatgccaagcatgaaacggtttaggaaggaggaggaatctgagggagcaatatggtga

SEQ ID NO: 15488 - RNA, 9873 nt, synthetic construct
  misc_feature 1..9873: note = derived and/or modified CDS sequence (opt3) from DENV-3__FJ639746__SS-prME
  source 1..9873: mol_type = other RNA
accagcctgtgcctcatgatgatccttccagccgctctggcattccacttgacttccagagacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaagaagaagctccgacctagatggctggacgctcggacatattctgatccccttgccctgaaagagtttaaggacttcgcagctggaaggaaatcgatcgccctcgatttggttaccgaaattggccgcgtcccaagccacctggcacatagaactaggaatgccctagacaacctggtgatgctccacacatcagagcatggtgggaaggcttaccggcacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgtaccccgcaggataatcaacttgcatatgtagtgattggaatcctgaccttggctgccataatcgcggctaacgaaatgggcctgctcgagacaactaaacgcgacctgggtatgtcaaaggaacccggggtcgtgtctccaacgagctaccttgatgttgacctccaccctgccagtgcatggaccctgtacgccgtggctacaactgtcattacccccatgttgcgacatacaatcgaaaattccaccgcaaacgtaagcctggccgcgattgctaaccaggccgtggttttaatgggcctagacaaaggatggccaatctctaagatggatctgggcgtgcctctccttgcactggggtgctattcacaggtcaatcccttgactctgacggccgctgtgctcctgcttataacacactacgccattatcggaccgggcttacaggcaaaagctaccagagaggcccaaaagaggactgcggccggtatcatgaagaacccaaccgtcgacgggattatgacaatcgatctggaccctgtgatatatgattccaaattcgagaagcagctcggacaggttatgttgctggtgctatgtgcagtacagctgctccttatgcggacaagttgggctctgtgcgaggccttgaccctggcaacaggccccattacgaccctctgggaaggtagcccaggcaaattttggaatactacaatcgctgtgtcgatggccaacattttccgcgggtcttacctggccggagcgggcttagctttttccatcatgaaaagcgtcgggaccggaaaaagaggcactggttcacaaggggagacacttggagaaaagtggaagaaaaagctgaatcagctcagtaggaaagagttcgacctatataagaaatctggcataaccgaggttgatcggacggaagcaaaggagggtctgaaacgaggcgaaatcacccatcacgccgtgtccagagggagcgctaagttgcagtggtttgtcgagcgcaacatggtgattcccgaaggaagggtaatcgacctgggctgtgggcggggaggctggtcatactattgcgccggtctcaagaaagtgacagaggttcgtgggtacactaagggaggccctggccatgaggaaccggtgcccatgagtacctacgggtggaatattgtcaaacttatgagcggaaaggatgtgttctatctgccacctgagaaatgtgacacattgctgtgcgatatcggtgaatcctctcccagccctactgtcgaggagtccagaaccattagggtgctcaagatggttgaaccatggttaaagaacaatcagttctgtatcaaagtactgaacccctacatgcctacagtggtcgagcaccttgaacgcctgcaacggaagcacggcgggatgctagtgcgaaatccactctcaagaaactctacccatgagatgtattggataagtaatggaactggcaacattgttgcatcggtgaatatggtcagcaggctgttgctgaaccgctttacgatgacacaccggagacccaccatcgaaaaagacgtggatctcggtgccgggactcgtcatgtaaacgctgagccggagacccctaatatggacgtgatcggagaaaggattaagcggataaaagaggaacacaactccacatggcactacgacgatgagaatccatataagacgtgggcgtaccatggctcttatgaagttaaggccaccggctcagcaagctccatgatcaacggggtcgtgaaacttctgactaagccctgggacgtggtccctatggttacacagatggctatgaccgatactacaccattcggacagcaacgcgtgtttaaagagaaggtagacacccgaacacccagaagtatgccgggtactaggcgggtgatgggcattaccgccgagtggttatggcgcacgctggggagaaataaaaagcctaggttgtgcacccgagaagagttcacaaagaaagtccggactaacgcagccatgggagctgtgtttaccgaagagaatcagtgggattctgccaaggcggcagttgaagacgaggatttctggaaactcgtggaccgtgagagagaactgcacaagctaggcaaatgtggtagctgcgtctacaacatgatggggaagcgcgagaagaaacttggagaatttggcaaagccaaaggctcaagggctatctggtacatgtggctgggggcccggtatctcgagttcgaggcactgggatttttgaatgaagatcattggttctccagagagaacagttacagcggtgtggaaggcgaggggctgcacaagctcggatatattcttcgcgacatctctaaaatacccggcggtgctatgtacgccgatgacacagctgggtgggacactaggatcaccgaagatgacctgcataatgaggagaagattacgcagcagatggatccagaacaccgacaattagccaacgcaatctttaaactgacatatcagaataaggtagttaaggtgcagcggcctacccccactggaacagtcatggacattatctccagaaaagatcagaggggctcaggccaagtggggacctacggattgaacactttcaccaatatggaggcgcagctcatacgccagatggaaggtgagggcgtgctgagcaaggccgacctagaaaacccacgtcttcccgagaaaaagattacacagtggctggagacgaaaggggtcgaacggctcaagagaatggctatctcgggagatgactgcgttgtgaagcctatcgatgacaggtttgccaacgcactgttggctttaaatgatatgggcaaagtacgcaaggacattccacaatggcagccgtctaaaggttggcacgattggcaacaggtgcccttctgtagtcatcacttccatgagctgataatgaaggacgggcgaaaactcgtcgtgccttgccggccacaagacgaacttatcggaagggccaggatttcccagggcgcaggctggagcctgcgcgagaccgcctgtctagggaaggcgtatgctcagatgtggtcactgatgtactttcacagacgggatctcaggttggcctccaacgcaatctgctctgccgttcccgtgcactgggtccctactagccgtacaacctggagtattcatgctcaccatcaatggatgactacagaagacatgctgaccgtgtggaatcgagtatggatcgaggataacccatggatggaggacaagacgcccataacaacctgggaaaatgttccttaccttggaaaacgcgaggatcagtggtgtggttccctgatcggcctcactagcagagccacctgggcacagaacattccgacagctatccagcaagtgcggtctttaattgggaatgaagagttcctggactatatgccatcaatgaagaggtttcgcaaagaggaagagagtgaaggagccatctggtga

SEQ ID NO: 15489 - RNA, 9873 nt, synthetic construct
  misc_feature 1..9873: note = derived and/or modified CDS sequence (opt3) from DENV-3__FJ639750__SS-prME
  source 1..9873: mol_type = other RNA
accagcctgtgcctcatgatgatccttccagccgctctggcattccacttgacttccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaagaagaagctccgacctagatggctggacgctcggacatattctgatccccttgccctgaaagagtttaaggacttcgcagctggaaggaaatcgatcgccctcgatttggttaccgaaattggccgcgtcccaagccacctggcacatagaactaggaatgccctagacaacctggtgatgctccacacatcagagcatggtgggaaggcttaccggcacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgtaccccgcaggataatcaacttgcatatgtagtgattggaatcctgaccttggctgccataatcgcggctaacgaaatgggcctgctcgagacaactaaacgcgacctgggtatgtcaaaggaacccggggtcgtgtctccaacgagctaccttgatgttgacctccaccctgccagtgcatggaccctgtacgccgtggctacaactgtcattacccccatgttgcgacatacaatcgaaaattccaccgcaaacgtaagcctggccgcgattgctaaccaggccgtggttttaatgggcctagacaaaggatggccaatctctaagatggatctgggcgtgcctctccttgcactggggtgctattcacaggtcaatcccttgactctgacggccgctgtgctcctgcttataacacactacgccattatcggaccgggcttacaggcaaaagctaccagagaggcccaaaagaggactgcggccggtatcatgaagaacccaaccgtcgacgggattatgacaatcgatctggaccctgtgatatatgattccaaattcgagaagcagctcggacaggttatgttgctggtgctatgtgcagtacagctgctccttatgcggacaagttgggctctgtgcgaggccttgaccctggcaacaggccccattacgaccctctgggaaggtagcccaggcaaattttggaatactacaatcgctgtgtcgatggccaacattttccgcgggtcttacctggccggagcgggcttagctttttccatcatgaaaagcgtcgggaccggaaaaagaggcactggttcacaaggggagacacttggagaaaagtggaagaaaaagctgaatcagctcagtaggaaagagttcgacctatataagaaatctggcataaccgaggttgatcggacggaagcaaaggagggtctgaaacgaggcgaaatcacccatcacgccgtgtccagagggagcgctaagttgcagtggtttgtcgagcgcaacatggtgattcccgaaggaagggtaatcgacctgggctgtgggcggggaggctggtcatactattgcgccggtctcaagaaagtgacagaggttcgtgggtacactaagggaggccctggccatgaggaaccggtgcccatgagtacctacgggtggaatattgtcaaacttatgagcggaaaggatgtgttctatctgccacctgagaaatgtgacacattgctgtgcgatatcggtgaatcctctcccagccctactgtcgaggagtccagaaccattagggtgctcaagatggttgaaccatggttaaagaacaatcagttctgtatcaaagtactgaacccctacatgcctacagtgatagagcaccttgaacgcctgcaacggaagcacggcgggatgctagtccgaaatccactctcaagaaactctacccatgagatgtattggattagtaatggaactggcaacatcgtggcatcggttaatatggtgagcaggctgttgctgaaccgctttacgatgacacaccggagacccaccatcgaaaaagacgtcgatctcggtgccgggactcgtcatgtgaacgctgagccggagacccctaatatggacgtaattggagaaaggataaagcggatcaaagaggaacacaactccacatggcactacgacgatgagaatccatataagacgtgggcgtaccatggctcttatgaagtgaaggccaccggctcagcaagctccatgattaacggggttgtcaaacttctgactaagccctgggacgtggtgcctatggtcacacagatggctatgaccgatactacaccattcggacagcaacgcgtttttaaagagaaggtggacacccgaacacccagaagtatgccgggtactaggcgggtaatgggcatcaccgccgagtggttatggcgcacgctggggagaaataaaaagcctaggttgtgcacccgagaagagttcacaaagaaagtgcggactaacgcagccatgggagctgtctttaccgaagagaatcagtgggattctgccaaggcggcagtggaagacgaggatttctggaaactcgttgaccgtgagagagaactgcacaagctaggcaaatgtggtagctgcgtgtacaacatgatggggaagcgcgagaagaaacttggagaatttggcaaagccaaaggctcaagggctatttggtacatgtggctgggggcccggtatctcgagttcgaggcactgggatttttgaatgaagatcattggttctccagagagaacagttacagcggtgtcgaaggcgaggggctgcacaagctcggatatatccttcgcgacatatctaaaatccccggcggtgctatgtacgccgatgacacagctgggtgggacactaggattaccgaagatgacctgcataatgaggagaagatcacgcagcagatggatccagaacaccgacaattagccaacgcaatttttaaactgacatatcagaataaggtggtaaaggttcagcggcctacccccactggaacagtgatggacatcatatccagaaaagatcagaggggctcaggccaagtcgggacctacggattgaacactttcaccaatatggaggcgcagctcattcgccagatggaaggtgagggcgtgctgagcaaggccgacctagaaaacccacaccttcccgagaaaaagatcacacagtggctggagacgaaaggggtggaacgtctcaagcggatggctatctcgggagatgactgcgtcgttaagcctattgatgacagatttgccaacgcactgttggctttaaatgatatgggcaaagtgaggaaggacataccacaatggcagccgtctaaaggttggcatgattggcagcaggtacccttctgtagtcaccatttccacgagctgatcatgaaggacgggcgcaaactcgtggtcccttgccgaccacaagacgaacttattggacgggccagaatctcccagggcgcaggctggagcctgagggagaccgcctgtctagggaaggcgtatgctcagatgtggtcactgatgtactttcaccgcagagatctccggttggcctccaacgcaatttgctctgccgtgcccgttcattgggtgcctactagcaggacaacctggagtatccacgctcatcaccaatggatgactacagaagacatgctgaccgtctggaatcgtgtgtggatagaggataacccatggatggaggacaagacgcccgtaacaacctgggaaaatgttccttaccttggaaaacgagaggatcagtggtgtggttccctgatcggcctcactagccgcgccacctgggcacagaacattccgacagctatccagcaagtgagatctttaattgggaatgaagagttcctggactatatgccatcaatgaagcggtttaggaaagaggaagagagtgaaggagccatctggtga

SEQ ID NO: 15490 - RNA, 9873 nt, synthetic construct
  misc_feature 1..9873: note = derived and/or modified CDS sequence (opt3) from DENV-3__FJ639754__SS-prME
  source 1..9873: mol_type = other RNA
accagcctgtgcctcatgatgatccttccagccgctctggcattccacttgacttccagagacggcgagcctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaagccacctggcacatagaactaggaatgccctagacaacctggtgatgctccacacatcagagcatggtgggaaggcttaccggcacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgtaccccgcaggataatcaacttgcatatgtagtgattggaatcctgaccttggctgccataatcgcggctaacgaaatgggcctgctcgagacaactaaacgcgacctgggtatgtcaaaggaacccggggtcgtgtctccaacgagctaccttgatgttgacctccaccctgccagtgcatggaccctgtacgccgtggctacaactgtcattacccccatgttgcgacatacaatcgaaaattccaccgcaaacgtaagcctggccgcgattgctaaccaggccgtggttttaatgggcctagacaaaggatggccaatctctaagatggatctgggcgtgcctctccttgcactggggtgctattcacaggtcaatcccttgactctgacggccgctgtgctcctgcttataacacactacgccattatcggaccgggcttacaggcaaaagctaccagagaggcccaaaagaggactgcggccggtatcatgaagaacccaaccgtcgacgggattatgacaatcgatctggaccctgtgatatatgattccaaattcgagaagcagctcggacaggttatgttgctggtgctatgtgcagtacagctgctccttatgcggacaagttgggctctgtgcgaggccttgaccctggcaacaggccccattacgaccctctgggaaggtagcccaggcaaattttggaatactacaatcgctgtgtcgatggccaacattttccgcgggaattacctggccggagcgggcttagctttttctatcatgaagtccgtcgggaccggaaaaagaggcactggtagccaaggggagacacttggagaaaagtggaagaaaaagctgaaccagctctcaaggaaagagttcgacctatataagaaaagtggcataaccgaggttgatcggacggaagcaaaggagggtctgaaacgaggcgaaatcacccatcacgccgtgtctagagggtccgctaagttgcagtggtttgtcgagcgcaatatggtgattcccgaaggaagggtaatcgacctgggctgtgggcggggaggctggagctactattgcgccggtctcaagaaagtgacagaggttcgtgggtacactaagggaggccctggccatgaggaaccggtgcccatgtcaacctacgggtggaacattgtcaaacttatgagtggaaaggatgtgttctatctgccacctgagaaatgtgacacattgctgtgcgatatcggtgaaagctccccctctcctactgtcgaggagagcagaaccattagggtgctcaagatggttgaaccatggttaaagaataaccagttctgtatcaaagtactgaatccctacatgcctacagtgatagagcaccttgaacgcctgcaacggaagcacggcgggatgctagtccgaaacccactctccagaaattcaacccatgagatgtattggatttctaacggaactggcaatatcgtggcaagtgttaacatggtgtcgaggctgttgctgaaccgctttacgatgacacaccggagacccaccatcgaaaaagacgtcgatctcggtgccgggactcgtcatgtgaatgctgagccggagacccctaacatggacgtaattggagaaaggataaagcggatcaaagaggaacacaatagcacatggcactacgacgatgagaacccatataagacgtgggcgtaccatggctcctatgaagtgaaggccaccggctctgcatcaagcatgattaatggggttgtcaaacttctgactaagccctgggacgtggtgcctatggtcacacagatggctatgaccgatactacaccattcggacagcaacgcgtttttaaagagaaggtggacacccgaacacccagatccatgccgggtactaggcgggtaatgggcatcaccgccgagtggttatggcgcacgctggggagaaacaaaaagcctaggttgtgcacccgagaagagttcacaaagaaagtgcggactaatgcagccatgggagctgtctttaccgaagagaaccagtgggatagtgccaaggcggcagtggaagacgaggatttctggaaactcgttgaccgtgagagagaactgcacaagctaggcaaatgtggttcttgcgtgtacaatatgatggggaagcgcgagaagaaacttggagaatttggcaaagccaaaggcagcagggctatttggtacatgtggctgggggcccggtatctcgagttcgaggcactgggatttttgaacgaagatcattggttctcaagagaaaattcctacagtggtgtcgaaggcgaggggctgcacaagctcggatatatccttcgcgacataagcaaaatccccggcggtgctatgtacgccgatgacacagctgggtgggacactaggattaccgaagatgacctgcataacgaggagaagatcacgcagcagatggatccagaacaccgacaattagccaatgcaatttttaaactgacatatcagaacaaggtggtaaaggttcagcggcctacccccactggaacagtgatggacatcatatctagaaaagatcagaggggctccggccaagtcgggacctacggattgaatactttcaccaacatggaggcgcagctcattcgccagatggaaggtgagggcgtgctgtcaaaggccgacctagaaaacccacaccttcccgagaaaaagatcacacagtggctggagacgaaaggggtggaacgtctcaagcggatggctatcagcggagatgactgcgtcgttaagcctattgatgacagatttgccaatgcactgttggctttaaacgatatgggcaaagtgaggaaggacataccacaatggcagccgtcgaaaggttggcatgattggcagcaggtacccttctgttctcaccatttccacgagctgatcatgaaggacgggcgcaaactcgtggtcccttgccgaccacaagacgaacttattggacgggccagaatcagtcagggcgcaggctggtccctgagggagaccgcctgtctagggaaggcgtatgctcagatgtggagcctgatgtactttcaccgcagagatctccggttggcctcaaatgcaatttgctccgccgtgcccgttcattgggtgcctacttctaggacaacctggagcatccacgctcatcaccaatggatgactacagaagacatgctgaccgtctggaaccgtgtgtggatagaggataatccatggatggaggacaagacgcccgtaacaacctgggaaaacgttccttaccttggaaaacgagaggatcagtggtgtggtagtctgatcggcctcacttcccgcgccacctgggcacagaatattccgacagctatccagcaagtgaggagcttaattgggaacgaagagttcctggactatatgccatctatgaagcggtttaggaaagaggaagagtcagaaggagccatctggtga

SEQ ID NO: 15491 - RNA, 9873 nt, synthetic construct
  misc_feature 1..9873: note = derived and/or modified CDS sequence (opt3) from DENV-3__FJ639757__SS-prME
  source 1..9873: mol_type = other RNA
accagcctgtgcctcatgatgatccttccagccgctctggcattccacttgacatccagggacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgatagcgccttgaaaatcaactggtataagaaggggagttctattggaaaaatgtttgaagctacagcccgcggtgcaagaaggatggccatactgggcgacactgcttgggatttcgggtccgttggaggcgtgctcaatagcctgggtaagatggtccaccagatctttgggtcggcctacaccgcacttttctctggcgtgtcctgggtaatgaaaattggaatcggcgtgctgttgacgtggatcgggctcaactcaaagaatacaagtatgagcttttcctgcattgcgataggaatcattaccctgtatttaggcgctgttgtccaggccgacatgggttgtgtgatcaactggaaagggaaggagctgaagtgcggatctggcattttcgtgactaatgaggtccatacatggaccgaacagtacaaatttcaagcagatagccccaagcggctagccactgctatcgccggtgcatgggagaacggcgtttgtgggatacgatcaaccacacgcatggaaaatctcctgtggaaacagatcgctaacgagcttaattatattttgtgggaaaacaatatcaagctgacggtggtggtaggagacattatcggcgtcctcgagcaggggaaaagaaccctgactccacagcctatggagttaaagtacagttggaaaacatggggaaaggccaagatagtgaccgcggaaacacaaaactccagcttcattatcgatggccccaacactccagagtgcccctctgcctcaagggcttggaatgtttgggaagtggaggactatggttttggggtcttcaccacgaacatttggctgaaacttcgggaagtgtacacacagttgtgtgaccaccgcctcatgagtgcagccgttaaggatgagagagctgtgcacgccgacatgggatactggatcgagagccagaaaaatggctcctggaagctggaaaaagcatctctaatagaggtaaagacctgcacttggcctaagtcgcataccctgtggagcaacggtgtcctcgaatccgatatgatcattccaaaatcactggcgggcccgatcagtcagcacaattataggcccgggtaccatacacaaactgccggaccttggcaccttggcaagttggagctggactttaactattgcgaggggaccacagtggtgattacggaaaattgtggaacccgtggcccatctttacggactacaaccgtcagcggtaaactcatccacgagtggtgctgtcgatcctgcactctgccccctcttagatacatgggggaagatggatgttggtatggcatggagataaggccaatttcagaaaaggaggagaacatggttaaaagcctggtgtctgctggttccggcgaagtagacaatttcacaatgggggtgttgtgcctcgccatcctgtttgaggaagtcatgcgcggaaagttcggcaagaaacatatgatcgcaggggtgttctttaccttcgttctactgctcagtggacagattacgtggcgggatatggctcacactctgatcatgattggcagcaacgcctctgacagaatgggtatgggggtgacctaccttgcattgatagccacatttaagatccagcccttcctggctttaggatttttcctcaggaaactgacctcccgcgagaatcttctgctaggcgtcggcctcgcgatggccactacactgcaattgccggaagatattgagcagatggcaaacgggatcgctctgggattaatggccctcaagctgattacccagtttgagacatatcagctttggactgccctgatctcattgacctgtagtaatacgatattcacactcaccgtggcttggcgaactgcaaccctgatcctagccggtgttagcctgcttcctgtgtgccaatcgtcctctatgcggaaaacagactggctcccaatgactgtcgcggctatgggcgtaccccctctgcccttgtttattttcagcctgaaggataccttaaagcgtagatcatggccactcaacgaaggggtgatggccgttggactggtgagtatccttgcatcctctctgttgaggaatgacgtccctatggccggccccctcgtggctggtgggctgctaattgcatgttacgtaatcacgggaacaagcgccgatctgaccgtggagaaagcggctgacgtcacttgggaagaggaagccgagcagacaggcgtttcccataaccttatgataaccgtggacgatgacggcactatgcgcattaaggatgacgagacagaaaacatcctcaccgtgctgttgaaaacggcattactgatcgtctcagggatttttccatacagcataccggccactctcctggtgtggcacacctggcagaagcagacacaacggagtggagttctttgggatgtaccttctcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaatggaaagcgactagagcccaactgggcatccgtcaagaaggacctgatcagctatggcggcgggtggcgcctctcggctcagtggcaaaaaggagaagaggtccaggtgattgccgttgaacctggtaagaatcccaagaacttccagacaatgcccggcactttccagaccacaaccggggagatcggagcgatagccctggattttaagcctggcacttcaggttctccgatcattaatcgggaggggaaggtggtcggactttacggcaacggcgtggttaccaaaaatgggggatatgtgagtggtatcgcacaaacaaacgctgaaccagacggccccacgcctgagttagaagaggaaatgttcaagaaaagaaatctgactattatggatctccacccagggtccggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaaagcgaacatacgggtcgggagatcgtggacttgatgtgccacgcaacttttacaatgcgcctactgtctcccgttagagtcccaaactacaatctcattatcatggatgaagcccatttcaccgaccctgctagcatagccgcaagggggtacatttccacccgggtgggaatgggcgaggccgctgcgatctttatgactgccacacccccaggcaccgcagatgctttccctcagtcaaacgcccccattcaggacgaggaacgagacatcccagagagaagttggaatagcgggaacgaatggataacagattttgcaggaaagactgtgtggttcgtcccgtctattaaagccggtaatgacatcgctaactgtttacgcaagaacggcaaaaaggtaatccaactgtccaggaagacgtttgataccgagtatcagaaaacaaaacttaatgactgggatttcgtggttactaccgacatttcagagatgggggccaactttaaagcggatcgtgtgatcgaccctcggagatgcctgaagcccgtcattctcacagatggaccagaaagggtgatattggcaggccccatgcctgttaccgccgctagtgccgctcagcgccgaggtagagtggggcggaatccacagaaagagaacgaccaatacatcttcactggccagcccctgaataacgatgaagaccacgcacattggacggaggccaagatgctcctggacaatattaacacccctgaaggaatcatcccggctcttttcgagccagagagggaaaagagcgccgcaattgatggcgagtatcgcctaaaaggggaatcccgtaagacatttgtcgagctgatgagacggggagacttgcccgtgtggttagcgcacaaagtagcctctgaaggtataaagtacactgataggaaatggtgcttcgacggccagcgcaataaccagatcctggaggagaatatggatgtggaaatttggaccaaggagggggagaagaagaagctccgacctagatggctggacgctcggacatattcggatccccttgccctgaaagagtttaaggacttcgcagctggaaggaaaagcatcgccctcgatttggttaccgaaattggccgcgtcccaactcacctggcacatagaacaaggaacgccctagacaatctggtgatgctccacacgtcagagcatggtgggaaggcttaccggcacgcggtggaggaacttcctgagaccatggaaactctgttattgctgggcctcatgatcctgcttacaggaggcgccatgctgtttctcatatccgggaaaggaatcggtaagaccagtattggcttgatctgtgtcattgcatctagcgggatgctgtggatggctgagatccccttacaatggatagcctccgccattgttctagagttctttatgatggtgctgctcatcccagaacctgagaagcagcgtaccccgcaggataaccaacttgcatatgtagtgattggaatcctgacattggctgccataatcgcggctaatgaaatgggcctgctcgagactacgaaacgcgacctgggtatgtcaaaggaacccggggtcgtgtctccaaccagctaccttgatgttgacctccaccctgccagtgcatggacactgtacgccgtggctactaccgtcattacacccatgttgcgacataccatcgagaactccactgcaaatgtaagcctggccgcgattgctaaccaggccgtggttttaatgggcctagacaaaggatggccaatctctaagatggatctgggcgtgcctctccttgcactggggtgctattcacaggtcaaccccttgacgctgacagccgctgtgctcctgcttataacccactacgccattatcggaccgggcttacaggcaaaagctactagagaggcccaaaagaggaccgcggccggtatcatgaagaatccaacagtcgacgggattatgactatcgatctggaccctgtgatatatgattccaaattcgaaaagcagctcggacaggttatgttgctggtgctatgtgcagtacagctgctccttatgcggaccagttgggctctgtgcgaggccttgacactggcaacgggccccattaccactctctgggaaggtagcccaggcaaattttggaacacaaccatcgctgtgtcgatggccaatattttccgcgggtcttacctggccggagcgggcttagctttttccatcatgaaaagcgtcgggactggaaaaagaggcacaggttcacaaggggagacccttggagaaaagtggaagaaaaagctgaaccagctcagtaggaaagagttcgacctatataagaaatctggcataacggaggttgatcggaccgaagcaaaggagggtctgaaacgaggcgaaatcacacatcacgccgtgtccagagggagcgctaagttgcagtggtttgtcgagcgcaatatggtgattcccgaaggaagggtaatcgacctgggctgtgggcggggaggctggtcatactattgcgccggtctcaagaaagtgactgaggttcgtgggtacaccaagggaggccctggccatgaggaaccggtgcccatgagtacatacgggtggaacattgtcaaacttatgagcggaaaggatgtgttctatctgccacctgagaaatgtgacactttgctgtgcgatatcggtgaatcctctcccagccctaccgtcgaggagtccagaacaattagggtgctcaagatggttgaaccatggttaaagaataaccagttctgtatcaaagtactgaatccctacatgcctaccgtgatagagcaccttgaacgcctgcaacggaagcacggcgggatgctagtccgaaacccactctcaagaaattctactcatgagatgtattggattagtaacggaacgggcaatatcgtggcatcggttaacatggtgagcaggctgttgctgaatcgctttacaatgacccaccggagacccactatcgaaaaagacgtcgatctcggtgccgggacccgtcatgtgaacgctgagccggagacacctaacatggacgtaattggagaaaggataaagcggatcaaagaggaacacaattccacgtggcactacgacgatgagaacccatataagacctgggcgtaccatggctcttatgaagtgaaggccactggctcagcaagctccatgattaatggggttgtcaaacttctgacaaagccctgggacgtggtgcctatggtcacccagatggctatgactgatacaaccccattcggacagcaacgcgtttttaaagagaaggtggacacacgaactcccagaagtatgccgggtaccaggcgggtaatgggcatcacggccgagtggttatggcgcaccctggggagaaacaaaaagcctaggttgtgcacacgagaagagttcactaagaaagtgcggaccaatgcagccatgggagctgtctttacagaagagaaccagtgggattctgccaaggcggcagtggaagacgaggatttctggaaactcgttgaccgtgagagagaactgcacaagctaggcaaatgtggtagctgcgtgtacaatatgatggggaagcgcgagaagaaacttggagaatttggcaaagccaaaggctcaagggctatttggtacatgtggctgggggcccggtatctcgagttcgaggcactgggatttttgaacgaagatcattggttctccagagagaatagttacagcggtgtcgaaggcgaggggctgcacaagctcggatatatccttcgcgacatatctaaaatccccggcggtgctatgtacgccgatgacactgctgggtgggacaccaggattacggaagatgacctgcataacgaggagaagatcacacagcagatggatccagaacaccgacaattagccaatgcaatttttaaactgacctatcagaacaaggtggtaaaggttcagcggcctactcccacaggaaccgtgatggacatcatatccagaaaagatcagaggggctcaggccaagtcgggacttacggattgaataccttcacaaacatggaggcgcagctcattcgccagatggaaggtgagggcgtgctgagcaaggccgacctagaaaatccacaccttcccgagaaaaagatcacgcagtggctggagaccaaaggggtggaacgtctcaagcggatggctatctcgggagatgactgcgtcgttaagcctattgatgacagatttgccaacgcactgttggctttaaacgatatgggcaaagtgaggaaggacataccacaatggcagccgtctaaaggttggcatgattggcagcaggtacccttctgtagtcaccatttccacgagctgatcatgaaggacgggcgcaaactcgtggtcccttgccgaccacaagacgaacttattggacgggccagaatctcccagggcgcaggctggagcctgagggagactgcctgtctagggaaggcgtatgctcagatgtggtcactgatgtactttcaccgcagagatctccggttggcctccaatgcaatttgctctgccgtgcccgttcattgggtgcctacaagcaggaccacttggagtatccacgctcatcaccaatggatgacaaccgaagacatgctgacggtctggaaccgtgtgtggatagaggataatccatggatggaggacaagacacccgtaaccacttgggaaaacgttccttaccttggaaaacgagaggatcagtggtgtggttccctgatcggcctcaccagccgcgccacatgggcacagaatattccgactgctatccagcaagtgagatctttaattgggaacgaagagttcctggactatatgccatcaatgaagcggtttaggaaagaggaagagagtgaaggagccatctggtga

SEQ ID NO: 15492 - RNA, 9873 nt, synthetic construct
  misc_feature 1..9873: note = derived and/or modified CDS sequence (opt3) from DENV-3__FJ639758__SS-prME
  source 1..9873: mol_type = other RNA
accagcctgtgcctcatgatgatccttccagccgctctggcattccacttgacttccagggacggagaacctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacgtcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcgaagtggacaacttcacaatgggggtcttgtgcctcgccattctgtttgaggaagtgatgcgcggaaagttcggcaagaaacatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaagatacagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaaaacagactggctcccaatgactgtagcggctatgggcgtgccccctctgcccttgtttatcttctctctgaaggataccttaaagcgtagaagctggccactcaatgaaggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgagaaagcggctgacgttacttgggaagaggaagccgagcagacaggcgtgagccataaccttatgatcaccgtggacgatgacggcactatgcgcataaaggatgacgagacagaaaatattctcaccgtcctgttgaaaacggcattactgatcgtgtccgggatctttccatactcaattccggccactctcctggtttggcacacctggcagaagcagacacaacggagcggagtactttgggatgtgcctagtcccccagagacccagaaagctgaactggaggagggtgtctatagaataaagcagcagggcatcttcgggaaaacacaagtgggagttggcgtgcagaaggaaggtgtctttcatactatgtggcacgtgaccagaggggccgtattgacgtacaacggaaagcgactagagcccaattgggcatctgtcaaaaaggacctgatttcctatggcggcgggtggcgcctcagcgctcagtggcaaaaaggagaagaggtgcaggttatcgccgtggaacctggtaagaaccccaagaatttccagacaatgcccggcactttccagaccacaaccggggagattggagcgatcgccctggattttaagcctggcacttcgggttcaccgataatcaaccgggaggggaaggtcgtgggactttacggcaatggcgttgtgaccaaaaacgggggatatgtctctggtattgcacaaacaaatgctgaaccagacggccccacgcctgagttagaagaggaaatgttcaagaaaagaaacctgactatcatggatctccacccagggagtggaaagaccaggaaatacttgcccgccattgtgcgtgaggctatcaagcgccggctgagaacactcatactggcacctaccagggtagtggccgccgagatggaagaggctcttaagggcctgccgattcgatatcagactacagcgaccaaatccgaacatacgggtcgggagatcgttgacttgatgtgccacgcaacttttacaatgcgcctactgagccccgtcagagtgccaaattacaacctcatcattatggatgaagcccatttcaccgaccctgcttctatcgccgcaagggggtacataagcacccgggtgggaatgggcgaggccgctgcgatttttatgactgccacacccccaggcaccgcagatgctttccctcagtccaatgcccccatccaggacgaggaacgagacattccagagagatcatggaacagtgggaatgaatggatcacagattttgcaggaaagactgtctggttcgtaccgagcataaaagccggtaacgacattgctaactgtttacgcaagaatggcaaaaaggtgatccaactgtctaggaagacgtttgataccgagtatcagaaaacaaaacttaacgactgggatttcgttgtgactaccgacatctccgagatgggggccaattttaaagcggatcgtgtcattgaccctcggagatgcctgaagcccgtgatcctcacagatggaccagaaagggttattttggcaggccccatgcctgtgaccgccgcttcagccgctcagcgccgaggtagagtcgggcggaacccacagaaagagaatgaccaatacatattcactggccagcccctgaacaatgatgaagaccacgcacattggacggaggccaagatgctcctggacaacatcaatacccctgaaggaattatcccggctcttttcgagccagagagggaaaagagtgccgcaatcgatggcgagtatcgcctaaaaggggaaagccgtaagacatttgtggagctgatgagacggggagacttgcccgtatggttagcgcacaaagtggcctccgaaggtattaagtacactgataggaaatggtgcttcgacggccagcgcaacaatcagatactggaggagaacatggatgttgaaatctggaccaaggagggggagaagaagaagctccgacctagatggctggacgctcggacatattctgatccccttgccctgaaagagtttaaggacttcgcagctggaaggaaatcgattgccctcgatttggtcaccgaaatcggccgcgtgccaagccacctggcacatagaactaggaatgccctagacaacctggtgatgctccacacatcagagcatggtgggaaggcttaccggcacgcggtcgaggaacttcctgagacgatggaaaccctgttattgctgggcctcatgattctgcttactggaggcgccatgctgtttctcatctccgggaaaggaataggtaagacaagtatcggcttgatttgtgttatcgcatctagcgggatgctgtggatggctgagattcccttacaatggatcgcctccgccatagtgctagagttctttatgatggtactgctcattccagaacctgagaagcagcgtaccccgcaggataatcaacttgcatatgtggtcatcggcattctgaccttggctgccatcatagcggctaacgaaatgggcctgctcgagacaactaaacgcgacctgggtatgtcaaaggaacccggggtggtttctccaacgagctaccttgatgtggacctccaccctgccagtgcatggaccctgtacgccgtcgctacaactgtaatcacccccatgttgcgacatacaattgaaaattccaccgcaaacgtgagcctggccgcgatcgctaaccaggccgttgtgttaatgggcctagacaaaggatggccaatttctaagatggatctgggcgtccctctccttgcactggggtgctattcacaggtgaatcccttgactctgacggccgctgtcctcctgcttatcacacactacgccataattggaccgggcttacaggcaaaagctaccagagaggcccaaaagaggactgcggccggtatcatgaagaacccaaccgtggacgggatcatgacaattgatctggaccctgttatctatgattccaaattcgagaagcagctcggacaggtgatgttgctggtactatgtgcagtgcagctgctccttatgcggacaagttgggctctgtgcgaggccttgaccctggcaacaggccccataacgaccctctgggaaggtagcccaggcaaattttggaatactacaattgctgtctcgatggccaacatcttccgcgggtcttacctggccggagcgggcttagctttttccattatgaaaagcgttgggaccggaaaaagaggcactggttcacaaggggagacacttggagaaaagtggaagaaaaagctgaatcagctcagtaggaaagagttcgacctatataagaaatctggcatcaccgaggtggatcggacggaagcaaaggagggtctgaaacgaggcgaaataacccatcacgccgtctccagagggagcgctaagttgcagtggtttgtggagcgcaacatggtaatccccgaaggaagggtgattgacctgggctgtgggcggggaggctggtcatactattgcgccggtctcaagaaagttacagaggtgcgtgggtacactaagggaggccctggccatgaggaaccggtccccatgagtacctacgggtggaatatcgtgaaacttatgagcggaaaggatgtcttctatctgccacctgagaaatgtgacacattgctgtgcgatattggtgaatcctctcccagccctactgtggaggagtccagaaccatcagggttctcaagatggtagaaccatggttaaagaacaatcagttctgtattaaagtgctgaacccctacatgcctacagtcgtggagcaccttgaacgcctgcaacggaagcacggcgggatgctagttcgaaatccactctcaagaaactctacccatgagatgtattggatcagtaatggaactggcaacatagtggcatcggtcaatatggtgagcaggctgttgctgaaccgctttacgatgacacaccggagacccaccattgaaaaagacgtagatctcggtgccgggactcgtcatgtgaacgctgagccggagacccctaatatggacgttatcggagaaaggatcaagcggattaaagaggaacacaactccacatggcactacgacgatgagaatccatataagacgtgggcgtaccatggctcttatgaagtcaaggccaccggctcagcaagctccatgataaacggggtggtgaaacttctgactaagccctgggacgtcgttcctatggtgacacagatggctatgaccgatactacaccattcggacagcaacgcgtatttaaagagaaggtggacacccgaacacccagaagtatgccgggtactaggcgggtcatgggcatcaccgccgagtggttatggcgcacgctggggagaaataaaaagcctaggttgtgcacccgagaagagttcacaaagaaagtgcggactaacgcagccatgggagctgtttttaccgaagagaatcagtgggattctgccaaggcggcagtggaagacgaggatttctggaaactcgtcgaccgtgagagagaactgcacaagctaggccgctgtggtagctgcgtgtacaacatgatggggaaaagggagaagaaacttggagaatttggcaaggccaagggctcacgggctatttggtacatgtggctgggggccagatatctcgagttcgaggcactgggatttttgaatgaagatcattggttctcccgcgagaacagttacagcggtgtagaaggcgaggggctgcacaaactcggatatatccttagggacatttctaagatccccggcggtgctatgtacgccgatgacacagctgggtgggacactcgaataaccgaagatgacctgcataatgaggagaaaatcacgcagcagatggatccagaacaccggcaattagccaacgcaatttttaagctgacatatcagaataaagttgtgaaggtccagagacctacccccactggaacagtgatggacatcatttccaggaaggatcagcgcggctcaggccaagtggggacctacggattgaacactttcaccaatatggaggcgcagctcatccgtcagatggaaggtgagggcgtcctgagcaaagccgacctagaaaacccacggcttcccgagaagaaaataacacagtggctggagacgaagggggttgaaagactcaaaaggatggctatttcgggagatgactgcgtggtaaagcctatcgatgaccgctttgccaacgcactgttggctttaaatgatatgggcaaggtgcgaaaagacatcccacaatggcagccgtctaagggttggcacgattggcagcaggtccccttctgtagtcatcacttccatgagctgattatgaaagacgggcggaagctcgtggttccttgcagaccacaagacgaacttataggaagggcccgcatctcccagggcgcaggctggagcctgagagagaccgcctgtctagggaaagcgtatgctcagatgtggtcactgatgtactttcaccggagggatctccgtttggcctccaacgcaatttgctctgccgtgcccgtccactgggtgcctactagccgaacaacctggagtatccatgctcaccatcaatggatgactacagaagacatgctgaccgtatggaatcgcgtttggattgaggataacccatggatggaggacaagacgcccgtgacaacctgggaaaatgtcccttaccttggaaagagagaggatcagtggtgtggttccctgatcggcctcactagccgggccacctgggcacagaacataccgacagctatccagcaagtgaggtctttaattgggaatgaagagttcctggactatatgccatcaatgaaacgctttagaaaggaggaagagagtgaaggagccatctggtga

SEQ ID NO: 15493 - RNA, 9873 nt, synthetic construct
  misc_feature 1..9873: note = derived and/or modified CDS sequence (opt3) from DENV-3__FJ639759__SS-prME
  source 1..9873: mol_type = other RNA
acaagcctgtgcctcatgatgatccttccagccgctctggcattccacttgacatccagggacggcgaacctaggatgattgtggggaagaacgaacggggaaaatctttactgtttaagactgcctcaggtattaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgctattcacgtttgttctgctcctgtccggacagatcacttggcgggatatggctcacacccttattatgatcggcagtaatgccagcgacagaatgggtatgggggtgacatacttggcactgattgccaccttcaagatacagccctttttagctctcggattctttctgaggaaacttacttctcgcgagaacctgctactcggcgtcggcctggcgatggccacaaccttgcaactgccggaagatatcgagcagatggcaaatgggattgctttaggactcatggccctgaaacttatcacacagttcgagacttatcagctgtggaccgccttgatttccctcacgtgttcaaacacaatctttaccctgactgtggcttggcgaaccgcaacactaatactggccggtgttagtcttctccctgtgtgccaaagctcgtccatgcggaaaactgactggatcccaatgaccgtcgcggctatgggcgtaccccctctgcccttgttcatattttctctgaaggatacgttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacaggaacctctgccgatctgactgtggagaaagcggctgacgtcacatgggaagaggaagccgagcagaccggcgttagccataaccttatgataactgtggacgatgacggcacaatgcgcattaaggatgacgagaccgaaaatatcctcacggtgctgttgaaaactgcattactgatcgtctccgggattttcccatactcaataccggccaccctcctggtgtggcacacatggcagaagcagacccaacggagcggagttctttgggatgtacctagtcccccagagacacagaaagctgaactggaggagggtgtgtatagaatcaagcagcagggcatttttgggaaaactcaagtcggagtgggcgttcagaaggaaggtgtgttccataccatgtggcacgtcacgagaggggccgtgttgacatacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaattttcagactatgcccggcaccttccagacaaccactggggagatcggagcgatagccctggatttcaagcctggcacctcgggttcaccgatcattaaccgggaggggaagatcgtgggactttacggcaatggcgtcgtgaccaagaacgggggatatgtttctggtattgcacaaacgaatgctgaaccagacggccccactcctgagttagaagaggaaatgtttaagaaaagaaacctgaccatcatggatctccacccagggagtggaaagacaaggaaatacttgcccgccatagtgcgtgaggctattaagcgccggctgagaaccctcatcctggcacctactagggtcgtggccgccgagatggaagaggctcttaagggcctgccgatccgatatcagacatccgcgaccaaaagcgaacatacgggtcgggagattgtagacttgatgtgccacgcaactttcacaatgcgcctactgtctcccgtgagagttccaaattacaacctcatcataatggatgaagcccattttaccgaccctgctagcattgccgcaagggggtacatctccacccgggtcggaatgggcgaggccgctgcgattttcatgactgccacacccccaggcaccgcagatgcttttcctcagtcaaatgcccccatccaggacgaggaacgagacataccagagagaagttggaacagcgggaatgaatggattacagatttcgcaggaaagactgtgtggtttgtgccgtctatcaaagccggtaacgacatcgctaactgtttacgcaagaatggcaaaaaggtcattcaactgtccaggaagacgttcgataccgagtatcagaaaacaaaacttaacgactgggattttgtagtgactaccgacatctcagagatgggggccaatttcaaagcggatcgtgttattgaccctcggagatgcctgaagcccgtgatactcacagatggaccagaaagggtcatcttggcaggccccatgcctgtgaccgccgctagtgccgctcagcgccgaggtagagttgggcggaacccacagaaagagaatgaccaatacatttttactggccagcccctgaacaatgatgaagaccacgcacattggacggaggccaagatgctcctggacaacatcaatacccctgaaggaatcattccggctcttttcgagccagagagggaaaagagcgccgcaatagatggcgagtatcgcctaaaaggggaatcccgtaagacattcgtggagctgatgagacggggagacttgcccgtctggttagcgcacaaagtggcctctgaaggtatcaagtacactgataggaaatggtgctttgacggccagcgcaacaatcagattctggaggagaacatggatgtagaaatctggaccaaggagggggagaagaagaagctccgacctagatggctggacgctcggacatattcggatccccttgccctgaaagagttcaaggactttgcagctggaaggaaaagcattgccctcgatttggtgaccgaaatcggccgcgttccaactcacctggcacatagaacaaggaatgccctagacaacctggtcatgctccacacgtcagagcatggtgggaaggcttaccggcacgcggtggaggaacttcctgagaccatggaaactctgttattgctgggcctcatgatactgcttacaggaggcgccatgctgttcctcatctccgggaaaggaattggtaagaccagtatcggcttgatttgtgtgatcgcatctagcgggatgctgtggatggctgagatacccttacaatggattgcctccgccatcgtcctagagtttttcatgatggttctgctcattccagaacctgagaagcagcgtaccccgcaggataatcaacttgcatatgtggtaatcggaatactgacattggctgccatcattgcggctaacgaaatgggcctgctcgagactacgaaacgcgacctgggtatgtcaaaggaacccggggtggtctctccaaccagctaccttgatgtggacctccaccctgccagtgcatggacactgtacgccgttgctactaccgtgatcacacccatgttgcgacataccattgaaaattccactgcaaacgtcagcctggccgcgatcgctaaccaggccgtagtgttaatgggcctagacaaaggatggccaatatctaagatggatctgggcgttcctctccttgcactggggtgctattcacaggtgaatcccttgacgctgacagccgctgtcctcctgcttattacccactacgccatcatcggaccgggcttacaggcaaaagctactagagaggcccaaaagaggaccgcggccggtattatgaagaacccaacagtggacgggatcatgactatagatctggaccctgtcatttatgattccaaatttgaaaagcagctcggacaggtgatgttgctggttctatgtgcagtgcagctgctccttatgcggaccagttgggctctgtgcgaggccttgacactggcaacgggccccatcaccactctctgggaaggtagcccaggcaaattctggaatacaaccattgctgtatcgatggccaacatctttcgcgggtcttacctggccggagcgggcttagctttctccataatgaaaagcgtggggactggaaaaagaggcacaggttcacaaggggagacccttggagaaaagtggaagaaaaagctgaatcagctcagtaggaaagagtttgacctatataagaaatctggcatcacggaggtcgatcggaccgaagcaaaggagggtctgaaacgaggcgaaattacacatcacgccgtttccagagggagcgctaagttgcagtggttcgtggagcgcaacatggtcatccccgaaggaagggtgattgacctgggctgtgggcggggaggctggtcatactattgcgccggtctcaagaaagtaactgaggtgcgtgggtacaccaagggaggccctggccatgaggaaccggttcccatgagtacatacgggtggaatatcgtgaaacttatgagcggaaaggatgtcttttatctgccacctgagaaatgtgacactttgctgtgcgatattggtgaatcctctcccagccctaccgtggaggagtccagaacaatcagggtcctcaagatggtggaaccatggttaaagaacaatcagttctgtataaaagttctgaacccctacatgcctaccgtaattgagcaccttgaacgcctgcaacggaagcacggcgggatgctagtgcgaaatccactctcaagaaactctactcatgagatgtattggatcagtaatggaacgggcaacatcgtcgcatcggtgaatatggttagcaggctgttgctgaaccgcttcacaatgacccaccggagacccactattgaaaaagacgtggatctcggtgccgggacccgtcatgtcaacgctgagccggagacacctaatatggacgtgataggagaaaggatcaagcggattaaagaggaacacaactccacgtggcactacgacgatgagaatccatataagacctgggcgtaccatggctcttatgaagtaaaggccactggctcagcaagctccatgatcaacggggtggttaaacttctgacaaagccctgggacgtcgtgcctatggtgacccagatggctatgactgatacaaccccatttggacagcaacgcgtcttcaaagagaaggttgacacacgaactcccagaagtatgccgggtaccaggcgggtgatgggcattacggccgagtggttatggcgcaccctggggagaaataaaaagcctaggttgtgcacacgagaagagtttactaagaaagtacggaccaacgcagccatgggagctgtgttcacagaagagaatcagtgggattctgccaaggcggcagtcgaagacgaggatttttggaaactcgtggaccgtgagagagaactgcacaagctaggcaaatgtggtagctgcgtttacaacatgatggggaagcgcgagaagaaacttggagagttcggcaaagccaaaggctcaagggctatctggtacatgtggctgggggcccggtatctcgagtttgaggcactgggattcttgaatgaagatcattggttttccagagagaacagttacagcggtgtggaaggcgaggggctgcacaagctcggatatatacttcgcgacatctctaaaattcccggcggtgctatgtacgccgatgacactgctgggtgggacaccaggatcacggaagatgacctgcataatgaggagaagattacacagcagatggatccagaacaccgacaattagccaacgcaatcttcaaactgacctatcagaataaggtcgtgaaggtacagcggcctactcccacaggaaccgttatggacataatttccagaaaagatcagaggggctcaggccaagtggggacttacggattgaacacctttacaaatatggaggcgcagctcatccgccagatggaaggtgagggcgtcctgagcaaggccgacctagaaaacccacaccttcccgagaaaaagatcacgcagtggctggagaccaaaggggtggaacgtctcaagcggatggctatttcgggagatgactgcgtggtcaagcctatagatgacagattcgccaacgcactgttggctttaaatgatatgggcaaagttaggaaggacatcccacaatggcagccgtctaaaggttggcatgattggcaacaggtgcccttttgtagtcaccatttccacgagctgattatgaaggacgggcgcaaactcgtagtgccttgccgaccacaagacgaacttatcggacgggccagaatttcccagggcgcaggctggagcctgagggagactgcctgtctagggaaggcgtatgctcagatgtggtcactgatgtacttccaccgcagagatctccggttggcctccaacgcaatctgctctgccgtccccgtgcattgggttcctacaagcaggaccacttggagtatacacgctcatcaccaatggatgacaaccgaagacatgctgacggtgtggaatcgtgtctggatcgaggataacccatggatggaggacaagacacccgtgaccacttgggaaaatgtaccttaccttggaaaacgagaggatcagtggtgtggttccctgattggcctcaccagccgcgccacatgggcacagaacatcccgactgctattcagcaagttagatctttaatcgggaatgaagagtttctggactatatgccatcaatgaagcggttcaggaaagaggaagagagtgaaggagccatttggtga

SEQ ID NO: 15494 - RNA, 9873 nt, synthetic construct
  misc_feature 1..9873: note = derived and/or modified CDS sequence (opt3) from DENV-3__FJ639761__SS-prME
  source 1..9873: mol_type = other RNA
accagcctgtgcctcatgatgatccttcccgccgctctggcattccacttgacatccagggacggcgaacctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgaaggggcttggaggcaggtcgaaaaagtggaaacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttacagcccatagagggaaaagtggtccagtatgagaatctgaagtacacagtgattatcactgttcataccggtgaccagcaccaagtgggcaacgaaacacagggggtcaccgcagagattactcctcaggcttccacgacagaagccatcctcccagagtatggaacccttggcctggaatgctctccgcgaactggtttggacttcaatgagatgatcctactgaccatgaaaaacaaggcgtggatggtgcatagacaatggtttttcgatctccccctgccttggacaagcggggccaccactgagacaccaacgtggaataggaaagaacttctggtaacctttaagaacgcacacgctaaaaagcaggaggttgtggtcttgggctcccaggaaggagccatgcacactgctctcacaggcgccaccgagattcaaaattcagggggaacaagtatattcgcaggtcatctgaagtgtcggttaaaaatggacaagctggaactaaaaggcatgagctacgccatgtgcactaacacctttgtgctcaagaaagaggtctctgagacgcaacacgggaccatcctgattaaggtggaatacaagggagaggatgttccctgtaaaatccctttctccacagaagacggccagggtaaggctcataacgggcgtcttataactgcgaatccagtggtaaccaaaaaggaggagcccgtcaacattgaagcagagccgcctttcggcgaatcaaatatcgtgatcggaattggcgataacgccttgaaaatcaattggtataagaaggggagcagtattggaaaaatgtttgaggctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggaactgaagtgcggatccggcattttcgtgactaacgaggtccatacatggaccgagcaatacaaatttcaggcagattctcccaagcggctagccactgctatcgccggtgcatgggaaaatggcgtttgtgggatacgaagcaccacacgcatggagaacctcctgtggaaacagatcgctaatgaacttaactatattttgtgggagaataacatcaagctgacggtggtggtaggagacattatcggcgtcctcgaacaggggaaaagaaccctgactccacaacctatggagttaaagtactcatggaaaacatggggaaaggccaagatagtgaccgcggagacacagaacagttccttcattatcgatggccccaatactccagaatgccccagcgcctctagggcttggaacgtttgggaggtggaagactatggttttggggtcttcaccacgaatatttggctgaaacttcgggaggtgtacacacagttgtgtgaccaccgcctcatgtcagcagccgttaaggatgaaagagctgtgcacgccgacatgggatactggatcgagagtcagaaaaacggcagctggaagctggagaaagcatccctaatagaagtaaagacctgcacttggcctaagtctcataccctgtggtcgaatggtgtcctcgagagcgatatgatcattccaaaatccctggcgggcccgatctcacaacacaactataggcccgggtaccatacacagactgccggaccttggcaccttggcaagttggaactggactttaattattgcgaggggaccacagtggtgattacggagaactgtggaacccgtggcccaagtttacggactacaaccgtctctggtaaactcatccacgaatggtgctgtcgaagctgcactctgccccctcttagatacatgggggaggatggatgttggtatggcatggaaataaggccaatttccgagaaggaagagaatatggttaaatcactggtgagcgctggttctggcgaggtagacaacttcacaatgggggtgttgtgcctcgccatcctgtttgaagaggtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccaacccttcctggctttaggatttttcctcaggaaactgacctctcgcgaaaaccttctgctaggcgtcggcctcgcgatggccactacactgcagttgccggaggatattgaacagatggcaaatgggatcgctctgggattaatggccctcaagctgattacccagtttgagacatatcaactttggactgccctgatctccttgacctgttcaaacacgatattcacactcaccgtggcttggcgaactgcaaccctgatcctagccggtgttagtctgcttcctgtgtgccagagctcgtccatgcggaaaacagactggctcccaatgactgtcgcggctatgggcgtaccccctctgcccttgtttattttctctctgaaggataccttaaagcgtagaagctggccactcaatgagggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggaaaaagcggctgacgtcacttgggaggaagaggccgaacagacaggcgttagccataaccttatgataaccgtggacgatgacggcactatgcgcattaaggatgacgagacagagaatatcctcaccgtgctgttgaaaacggcattactgatcgtctccgggatttttccatactcaataccggccactctcctggtgtggcacacctggcagaagcaaacacagcggagcggagttctttgggatgtacctagtcccccagaaacccagaaagctgagctggaagagggtgtgtatagaatcaagcagcaaggcattttcgggaaaacacaggtcggagtgggcgttcagaaggagggtgtgtttcatactatgtggcacgtcaccagaggggccgtgttgacgtacaacggaaagcgactagaacccaattgggcatctgtcaagaaggacctgatctcctatggcggcgggtggcgcctcagcgctcaatggcagaaaggagaggaagtccaggtgattgccgttgagcctggtaagaaccccaagaatttccagacaatgcccggcactttccaaaccacaaccggggaaatcggagcgatagccctggattttaagcctggcacttcgggttcaccgatcattaaccgggaggggaaggtggtcggactttacggcaatggcgtggttaccaaaaacgggggatatgtgtctggtatcgcacagacaaatgctgagccagacggccccacgcctgaattagaggaagagatgttcaagaaaagaaacctgactattatggatctccacccagggagtggaaagaccaggaaatacttgcccgccatcgtccgtgaagctataaagcgccggctgagaacactcattctggcacctaccagggtggtagccgccgagatggaggaagctcttaagggcctgccgatccgatatcagactacagcgaccaaatccgagcatacgggtcgggaaatcgtggacttgatgtgccacgcaacttttacaatgcgcctactgagccccgttagagtcccaaattacaacctcattatcatggatgaggcccatttcaccgaccctgcttctatagccgcaagggggtacattagcacccgggtgggaatgggcgaagccgctgcgatctttatgactgccacacccccaggcaccgcagatgctttccctcagtccaatgcccccattcaagacgaggagcgagacatcccagaaagatcatggaacagtgggaatgagtggataacagattttgcaggaaagactgtgtggttcgtcccgagcattaaagccggtaacgacatcgctaactgtttacgcaagaatggcaaaaaggtaatccagctgtctaggaagacgtttgataccgaatatcagaaaacaaaacttaacgactgggatttcgtggttactaccgacatttccgagatgggggccaattttaaagcggatcgtgtgatcgaccctcggagatgcctgaagcccgtcattctcacagatggaccagagagggtgatattggcaggccccatgcctgttaccgccgcttcagccgctcagcgccgaggtagagtggggcggaacccacaaaaagaaaatgaccagtacatcttcactggccagcccctgaacaatgatgaggaccacgcacattggacggaagccaagatgctcctggacaacattaatacccctgagggaatcatcccggctcttttcgaaccagagagggagaagagtgccgcaattgatggcgaatatcgcctaaaaggggagagccgtaagacatttgtcgaactgatgagacggggagacttgcccgtgtggttagcgcacaaagtagcctccgagggtataaagtacactgataggaaatggtgcttcgacggccagcgcaacaatcaaatcctggaagagaacatggatgtggagatttggaccaaggaaggggagaaaaagaagctccgacctagatggctggacgctcggacatattctgatccccttgccctgaaagaatttaaggacttcgcagctggaaggaaatcgatcgccctcgatttggttaccgagattggccgcgtcccaactcacctggcacatagaacaaggaatgccctagacaacctggtgatgctccacacgagcgaacatggtgggaaggcttaccggcacgcggtggaggagcttcctgaaaccatggagactctgttattgctgggcctcatgatcctgcttacaggaggcgtcatgctgtttctcatatcagggaaaggaatcggtaagacctccattggcttgatctgtgttattgccagttctgggatgctgtggatggcagaaatccccttacagtggatagctagcgccattgtgctagagttctttatgatggtactgctcatcccagagcctgaaaagcagcgtaccccgcaagataatcagcttgcctatgtggtcattggaatcctgacattggcagctataatcgccgcgaacgagatgggcctgctcgaaactacgaaacgcgacctgggtatgtccaaggagcccggggtggtttcaccaacctcttaccttgatgtggacctccaccctgctagcgcctggacactgtacgcagtcgccactaccgtaattacacccatgttgcgacataccatcgaaaatagtactgctaacgtgtccctggcagccattgcgaaccaggctgttgtgttaatgggcctagacaaaggatggccaatcagcaagatggatctgggcgtccctctccttgccctggggtgctattctcaggtgaatcccttgacgctgacagcagccgtcctcctgcttataacccactacgctattatcggaccgggcttacaagccaaagcaactagagaggctcagaagaggaccgccgcgggtatcatgaagaacccaacagtggacgggattatgactatcgatctggaccctgttatatatgattcaaaattcgagaagcagctcggacaggtgatgttgctggtactatgtgccgtgcaactgctccttatgcggacctcctgggcactgtgcgaggctttgacactggccacgggccccattaccactctctgggagggtagtccaggcaaattttggaatacaaccatcgcagtcagcatggctaacattttccgcgggtcgtacctggccggagccggcttagcgttttctatcatgaagtccgttgggactggaaaaagaggcacaggtcttcagggggaaaccctgggagagaagtggaagaaaaagctcaatcagctaagcaggaaagagttcgacctgtataagaaatcaggcataacggaggtggatcggaccgaggctaaggaaggtttgaaacgaggcgagatcacacatcacgcagtcagtagagggtctgccaagctgcagtggtttgtggaacgcaacatggtaattcccgagggaagggtgatcgacctcggctgtgggcggggaggctggtcctactattgcgctggtcttaagaaagttactgaagtgcgtgggtacaccaagggaggccctggccatgaggagccggtccccatgagcacatacgggtggaatattgtgaaactgatgtcaggaaaggatgtcttctatttgccacctgaaaaatgtgacactctgctctgcgatatcggtgagagtagcccctcccctaccgtggaagagtctagaacaattagggttttaaagatggtagagccatggctgaagaacaatcaattctgtatcaaagtgcttaacccctacatgcctaccgtcatagaacacctggagcgcctacagcggaagcacggcgggatgctcgtgcgaaatccactgagcagaaactccactcatgaaatgtattggatttcaaatggaacgggcaacatcgttgcctctgtgaatatggtcagtaggttgctgctcaaccgctttacaatgacccaccggagacccactatcgagaaagacgtggatcttggtgcagggacccgtcatgtaaacgccgaaccggagacacctaatatggacgtgattggagagaggataaagcggatcaaagaagaacacaactcgacgtggcactacgacgatgaaaatccatataagacctgggcttaccatggcagctatgaggttaaggcgactggctccgcctcttcaatgattaacggggtcgtgaaactgttaacaaagccctgggacgtggtccctatggttacccagatggcaatgactgatacaaccccattcggacaacagcgcgtgtttaaagaaaaggtagacacacgaactcccagaagcatgccgggtaccaggcgggtgatgggcatcacggctgagtggctgtggcgcaccttggggagaaataaaaagcctaggctctgcacacgagaggagttcactaagaaagtccggaccaacgccgcaatgggagccgtgtttacagaggaaaatcagtgggattccgctaaggccgcggttgaggacgaagatttctggaaactggtggaccgtgagagagagctacacaaacttggcaaatgtggtagttgcgtctacaacatgatggggaagcgcgagaagaagctgggagagtttggcaaggcaaaaggctctagggccatttggtacatgtggctcggggctcggtatctggagttcgaggccttgggatttctgaatgaggatcattggttcagcagagaaaactcatactccggtgtggagggcgaagggctccacaaacttggatatatcctgcgcgacataagtaaaatccccggcggtgcaatgtacgctgatgacactgccgggtgggacaccaggattacggaggatgacttacataatgaagagaagatcacacagcaaatggatccagagcaccgacagctggctaacgccatttttaaattgacctatcagaataaggtagttaaggtgcagcggcctactcccacaggaaccgtcatggacatcataagcagaaaagatcaaaggggctctggccaggtggggacttacggactcaacaccttcacaaatatggaagcacagctgattcgccagatggagggtgaaggcgtgctatccaaggcggaccttgagaacccacatctgccagagaaaaagatcacgcaatggctcgagaccaaaggggtcgagcgtctgaagcggatggccatctcaggagatgactgcgttgtgaagcctattgatgacagatttgctaacgccttgttagcactgaatgatatgggcaaagtaaggaaggacataccacagtggcagccgagcaaaggttggcacgattggcagcaagtgcccttctgttcgcaccatttccacgaactcatcatgaaggacgggcgcaaacttgtcgtgccttgccgaccacaggacgagctgattggacgggctagaatctctcagggcgccggctggagtctaagggaaactgcatgtctggggaaggcctatgcgcaaatgtggtccctcatgtactttcaccgcagagatttgcggctggctagcaacgccatttgctcagcagttcccgtgcattgggtccctacatccaggaccacttggtctatccacgcccatcaccagtggatgacaaccgaggacatgcttacggtgtggaatcgtgtatggatagaagataacccatggatggaggacaagacacccgttaccacttgggagaatgtgccttacctgggaaaacgagaagatcagtggtgtggtagcctcatcggcttaaccagtcgcgctacatgggcccagaacattccgactgcaatccaacaggtcagatccctgattgggaatgaggagttcttggactatatgccaagcatgaagcggtttaggaaagaggaggaatctgagggagctatctggtga

SEQ ID NO: 15495 - RNA, 9873 nt, synthetic construct
  misc_feature 1..9873: note = derived and/or modified CDS sequence (opt3) from DENV-3__FJ639762__SS-prME
  source 1..9873: mol_type = other RNA
accagcctgtgcctcatgatgatccttccagccgctctggcattccacttgacatccagagacggagagcctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaagatcgagtacaagggagaagatgtgccctgtaaaatacctttctccacagaggacggccaaggtaaggctcataacgggcgtcttattactgcgaatccagttgtgaccaaaaaggaggaacccgtaaacatcgaggcagaaccgcctttcggcgagtcaaatatcgtcattggaatcggcgataacgccttgaaaattaattggtataagaaggggagcagtataggaaaaatgtttgaagctacagcccgcggtgcaagaaggatggccatcctgggcgacactgcttgggatttcgggtctgtgggaggcgttctcaactccctgggtaagatggtgcaccagatttttgggagcgcctacaccgcacttttctcgggcgtctcttgggtgatgaaaatcggaatcggcgtactgttgacgtggattgggctcaattccaagaacacatcaatgagttttagctgcatagcgatcggaattatcaccctgtatttaggcgctgtggttcaggccgacatgggttgtgtcattaattggaaagggaaggagctgaagtgcggatccggcatcttcgtgactaacgaggtgcatacatggaccgaacagtacaaatttcaagcagattctcccaagcggctagccactgctatagccggtgcatgggagaatggcgtctgtgggatccgaagcaccacacgcatggaaaacctcctgtggaaacagattgctaatgagcttaactatatcttgtgggaaaataacattaagctgacggttgtggtgggagacatcataggcgtactcgagcaggggaaaagaaccctgactccacagcctatggagttaaagtactcatggaaaacatggggaaaggccaagattgtcaccgcggaaacacaaaacagttccttcatcattgatggccccaatactccagagtgccccagcgcctctagggcttggaacgtgtgggaagttgaggactatggttttggggtgttcaccacgaatatctggctgaaacttcgggaagtctacacacagttgtgtgaccaccgcctcatgtcagcagccgtgaaggatgagagagctgttcacgccgacatgggatactggatagagagtcagaaaaacggcagctggaagctggaaaaagcatccctaatcgaggtgaagacctgcacttggcctaagtctcataccctgtggtcgaatggtgtactcgaaagcgatatgattatcccaaaatccctggcgggcccgatttcacagcacaactataggcccgggtaccatacacaaactgccggaccttggcaccttggcaagttggagctggactttaattattgcgaggggaccacagtcgtgatcacggaaaactgtggaacccgtggcccaagtttacggactacaaccgtgtctggtaaactcatacacgagtggtgctgtcgaagctgcactctgccccctcttagatacatgggggaagatggatgttggtatggcatggagattaggccaatctccgaaaaggaggagaatatggtcaaatcactggttagcgctggttctggcgaagtggacaacttcacaatgggggtattgtgcctcgccatcctgtttgaggaagtgatgcgcggaaagttcggcaagaaacatatgattgcagggatcttctttaccttcgtcctactgctctccggacagattacgtggcgggatatggctcacactctgataatgatcggcagtaatgccagcgacagaatgggtatgggggtgacctaccttgcattgattgccacatttaagatccagcccttcctggctttaggatttttcctcaggaaactgacctctcgcgagaaccttctgctaggcgttggcctcgcgatggccactacactgcaattgccggaagatattgagcagatggcaaatgggatcgctctgggattaatggccctcaagctgataacccagtttgagacatatcagctttggactgccctgatctccttgacctgttcaaacacgattttcacactcaccgtggcttggcgaactgcaaccctgatcctagccggtgtcagtctgcttcctgtgtgccaaagctcgtccatgcggaaaacagactggctcccaatgactgttgcggctatgggcgtgccccctctgcccttgtttattttctctctgaaggataccttaaagcgtagaagctggccactcaatgaaggggtcatggccgtaggactggtgtcaatccttgcaagttccctgttgaggaacgacgttcctatggccggccccctcgtggctggtgggctgctaatagcatgttacgtcattacgggaacatctgccgatctgaccgtggagaaagcggctgacgtaacttgggaagaggaagccgagcagacaggcgtgagccataaccttatgatcaccgtcgacgatgacggcactatgcgcatcaaggatgacgagacagaaaatattctcaccgttctgttgaaaacggcattactgatagtgtccgggatctttccatactcaattccggccactctcctggtgtggcacacctggcagaagcagacacaacggagcggagtcctttgggatgtgcctagtcccccagagacccagaaagctgaactggaggagggtgtttatagaatcaagcagcagggcattttcgggaaaacacaagtaggagtgggcgtccagaaggaaggtgtgtttcatactatgtggcacgttaccagaggggccgtgttgacgtacaacggaaagcgactagagcccaattgggcatctgtcaaaaaggacctgatctcctatggcggcgggtggcgcctcagcgctcagtggcaaaaaggagaagaggtgcaggtaatagccgtcgaacctggtaagaaccccaagaatttccagacaatgcccggcactttccagaccacaaccggggagatcggagcgattgccctggattttaagcctggcacttcgggttcaccgatcattaaccgggaggggaagatcgtgggactttacggcaatggcgttgtgaccaaaaacgggggatatgtctctggtatagcacaaacaaatgctgaaccagacggccccacgcctgagttagaagaggaaatgttcaagaaaagaaacctgactattatggatctccacccagggagtggaaagaccaggaaatacttgcccgccatcgtgcgtgaggctatcaagcgccggctgagaacactcattctggcacctaccagggttgtggccgccgagatggaagaggctcttaagggcctgccgatccgatatcagactacagcgaccaaatccgaacatacgggtcgggagatagtcgacttgatgtgccacgcaacttttacaatgcgcctactgagccccgtgagagtaccaaattacaacctcattatcatggatgaagcccatttcaccgaccctgcttctattgccgcaagggggtacatcagcacccgggtgggaatgggcgaggccgctgcgatatttatgactgccacacccccaggcaccgcagatgctttccctcagtccaatgcccccattcaggacgaggaacgagacatcccagagagatcatggaacagtgggaatgaatggatcacagattttgcaggaaagactgtttggttcgtcccgagcattaaagccggtaacgacatcgctaactgtttacgcaagaatggcaaaaaggtgattcaactgtctaggaagacgtttgataccgagtatcagaaaacaaaacttaacgactgggatttcgtggtcactaccgacatatccgagatgggggccaattttaaagcggatcgtgtaatcgaccctcggagatgcctgaagcccgtgattctcacagatggaccagaaagggttatcttggcaggccccatgcctgtgaccgccgcttcagccgctcagcgccgaggtagagtcgggcggaacccacagaaagagaatgaccaatacatcttcactggccagcccctgaacaatgatgaagaccacgcacattggacggaggccaagatgctcctggacaacattaatacccctgaaggaataatcccggctcttttcgagccagagagggaaaagagtgccgcaattgatggcgagtatcgcctaaaaggggaaagccgtaagacatttgtggagctgatgagacggggagacttgcccgtttggttagcgcacaaagtggcctccgaaggtatcaagtacactgataggaaatggtgcttcgacggccagcgcaacaatcagattctggaggagaacatggatgtcgaaatctggaccaaggagggggagaagaagaagctccgacctagatggctggacgctcggacatattctgatccccttgccctgaaagagtttaaggacttcgcagctggaaggaaatcgatagccctcgatttggtgaccgaaatcggccgcgtaccaactcacctggcacatagaacaaggaatgccctagacaacctggtgatgctccacacgagcgagcatggtgggaaggcttaccggcacgcggttgaggaacttcctgagaccatggaaactctgttattgctgggcctcatgattctgcttacaggaggcgccatgctgtttctcatctcagggaaaggaattggtaagacctccatcggcttgatatgtgtcattgcaagttctgggatgctgtggatggctgagatccccttacaatggattgccagcgccatcgtgctagagttctttatgatggtgctgctcataccagaacctgagaagcagcgtaccccgcaggataatcaacttgcatatgtcgttatcggcattctgacattggctgccatcattgcggctaacgaaatgggcctgctcgagactacgaaacgcgacctgggtatgtccaaggaacccggggtggtatcaccaacctcttaccttgatgtggacctccaccctgccagcgcatggacactgtacgccgtcgctactaccgtgatcacacccatgttgcgacataccatagagaatagtactgcaaacgtttccctggccgcgattgctaaccaggccgtggtcttaatgggcctagacaaaggatggccaatcagcaagatggatctgggcgtacctctccttgcactggggtgctattctcaggtgaatcccttgacgctgacagccgctgttctcctgcttatcacccactacgccattatcggaccgggcttacaggcaaaagctactagagaggcccaaaagaggaccgcggccggtataatgaagaacccaacagtggacgggattatgactatcgatctggaccctgtcatttatgattcaaaattcgaaaagcagctcggacaggtgatgttgctggtcctatgtgcagtgcagctgctccttatgcggacctcctgggctctgtgcgaggccttgacactggcaacgggccccatcaccactctctgggaaggtagtccaggcaaattttggaatacaaccatagctgttagcatggccaacatcttccgcgggtcgtacctggccggagcgggcttagctttttctattatgaagtccgtggggactggaaaaagaggcacaggtagccaaggggagacccttggagaaaagtggaagaaaaagctgaatcagctctcaaggaaagagttcgacctatataagaaaagtggcatcacggaggtagatcggaccgaagcaaaggagggtctgaaacgaggcgaaattacacatcacgccgtgtctagagggtccgctaagttgcagtggtttgtcgagcgcaacatggttatccccgaaggaagggtgattgacctgggctgtgggcggggaggctggagctactattgcgccggtctcaagaaagtcactgaggtgcgtgggtacaccaagggaggccctggccatgaggaaccggtacccatgtcaacatacgggtggaatatcgtgaaacttatgagtggaaaggatgttttctatctgccacctgagaaatgtgacactttgctgtgcgatataggtgaaagctccccctctcctaccgtggaggagagcagaacaattagggtcctcaagatggtggaaccatggttaaagaacaatcagttctgtatcaaagtcctgaacccctacatgcctaccgtgatcgagcaccttgaacgcctgcaacggaagcacggcgggatgctagttcgaaatccactctccagaaactcaactcatgagatgtattggatttctaatggaacgggcaacatagtagcaagtgtgaatatggtctcgaggctgttgctgaaccgctttacaatgacccaccggagacccactatcgaaaaagacgtggatctcggtgccgggacccgtcatgttaacgctgagccggagacacctaatatggacgtgattggagaaaggatcaagcggattaaagaggaacacaacagcacgtggcactacgacgatgagaatccatataagacctgggcgtaccatggctcctatgaagtcaaggccactggctctgcatcaagcatgatcaacggggtggtaaaacttctgacaaagccctgggacgtggttcctatggtcacccagatggctatgactgatacaaccccattcggacagcaacgcgtgtttaaagagaaggtggacacacgaactcccagatccatgccgggtaccaggcgggtcatgggcataacggccgagtggttatggcgcaccctggggagaaataaaaagcctaggttgtgcacacgagaagagttcactaagaaagttcggaccaacgcagccatgggagctgtgtttacagaagagaatcagtgggatagtgccaaggcggcagtagaagacgaggatttctggaaactcgtggaccgtgagagagaactgcacaagctaggcaaatgtggttcttgcgtctacaacatgatggggaagcgcgagaagaaacttggagaatttggcaaagccaaaggcagcagggctatctggtacatgtggctgggggcccggtatctcgagttcgaggcactgggatttttgaatgaagatcattggttctcaagagagaactcctacagtggtgtggaaggcgaggggctgcacaagctcggatatattcttcgcgacatcagcaaaattcccggcggtgctatgtacgccgatgacactgctgggtgggacaccaggatcacggaagatgacctgcataatgaggagaagataacacagcagatggatccagaacaccgacaattagccaacgcaatttttaaactgacctatcagaataaggttgtgaaggtccagcggcctactcccacaggaaccgtgatggacatcatctctagaaaagatcagaggggctccggccaagtagggacttacggattgaacaccttcacaaatatggaggcgcagctcattcgccagatggaaggtgagggcgttctgtcaaaggccgacctagaaaacccacaccttcccgagaaaaagataacgcagtggctggagaccaaaggggtggaacgtctcaagcggatggctatcagcggagatgactgcgtcgtgaagcctattgatgacagatttgccaacgcactgttggctttaaatgatatgggcaaagtgaggaaggacatcccacaatggcagccgtcgaaaggttggcatgattggcagcaggtccccttctgttctcaccatttccacgagctgattatgaaggacgggcgcaaactcgttgtgccttgccgaccacaagacgaacttatcggacgggccagaataagtcagggcgcaggctggtccctgagggagactgcctgtctagggaaggcgtatgctcagatgtggagcctgatgtactttcaccgcagagatctccggttggcctcaaacgcaatctgctccgccgtacccgtgcattgggtccctacatctaggaccacttggagcattcacgctcatcaccaatggatgacaaccgaagacatgctgacggtgtggaatcgtgtttggatcgaggataacccatggatggaggacaagacacccgtgaccacttgggaaaatgtcccttaccttggaaaacgagaggatcagtggtgtggtagtctgattggcctcacctcccgcgccacatgggcacagaacatcccgactgctattcagcaagtgaggagcttaatagggaatgaagagttcctggactatatgccatctatgaagcggtttaggaaagaggaagagtcagaaggagccatctggtga

SEQ ID NO: 15496 - RNA, 9873 nt, synthetic construct
  misc_feature 1..9873: note = derived and/or modified CDS sequence (opt3) from DENV-3__FJ639763__SS-prME
  source 1..9873: mol_type = other RNA
accagcctgtgcctcatgatgatccttcccgcagctctggcattccacttgacttccagggacggcgaacctaggatgattgtggggaagaacgaacggggaaagtctttactgtttaagactgcatcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggccgttatattcatcttactgatgcttgtgaccccatcgatgacaatgcgctgtgtcggcgtggggaacagagactttgtagaaggattgtcaggtgcgacctgggttgatgtggtcctggagcacggcgggtgcgtgacgactatggcaaagaataaacccacactagacattgagctccagaagaccgaagccactcagctggctacacttaggaaactgtgtatcgagggaaagattaccaacatcacgaccgatagccggtgccctacacagggcgaagccgtgttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcaaaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaactataggcccgggtaccatacacaaactgctggaccttggcaccttggcaagttggagctggactttaattattgcgaggggaccacagtcgtgattacggaaaactgtggaacccgtggcccaagtttacggactacaaccgtgtctggtaaactcatccacgagtggtgctgtcgaagctgcactctgccccctcttagatacatgggggaagatggatgttggtatggcatggagataaggccaatttccgaaaaggaggagaatatggtcaaatcactggttagcgccggttctggcgaagtggacaacttcacaatgggggtattgtgcctcgcaatcctgtttgaggaagtgatgcgcggaaagttcggcaagaaacatatgatcgctggggtcttctttaccttcgtgctactgctctccggacagattacgtggcgggatatggcccacactctgatcatgattggcagtaatgcaagcgacagaatgggtatgggggttacctaccttgccttgatagctacatttaagatccagcccttcctggcgttaggatttttcctcaggaaactgacctctcgcgagaaccttctgctaggcgtgggcctcgccatggcaactacactgcaattgccggaagatattgagcagatggctaatgggatcgccctgggattaatggccctcaagctgattacccagtttgagacatatcagctttggactgctctgatctccttgacctgttcaaacacgatattcacactcaccgtcgcatggcgaactgccaccctgatcctagcgggtgtgagtctgcttcctgtttgccaaagctcgtccatgcggaaaacagactggctcccaatgactgtggctgccatgggcgtcccacctctgcccttgtttattttctctctgaaggataccttaaagcgtagaagctggccactcaatgaaggggtaatggcagtgggactggtttcaatccttgccagttccctgttgaggaacgacgtgcctatggctggccccctcgtcgccggtgggctgctaattgcctgttacgtgatcacgggaacatctgcggatctgaccgtagagaaagctgccgacgtgacttgggaagaggaagcagagcagacaggcgtcagccataaccttatgataaccgttgacgatgacggcactatgcgcattaaggatgacgagacagaaaatatcctcaccgtgctgttgaaaacggccttactgatcgtgtccgggatttttccatactcaataccggctactctcctggtctggcacacctggcagaagcagacacaacggagcggagtgctttgggatgttcctagtcccccagagacccagaaagccgaactggaggagggtgtatatagaatcaagcagcagggcattttcgggaaaacacaagtgggagtcggcgtgcagaaggaaggtgtttttcatactatgtggcacgtgaccagaggggcagtcttgacgtacaacggaaagcgactagagcccaattgggcttctgtgaaaaaggacctgatctcctatggcggcgggtggcgcctcagcgcccagtggcaaaaaggagaagaggtacaggtcattgcggtggaacctggtaagaaccccaagaatttccagacaatgcccggcactttccagaccacaaccggggagatcggagccatagcactggattttaagcctggcacttcgggttcaccgatcattaaccgggaggggaaggttgtgggactttacggcaatggcgtcgtgaccaaaaacgggggatatgtttctggtatcgctcaaacaaatgccgaaccagacggccccacgcctgagttagaagaggaaatgttcaagaaaagaaacctgactattatggatctccacccagggagtggaaagaccaggaaatacttgcccgctatcgtgcgtgaggcaataaagcgccggctgagaacactcattctggcccctaccagggtcgtggccgctgagatggaagaggcgcttaagggcctgccgatccgatatcagactacagcaaccaaatccgaacatacgggtcgggagatcgtagacttgatgtgccacgccacttttacaatgcgcctactgagccccgtgagagttccaaattacaacctcattatcatggatgaagctcatttcaccgaccctgcctctatagcagccagggggtacattagcacccgggtcggaatgggcgaggctgcggccatctttatgactgcaacacccccaggcaccgctgatgccttccctcagtccaatgcacccattcaggacgaggaacgagacatcccagagagatcatggaacagtgggaatgaatggataacagattttgccggaaagactgtgtggttcgtgccgagcattaaagctggtaacgacatcgccaactgtttacgcaagaatggcaaaaaggtcatccaactgtctaggaagacgtttgataccgagtatcagaaaacaaaacttaacgactgggatttcgtagtgactaccgacatttccgagatgggggcgaattttaaagcagatcgtgttatcgaccctcggagatgcctgaagcccgtgattctcacagatggaccagaaagggtcatattggccggccccatgcctgtgaccgctgcctcagctgcacagcgccgaggtagagttgggcggaacccacagaaagagaatgaccaatacatcttcactggccagcccctgaacaatgatgaagaccacgcccattggacggaggctaagatgctcctggacaacattaatacccctgaaggaatcatcccggcccttttcgagccagagagggaaaagagtgcagcgattgatggcgagtatcgcctaaaaggggaaagccgtaagacatttgtggagctgatgagacggggagacttgcccgtctggttagcccacaaagtggcttccgaaggtataaagtacactgataggaaatggtgcttcgacggccagcgcaacaatcagatcctggaggagaacatggatgtagaaatttggaccaaggagggggagaagaaaaagctccgacctagatggctggacgcccggacatattctgatccccttgcactgaaagagtttaaggacttcgctgccggaaggaaatcgatcgcactcgatttggtgaccgaaattggccgcgttccaagccacctggcccatagaactaggaatgctctagacaacctggtcatgctccacacatcagagcatggtgggaaggcgtaccggcacgccgtggaggaacttcctgagacgatggaaaccctgttattgctgggcctcatgatcctgcttactggaggcgcaatgctgtttctcatatccgggaaaggaatcggtaagacaagtattggcttgatctgtgtgattgcttctagcgggatgctgtggatggccgagatccccttacaatggatagcctccgcaattgtcctagagttctttatgatggttctgctcatcccagaacctgagaagcagcgtaccccgcaggataatcaacttgcttatgtggtaattggaatcctgaccttggccgcgataatcgctgccaacgaaatgggcctgctcgagacaactaaacgcgacctgggtatgtcaaaggaacccggggtggtctctccaacgagctaccttgatgtggacctccaccctgcaagtgcctggaccctgtacgctgttgcaacaactgtgattacccccatgttgcgacatacaatcgaaaattccaccgccaacgtcagcctggcggctattgccaaccaggcagtagtgttaatgggcctagacaaaggatggccaatctctaagatggatctgggcgttcctctccttgccctggggtgctattcacaggtgaatcccttgactctgacggctgccgtcctcctgcttataacacactacgcaattatcggaccgggcttacaggctaaagccaccagagaggcgcaaaagaggactgccgcaggtatcatgaagaacccaaccgtggacgggattatgacaatcgatctggaccctgtcatatatgattccaaattcgagaagcagctcggacaggtgatgttgctggttctatgtgctgtgcagctgctccttatgcggacaagttgggccctgtgcgaggcattgaccctggctacaggccccattacgaccctctgggaaggtagcccaggcaaattttggaatactacaatcgccgtatcgatggccaacattttccgcgggtcttacctggcgggagctggcttagcattttccatcatgaaaagcgtggggaccggaaaaagaggcactggttcacaaggggagacacttggagaaaagtggaagaaaaagctgaatcagctcagtaggaaagagttcgacctatataagaaatctggcataaccgaggtcgatcggacggaagccaaggagggtctgaaacgaggcgaaatcacccatcacgctgtttccagagggagcgccaagttgcagtggtttgtggagcgcaacatggtcattcccgaaggaagggtgatcgacctgggctgtgggcggggaggctggtcatactattgcgcaggtctcaagaaagtaacagaggtgcgtgggtacactaagggaggccctggccatgaggaaccggttcccatgagtacctacgggtggaatattgtgaaacttatgagcggaaaggatgtcttctatctgccacctgagaaatgtgacacattgctgtgcgatatcggtgaatcctctcccagccctactgtggaggagtccagaaccattagggtcctcaagatggtggaaccatggttaaagaacaatcagttctgtatcaaagttctgaacccctacatgcctacagtaatagagcaccttgaacgcctgcaacggaagcacggcgggatgctagtgcgaaatccactctcaagaaactctacccatgagatgtattggattagtaatggaactggcaacatcgtcgcctcggtgaatatggttagcaggctgttgctgaaccgctttacgatgacacaccggagacccaccatcgaaaaagacgtggatctcggtgctgggactcgtcatgtcaacgcggagccggagacccctaatatggacgtgattggagaaaggataaagcggatcaaagaggaacacaactccacatggcactacgacgatgagaatccatataagacgtgggcctaccatggctcttatgaagtaaaggcaaccggctcagctagctccatgattaacggggtggttaaacttctgactaagccctgggacgtcgtgcctatggtgacacagatggccatgaccgatactacaccattcggacagcaacgcgtctttaaagagaaggttgacacccgaacacccagaagtatgccgggtactaggcgggtgatgggcatcaccgcagagtggttatggcgcacgctggggagaaataaaaagcctaggttgtgcacccgagaagagttcacaaagaaagtacggactaacgccgctatgggagccgtgtttaccgaagagaatcagtgggattctgcgaaggcagccgtcgaagacgaggatttctggaaactcgtggaccgtgagagagaactgcacaagctaggcaaatgtggtagctgcgtttacaacatgatggggaagcgcgagaagaaacttggagaatttggcaaagctaaaggctcaagggccatttggtacatgtggctgggggcacggtatctcgagttcgaggctctgggatttttgaatgaagatcattggttctccagagagaacagttacagcggtgtggaaggcgaggggctgcacaagctcggatatatccttcgcgacatatctaaaatccccggcggtgccatgtacgctgatgacacagccgggtgggacactaggattaccgaagatgacctgcataatgaggagaagatcacgcagcagatggatccagaacaccgacaattagcaaacgcgatttttaaactgacatatcagaataaggtcgtgaaggtacagcggcctacccccactggaacagttatggacatcatatccagaaaagatcagaggggctcaggccaagtggggacctacggattgaacactttcaccaatatggaggcccagctcattcgccagatggaaggtgagggcgtcctgagcaaggctgacctagaaaacccacaccttcccgagaaaaagatcacacagtggctggagacgaacggggtggaacgtctcaaacggatggccatctcgggagatgactgcgtggtcaagcctattgatgacagatttgcaaatgctctgttggccttaaacgatatgggcaaggttaggaaagacataccacaatggcagccgtctaagggttggcatgattggcaacaggtgcccttctgtagtcaccatttccacgagctgatcatgaaagacgggcgcaagctcgtagtgccttgccgaccacaagacgaacttattggacgggcaagaatctcccagggcgccggctggagcctgagggagaccgcgtgtctagggaaggcttatgcccagatgtggtcactgatgtactttcaccgcagagatctccggttggcatccaatgccatttgctctgctgtccccgtgcattgggttcctactagcaggacaacctggagtatccacgcccatcaccaatggatgactacagaagacatgctgaccgtgtggaaccgtgtctggatagaggataatccatggatggaggacaagacgcccgtgacaacctgggaaaacgtaccttaccttggaaagcgagaggatcagtggtgtggttccctgatcggcctcactagccgcgcaacctgggctcagaatattccgacagccatccagcaagttagatctttaattgggaacgaagagttcctggactatatgccatcaatgaaacggtttaggaaggaggaagagagtgaaggagcgatctggtga

SEQ ID NO: 15497 - RNA, 9873 nt, synthetic construct
  misc_feature 1..9873: note = derived and/or modified CDS sequence (opt3) from DENV-3__FJ639765__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattatcctagagttctttatgatggttctgctcattccagaacctgagaagcagcgtaccccgcaggataatcaacttgcatatgtggtaatcggaatactgacattggctgccatcattgcggctaacgaaatgggcctgctcgagactacgaaacgcgacctgggtatgtccaaggaacccggggtggtctcaccaacctcttaccttgatgtggacctccaccctgccagcgcatggacactgtacgccgttgctactaccgtgatcacacccatgttgcgacataccattgagaatagtactgcaaacgtctccctggccgcgatcgctaaccaggccgtagtgttaatgggcctagacaaaggatggccaataagcaagatggatctgggcgttcctctccttgcactggggtgctattctcaggtgaatcccttgacgctgacagccgctgtcctcctgcttattacccactacgccatcatcggaccgggcttacaggcaaaagctactagagaggcccaaaagaggaccgcggccggtattatgaagaacccaacagtggacgggatcatgactatagatctggaccctgtcatttatgattcaaaattcgaaaagcagctcggacaggtgatgttgctggttctatgtgcagtgcagctgctccttatgcggacctcctgggctctgtgcgaggccttgacactggcaacgggccccatcaccactctctgggaaggtagtccaggcaaattttggaatacaaccattgctgtaagcatggccaacatcttccgcgggtcgtacctggccggagcgggcttagctttttctataatgaagtccgtggggactggaaaaagaggcacaggtagccaaggggagacccttggagaaaagtggaagaaaaagctgaatcagctctcaaggaaagagttcgacctatataagaaaagtggcatcacggaggtcgatcggaccgaagcaaaggagggtctgaaacgaggcgaaattacacatcacgccgtttctagagggtccgctaagttgcagtggtttgtggagcgcaacatggtcatccccgaaggaagggtgattgacctgggctgtgggcggggaggctggagctactattgcgccggtctcaagaaagtaactgaggtgcgtgggtacaccaagggaggccctggccatgaggaaccggttcccatgtcaacatacgggtggaatatcgtgaaacttatgagtggaaaggatgtcttctatctgccacctgagaaatgtgacactttgctgtgcgatattggtgaaagctccccctctcctaccgtggaggagagcagaacaatcagggtcctcaagatggtggaaccatggttaaagaacaatcagttctgtataaaagttctgaacccctacatgcctaccgtaattgagcaccttgaacgcctgcaacggaagcacggcgggatgctagtgcgaaatccactctccagaaactcaactcatgagatgtattggatctctaatggaacgggcaacatcgtcgcaagtgtgaatatggtttcgaggctgttgctgaaccgctttacaatgacccaccggagacccactattgaaaaagacgtggatctcggtgccgggacccgtcatgtcaacgctgagccggagacacctaatatggacgtgataggagaaaggatcaagcggattaaagaggaacacaacagcacgtggcactacgacgatgagaatccatataagacctgggcgtaccatggctcctatgaagtaaaggccactggctctgcatcaagcatgatcaacggggtggttaaacttctgacaaagccctgggacgtcgtgcctatggtgacccagatggctatgactgatacaaccccattcggacagcaacgcgtctttaaagagaaggttgacacacgaactcccagatccatgccgggtaccaggcgggtgatgggcattacggccgagtggttatggcgcaccctggggagaaataaaaagcctaggttgtgcacacgagaagagttcactaagaaagtacggaccaacgcagccatgggagctgtgtttacagaagagaatcagtgggatagtgccaaggcggcagtcgaagacgaggatttctggaaactcgtggaccgtgagagagaactgcacaagctaggcaaatgtggttcttgcgtttacaacatgatggggaagcgcgagaagaaacttggagaatttggcaaagccaaaggcagcagggctatctggtacatgtggctgggggcccggtatctcgagttcgaggcactgggatttttgaatgaagatcattggttctcaagagagaactcctacagtggtgtggaaggcgaggggctgcacaagctcggatatatacttcgcgacatcagcaaaattcccggcggtgctatgtacgccgatgacactgctgggtgggacaccaggatcacggaagatgacctgcataatgaggagaagattacacagcagatggatccagaacaccgacaattagccaacgcaatctttaaactgacctatcagaataaggtcgtgaaggtacagcggcctactcccacaggaaccgttatggacataatttctagaaaagatcagaggggctccggccaagtggggacttacggattgaacaccttcacaaatatggaggcgcagctcatccgccagatggaaggtgagggcgtcctgtcaaaggccgacctagaaaacccacaccttcccgagaaaaagatcacgcagtggctggagaccaaaggggtggaacgtctcaagcggatggctattagcggagatgactgcgtggtcaagcctatagatgacagatttgccaacgcactgttggctttaaatgatatgggcaaagttaggaaggacatcccacaatggcagccgtcgaaaggttggcatgattggcaacaggtgcccttctgttctcaccatttccacgagctgattatgaaggacgggcgcaaactcgtagtgccttgccgaccacaagacgaacttatcggacgggccagaattagtcagggcgcaggctggtccctgagggagactgcctgtctagggaaggcgtatgctcagatgtggagcctgatgtactttcaccgcagagatctccggttggcctcaaacgcaatctgctccgccgtccccgtgcattgggttcctacatctaggaccacttggagcatacacgctcatcaccaatggatgacaaccgaagacatgctgacggtgtggaatcgtgtctggatcgaggataacccatggatggaggacaagacacccgtgaccacttgggaaaatgtaccttaccttggaaaacgagaggatcagtggtgtggtagtctgattggcctcacctcccgcgccacatgggcacagaacatcccgactgctattcagcaagttaggagcttaatcgggaatgaagagttcctggactatatgccatctatgaagcggtttaggaaagaggaagagtcagaaggagccatttggtga

SEQ ID NO: 15498 - RNA, 9873 nt, synthetic construct
  misc_feature 1..9873: note = derived and/or modified CDS sequence (opt3) from DENV-3__FJ639766__SS-prME
  source 1..9873: mol_type = other RNA
accagcctgtgcctcatgatgatccttcccgccgctctggcattccacttgacatccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttcaatctgaaggataccttaaagcgtagatcttggccactcaacgaaggggtgatggccgttggactggtgagcatccttgcatcaagtctgttgaggaacgacgtccctatggccggccccctcgtggctggtgggctgctaattgcatgttacgtaatcacgggaacatccgccgatctgaccgtggagaaagcggctgacgtcacttgggaagaggaagccgagcagacaggcgtttctcataatcttatgataaccgtggacgatgacggcactatgcgcattaaggatgacgagacagaaaacatcctcaccgtgctgttgaaaacggcattactgatcgtcagcgggatttttccatactccataccggccactctcctggtgtggcacacctggcagaagcagacacaacggtcaggagttctttgggatgtacctagcccaccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaatggaaagcgactagagcccaactgggcaagtgtcaagaaggacctgatctcttatggcggcgggtggcgcctctccgctcagtggcaaaaaggagaagaggtccaggtgattgccgttgaacctggtaagaatcccaagaatttccagacaatgcccggcactttccagaccacaaccggggagatcggagcgatagccctggattttaagcctggcactagcggttcgccgatcattaatcgggaggggaaggtggtcggactttacggcaacggcgtggttaccaaaaatgggggatatgtgtcaggtatcgcacaaacaaacgctgaaccagacggccccacgcctgagttagaagaggaaatgttcaagaaaagaaatctgactattatggatctccacccagggtctggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaaagtgaacatacgggtcgggagatcgtggacttgatgtgccacgcaacttttacaatgcgcctactgtcccccgttagagtcccaaactacaatctcattatcatggatgaagcccatttcaccgaccctgctagcatagccgcaagggggtacatttctacccgggtgggaatgggcgaggccgctgcgatctttatgactgccacacccccaggcaccgcagatgctttccctcagagcaacgcccccattcaggacgaggaacgagacatcccagagagatcctggaactcagggaacgaatggataacagattttgcaggaaagactgtgtggttcgtcccgagtattaaagccggtaacgacatcgctaattgtttacgcaagaacggcaaaaaggtaatccaactgagcaggaagacgtttgataccgagtatcagaaaacaaaacttaatgactgggatttcgtggttactaccgacatttctgagatgggggccaactttaaagcggatcgtgtgatcgaccctcggagatgcctgaagcccgtcattctcacagatggaccagaaagggtgatattggcaggccccatgcctgttaccgccgcttccgccgctcagcgccgaggtagagtggggcggaatccacagaaagagaacgaccaatacatcttcactggccagcccctgaataacgatgaagaccacgcacattggacggaggccaagatgctcctggacaatattaacacccctgaaggaatcatcccggctcttttcgagccagagagggaaaagtcagccgcaattgatggcgagtatcgcctaaaaggggaaagtcgtaagacatttgtcgagctgatgagacggggagacttgcccgtgtggttagcgcacaaagtagccagcgaaggtataaagtacactgataggaaatggtgcttcgacggccagcgcaataaccagatcctggaggagaatatggatgtggaaatttggaccaaggagggggagaaaaagaagctccgacctagatggctggacgctcggacatattccgatccccttgccctgaaagagtttaaggacttcgcagctggaaggaaatctatcgccctcgatttggttaccgaaattggccgcgtcccaactcacctggcacatagaacaaggaacgccctagacaatctggtgatgctccacacgtcggagcatggtgggaaggcttaccggcacgcggtggaggaacttcctgagaccatggaaactctgttattgctgggcctcatgatcctgcttacaggaggcgccatgctgtttctcataagcgggaaaggaatcggtaagacctcaattggcttgatctgtgtcattgcatccagtgggatgctgtggatggctgagatccccttacaatggatagcctctgccattgttctagagttctttatgatggtgctgctcatcccagaacctgagaagcagcgtaccccgcaggataaccaacttgcatatgtagtgattggaatcctgacattggctgccataatcgcggctaatgaaatgggcctgctcgagactacgaaacgcgacctgggtatgagcaaggaacccggggtcgtgtccccaacctcataccttgatgttgacctccaccctgcctctgcatggacactgtacgccgtggctactaccgtcattacacccatgttgcgacataccatcgagaacagcactgcaaacgtaagtctggccgcgattgctaatcaggccgtggttttaatgggcctagacaaaggatggccaatctccaagatggatctgggcgtgcctctccttgcactggggtgctatagccaggtcaaccccttgacgctgacagccgctgtgctcctgcttataacccactacgccattatcggaccgggcttacaggcaaaagctactagagaggcccaaaagaggaccgcggccggtatcatgaagaatccaacagtcgacgggattatgactatcgatctggaccctgtgatatatgattctaaattcgaaaagcagctcggacaggttatgttgctggtgctatgtgcagtacagctgctccttatgcggacctcatgggctctgtgcgaggccttgacactggcaacgggccccattaccactctctgggaaggttccccaggcaaattttggaacacaaccatcgctgtgagtatggccaatattttccgcgggagctacctggccggagcgggcttagctttttcgatcatgaagtctgtcgggactggaaaaagaggcacaggttcccaaggggagacccttggagaaaagtggaagaaaaagctgaaccagctcagcaggaaagagttcgacctatataagaaatcaggcataacggaggttgatcggaccgaagcaaaggagggtctgaaacgaggcgaaatcacacatcacgccgtgagtagagggtctgctaagttgcagtggtttgtcgagcgcaatatggtgattcccgaaggaagggtaatcgacctgggctgtgggcggggaggctggtcctactattgcgccggtctcaagaaagtgactgaggttcgtgggtacaccaagggaggccctggccatgaggaaccggtgcccatgagcacatacgggtggaacattgtcaaacttatgtcaggaaaggatgtgttctatctgccacctgagaaatgtgacactttgctgtgcgatatcggtgaaagtagcccctcccctaccgtcgaggagtctagaacaattagggtgctcaagatggttgaaccatggttaaagaataaccagttctgtatcaaagtactgaatccctacatgcctaccgtgatagagcaccttgaacgcctgcaacggaagcacggcgggatgctagtccgaaacccactcagcagaaattccactcatgagatgtattggatttcaaacggaacgggcaatatcgtggcatctgttaacatggtgagtaggctgttgctgaaccgctttacaatgacccaccggagacccactatcgaaaaagacgtcgatctcggtgccgggacccgtcatgtgaatgctgagccggagacacctaacatggacgtaattggagaaaggataaagcggatcaaagaggaacacaattcgacgtggcactacgacgatgagaacccatataagacctgggcgtaccatggcagctatgaagtgaaggccactggctccgcatcttcaatgattaatggggttgtcaaacttctgacaaagccctgggacgtggtgcctatggtcacccagatggctatgactgatacaaccccattcggacagcaacgcgtttttaaagagaaggtggacacacgaactcccagaagcatgccgggtaccaggcgggtaatgggcatcacggccgagtggttatggcgcaccctggggagaaacaaaaagcctaggttgtgcacacgagaagagttcactaagaaagtgcggaccaatgcagccatgggagctgtctttacagaagagaaccagtgggattccgccaaggcggcagtggaagacgaggatttctggaaactcgttgaccgtgagagagaactgcacaagctaggcaaatgtggtagttgcgtgtacaatatgatggggaagcgcgagaagaaacttggagaatttggcaaagccaaaggctctagggctatttggtacatgtggctgggggcccggtatctcgagttcgaggcactgggatttttgaacgaagatcattggttcagcagagaaaattcatactccggtgtcgagggcgaggggctgcacaagctcggatatatccttcgcgacataagtaaaatccccggcggtgctatgtacgccgatgacactgctgggtgggacaccaggattacggaagatgacctgcataacgaggagaagatcacacagcagatggatccagaacaccgacaattagccaatgcaatttttaaactgacctatcagaacaaggtggtaaaggttcagcggcctactcccacaggaaccgtgatggacatcataagcagaaaagatcagaggggctctggccaagtcgggacttacggattgaataccttcacaaacatggaggcgcagctcattcgccagatggaaggtgagggcgtgctgtccaaggccgacctagaaaacccacaccttcccgagaaaaagatcacgcagtggctggagaccaaaggggtggaacgtctcaagcggatggctatctcaggagatgactgcgtcgttaagcctattgatgacagatttgccaatgcactgttggctttaaacgatatgggcaaagtgaggaaggacataccacaatggcagccgagcaaaggttggcatgattggcagcaggtacccttctgttcgcaccatttccacgagctgatcatgaaggacgggcgcaaactcgtggtcccttgccgaccacaagacgaacttattggacgggccagaatctctcagggcgcaggctggagtctgagggagactgcctgtctagggaaggcgtatgctcagatgtggtccctgatgtactttcaccgcagagatctccggttggccagcaatgcaatttgctcagccgtgcccgttcattgggtgcctacatccaggaccacttggtctatccacgctcatcaccaatggatgacaaccgaagacatgctgacggtctggaaccgtgtgtggatagaggataatccatggatggaggacaagacacccgtaaccacttgggaaaacgttccttaccttggaaaacgagaggatcagtggtgtggtagcctgatcggcctcaccagtcgcgccacatgggcacagaatattccgactgctatccagcaagtgagatccttaattgggaacgaagagttcctggactatatgccaagcatgaagcggtttaggaaagaggaagagtctgaaggagccatctggtga

SEQ ID NO: 15499 - RNA, 9873 nt, synthetic construct
  misc_feature 1..9873: note = derived and/or modified CDS sequence (opt3) from DENV-3__FJ639767__SS-prME
  source 1..9873: mol_type = other RNA
accagcctgtgcctcatgatgatccttccagccgctctggcattccacttgacatccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaagaagaagctccgacctagatggctggacgctcggacatattctgatccccttgccctgaaagagtttaaggacttcgcagctggaaggaaatcgatcgccctcgatttggttaccgaaattggccgcgtcccaagccacctggcacatagaactaggaatgccctagacaacctggtgatgctccacacatcagagcatggtgggaaggcttaccggcacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgtaccccgcaggataatcaacttgcatatgtagtgattggaatcctgaccttggctgccataatcgcggctaacgaaatgggcctgctcgagacaactaaacgcgacctgggtatgtcaaaggaacccggggtcgtgtctccaattagctaccttgatgttgacctccaccctgccagtgcatggacgctgtacgccgtggctaccacagtcatcactcccatgttgcgacataccattgaaaattccacagcaaacgtaagcctggccgcgatcgctaaccaggccgtggttttaatgggcctagacaaaggatggccaatatctaagatggatctgggcgtgcctctccttgcactggggtgctattcacaggtcaatcccttgaccctgactgccgctgtgctcctgcttattacgcactacgccatcatcggaccgggcttacaggcaaaagctacaagagaggcccaaaagaggaccgcggccggtattatgaagaacccaactgtcgacgggatcatgaccatagatctggaccctgtgatttatgattccaaattcgagaagcagctcggacaggttatgttgctggtgctatgtgcagtacagctgctccttatgcggacaagttgggctctgtgcgaggccttgactctggcaaccggccccatcacaacgctctgggaaggtagcccaggcaaattttggaataccactattgctgtgtcgatggccaacatcttccgcgggtcttacctggccggagcgggcttagctttttccataatgaaaagcgtcgggacaggaaaaagaggcaccggttcacaaggggagactcttggagaaaagtggaagaaaaagctgaatcagctcagtaggaaagagttcgacctatataagaaatctggcatcacagaggttgatcggaccgaagcaaaggagggtctgaaacgaggcgaaattacgcatcacgccgtgtccagagggagcgctaagttgcagtggtttgtcgagcgcaacatggtgatccccgaaggaagggtaattgacctgggctgtgggcggggaggctggtcatactattgcgccggtctcaagaaagtgaccgaggttcgtgggtacacaaagggaggccctggccatgaggaaccggtgcccatgagtacttacgggtggaatatcgtcaaacttatgagcggaaaggatgtgttctatctgccacctgagaaatgtgacaccttgctgtgcgatattggtgaatcctctcccagccctacagtcgaggagtccagaactatcagggtgctcaagatggttgaaccatggttaaagaacaatcagttctgtataaaagtactgaacccctacatgcctaccgtgattgagcaccttgaacgcctgcaacggaagcacggcgggatgctagtccgaaatccactctcaagaaactctacacatgagatgtattggatcagtaatggaaccggcaacatcgtggcatcggttaatatggtgagcaggctgttgctgaaccgctttactatgacgcaccggagacccacaattgaaaaagacgtcgatctcggtgccgggacccgtcatgtgaacgctgagccggagactcctaatatggacgtaataggagaaaggatcaagcggattaaagaggaacacaactccacctggcactacgacgatgagaatccatataagacatgggcgtaccatggctcttatgaagtgaaggccacgggctcagcaagctccatgatcaacggggttgtcaaacttctgaccaagccctgggacgtggtgcctatggtcactcagatggctatgacagataccactccattcggacagcaacgcgtttttaaagagaaggtggacacacgaacccccagaagtatgccgggtacaaggcgggtaatgggcattactgccgagtggttatggcgcaccctggggagaaataaaaagcctaggttgtgcacgcgagaagagttcaccaagaaagtgcggacaaacgcagccatgggagctgtctttactgaagagaatcagtgggattctgccaaggcggcagtggaagacgaggatttctggaaactcgttgaccgtgagagagaactgcacaagctaggcaaatgtggtagctgcgtgtacaacatgatggggaagcgcgagaagaaacttggagaatttggcaaagccaaaggctcaagggctatctggtacatgtggctgggggcccggtatctcgagttcgaggcactgggatttttgaatgaagatcattggttctccagagagaacagttacagcggtgtcgaaggcgaggggctgcacaagctcggatatatacttcgcgacatctctaaaattcccggcggtgctatgtacgccgatgacaccgctgggtgggacacaaggatcactgaagatgacctgcataatgaggagaagattacccagcagatggatccagaacaccgacaattagccaacgcaatctttaaactgacgtatcagaataaggtggtaaaggttcagcggcctacacccaccggaactgtgatggacataatttccagaaaagatcagaggggctcaggccaagtcgggacatacggattgaacaccttcactaatatggaggcgcagctcatccgccagatggaaggtgagggcgtgctgagcaaggccgacctagaaaacccacaccttcccgagaaaaagatcacccagtggctggagacaaaaggggtggaacgtctcaagcggatggctatttcgggagatgactgcgtcgttaagcctatagatgacagatttgccaacgcactgttggctttaaatgatatgggcaaagtgaggaaggacatcccacaatggcagccgtctaaaggttggcatgattggcagcaggtacccttctgtagtcaccatttccacgagctgattatgaaggacgggcgcaaactcgtggtcccttgccgaccacaagacgaacttatcggacgggccagaatttcccagggcgcaggctggagcctgagggagacggcctgtctagggaaggcgtatgctcagatgtggtcactgatgtactttcaccgcagagatctccggttggcctccaacgcaatctgctctgccgtgcccgttcattgggtgcctaccagcaggactacatggagtatacacgctcatcaccaatggatgaccactgaagacatgctgacagtctggaatcgtgtgtggatcgaggataacccatggatggaggacaagacccccgtaacgacatgggaaaatgttccttaccttggaaaacgagaggatcagtggtgtggttccctgattggcctcaccagccgcgccacttgggcacagaacatcccgaccgctattcagcaagtgagatctttaatcgggaatgaagagttcctggactatatgccatcaatgaagcggtttaggaaagaggaagagagtgaaggagccatttggtga

SEQ ID NO: 15500 - RNA, 9873 nt, synthetic construct
  misc_feature 1..9873: note = derived and/or modified CDS sequence (opt3) from DENV-3__FJ639768__SS-prME
  source 1..9873: mol_type = other RNA
accagcctgtgcctcatgatgatccttccagccgctctggcattccacttgacatccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcaacgctcagtggcaaaaaggagaagaggtccaggtgattgccgttgaacctggtaagaatcccaagaatttccagacaatgcccggcactttccagaccacaaccggggagatcggagcgatagccctggattttaagcctggcactagcggttcgccgatcattaatcgggaggggaaggtggtcggactttacggcaacggcgtggttaccaaaaatgggggatatgtgtcaggtatcgcacaaacaaacgctgaaccagacggccccacgcctgagttagaagaggaaatgttcaagaaaagaaatctgactattatggatctccacccagggtctggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaaagtgaacatacgggtcgggagatcgtggacttgatgtgccacgcaacttttacaatgcgcctactgtcccccgttagagtcccaaactacaatctcattatcatggatgaagcccatttcaccgaccctgctagcatagccgcaagggggtacatttctacccgggtgggaatgggcgaggccgctgcgatctttatgactgccacacccccaggcaccgcagatgctttccctcagagcaacgcccccattcaggacgaggaacgagacatcccagagagatcctggaactcagggaacgaatggataacagattttgcaggaaagactgtgtggttcgtcccgagtattaaagccggtaacgacatcgctaattgtttacgcaagaacggcaaaaaggtaatccaactgagcaggaagacgtttgataccgagtatcagaaaacaaaacttaatgactgggatttcgtggttactaccgacatttctgagatgggggccaactttaaagcggatcgtgtgatcgaccctcggagatgcctgaagcccgtcattctcacagatggaccagaaagggtgatattggcaggccccatccctgttaccgccgcttccgccgctcagcgccgaggtagagtggggcggaatccacagaaagagaacgaccaatacattttcactggccagcccctgaataacgatgaagaccacgcacattggacggaggccaagatgctcctggacaatatcaacacccctgaaggaatcattccggctcttttcgagccagagagggaaaagtcagccgcaatagatggcgagtatcgcctaaaaggggaaagtcgtaagacatttgtcgagctgatgagacggggagacttgcccgtgtggttagcgcacaaagtagccagcgaaggtatcaagtacactgataggaaatggtgcttcgacggccagcgcaataaccagattctggaggagaatatggatgtggaaatctggaccaaggagggggagaaaaagaagctccgacctagatggctggacgctcggacatattccgatccccttgccctgaaagagtttaaggacttcgcagctggaaggaaatctattgccctcgatttggttaccgaaatcggccgcgtcccatcgcacctggcacatagaactaggaacgccctagacaatctggtgatgctccacacaagcgagcatggtgggaaggcttaccggcacgcggtggaggaacttcctgagacgatggaaaccctgttattgctgggcctcatgatactgcttactggaggcgccatgctgtttctcatctcagggaaaggaattggtaagacatccatcggcttgatttgtgtcatcgcaagttctgggatgctgtggatggctgagatacccttacaatggattgccagcgccatcgttctagagttctttatgatggtgctgctcattccagaacctgagaagcagcgtaccccgcaggataaccaacttgcatatgtagtgatcggaatactgaccttggctgccatcattgcggctaatgaaatgggcctgctcgagacaactaaacgcgacctgggtatgtccaaggaacccggggtcgtgtcaccaacgtcttaccttgatgttgacctccaccctgccagcgcatggaccctgtacgccgtggctacaactgtcatcacccccatgttgcgacatacaattgagaacagtaccgcaaacgtatccctggccgcgatcgctaatcaggccgtggttttaatgggcctagacaaaggatggccaataagcaagatggatctgggcgtgcctctccttgcactggggtgctattctcaggtcaaccccttgactctgacggccgctgtgctcctgcttattacacactacgccatcatcggaccgggcttacaggcaaaagctaccagagaggcccaaaagaggactgcggccggtattatgaagaatccaaccgtcgacgggatcatgacaatagatctggaccctgtgatttatgattcaaaattcgaaaagcagctcggacaggttatgttgctggtgctatgtgcagtacagctgctccttatgcggacttcctgggctctgtgcgaggccttgaccctggcaacaggccccatcacgaccctctgggaaggtagtccaggcaaattttggaacactacaattgctgtgagcatggccaatatcttccgcgggtcgtacatagccggagcgggcctggctttttctatcatgaagtccgtcgggaccggaaaaagaggcactggtagccaaggggagacattaggagaaaagtggaagaagaaacttaaccagctgtcaaggaaagagttcgacctctataagaaaagtggcattaccgaggttgatcggacggaagcaaaagagggtctaaaacgaggcgaaatcacccatcacgccgtgtctagagggtccgctaagctgcagtggtttgtcgagcgcaatatggtgattcccgaaggaagggtaatcgacttgggctgtgggcggggaggctggagctactattgcgccggtctgaagaaagtgacagaggttcgtgggtacactaagggaggccctggccatgaggaaccggtgcccatgtcaacctacgggtggaacattgtcaaactcatgagtggaaaggatgtgttctatcttccacctgagaaatgtgacacactgttgtgcgatatcggtgaaagctccccctctcctactgtcgaggagagcagaaccataagggtgctgaagatggttgaaccatggctcaagaataaccagttctgtattaaagtattaaatccctacatgcctacagtgatcgagcacctggaacgccttcaacggaagcacggcgggatgctggtccgaaacccactatccagaaattcaacccatgagatgtattggatctctaacggaactggcaatattgtggcaagtgttaacatggtgtcgaggctcctgttgaaccgctttacgatgacacaccggagacccaccatagaaaaagacgtcgatctgggtgccgggactcgtcatgtgaatgctgagccggagacccctaacatggacgtaatcggagaaaggattaagcggatcaaagaggaacacaatagcacatggcactacgacgatgagaacccatataagacgtgggcgtaccatggctcctatgaagtgaaggccaccggctctgcatcaagcatgattaatggggttgtcaaactccttactaagccctgggacgtggtgcctatggtcacacagatggctatgaccgatactacaccattcggacagcaacgcgtttttaaagagaaggtggacacccgaacacccagatccatgccgggtactaggcgggtaatgggcatcaccgccgagtggctgtggcgcacgttagggagaaacaaaaagcctaggctgtgcacccgagaagagttcacaaagaaagtgcggactaatgcagccatgggagctgtctttaccgaagagaaccagtgggatagtgccaaggcggcagtggaagacgaggatttctggaaattggttgaccgtgagagagaactccacaagctgggcaaatgtggttcttgcgtgtacaatatgatggggaagcgcgagaaaaagctaggagaatttggcaaggccaaaggcagcagggctatatggtacatgtggcttggggcccggtatctggagttcgaggcactcggatttctgaacgaagatcattggttctcaagagaaaattcctacagtggtgtcgagggcgaggggttgcacaagctgggatatatcctccgcgacattagcaaaatccccggcggtgctatgtacgccgatgacacagctgggtgggacactaggattaccgaagatgaccttcataacgaggagaagatcacgcagcagatggatccagaacaccgacaactggccaatgcaatatttaaattaacatatcagaacaaggtggtaaaggttcagcggcctacccccactggaacagtgatggacattatctctagaaaagatcagaggggctccggccaagtcgggacctacggactgaatactttcaccaacatggaggcgcagttgatccgccagatggaaggtgagggcgtgctctcaaaggccgacctggaaaacccacacctacccgagaaaaagattacacagtggcttgagacgaaaggggtggaacgtctgaagcggatggctataagcggagatgactgcgtcgttaagcctatcgatgacagatttgccaatgcactcctggctttgaacgatatgggcaaagtgaggaaggacattccacaatggcagccgtcgaaaggttggcatgattggcagcaggtacccttctgttctcaccatttccacgagttaatcatgaaggacgggcgcaaactggtggtcccttgccgaccacaagacgaactcattggacgggccagaatcagtcagggcgcaggctggtcccttagggagaccgcctgtctggggaaggcgtatgctcagatgtggagcctaatgtactttcaccgcagagatctgcggctcgcctcaaatgcaatatgctccgccgtgcccgttcattgggtgcctacttctaggacaacctggagcatccacgctcatcaccaatggatgactacagaagacatgttgaccgtctggaaccgtgtgtggattgaggataatccatggatggaggacaagacgcccgtaacaacctgggaaaacgttccttacctgggaaaacgagaggatcagtggtgtggtagtcttatcggcctgacttcccgcgccacctgggcacagaatattccgacagctatccagcaagtgagaagcctcattgggaacgaagagttcttagactatatgccatctatgaagcggtttaggaaagaggaagagtcagaaggagccatatggtga

SEQ ID NO: 15501 - RNA, 9873 nt, synthetic construct
  misc_feature 1..9873: note = derived and/or modified CDS sequence (opt3) from DENV-3__FJ639769__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgtagtgcagctgctccttatgcggacctcctgggcactgtgcgaggctttgacactggccacgggccccattaccactctctgggaaggtagtccaggcaaattttggaatacaaccatcgcagtcagcatggctaacattttccgcgggtcgtacctggccggagccggcttagcgttttctatcatgaagtccgttgggactggaaaaagaggcacaggtagccaaggggagacccttggagaaaagtggaagaaaaagctgaatcagctctcaaggaaagagttcgacctatataagaaaagtggcataacggaggtggatcggaccgaagctaaggagggtctgaaacgaggcgaaatcacacatcacgcagtctctagagggtccgccaagttgcagtggtttgtggagcgcaacatggtaattcccgaaggaagggtgatcgacctgggctgtgggcggggaggctggagctactattgcgctggtctcaagaaagttactgaggtgcgtgggtacaccaagggaggccctggccatgaggaaccggtccccatgtcaacatacgggtggaatattgtgaaacttatgagtggaaaggatgtcttctatctgccacctgagaaatgtgacactttgctgtgcgatatcggtgaaagctccccctctcctaccgtggaggagagcagaacaattagggttctcaagatggtagaaccatggttaaagaacaatcagttctgtatcaaagtgctgaacccctacatgcctaccgtcatagagcaccttgaacgcctgcaacggaagcacggcgggatgctagtgcgaaatccactctccagaaactcaactcatgagatgtattggatttctaatggaacgggcaacatcgttgccagtgtgaatatggtctcgaggctgttgctgaaccgctttacaatgacccaccggagacccactatcgaaaaagacgtggatctcggtgcagggacccgtcatgtaaacgccgagccggagacacctaatatggacgtgattggagaaaggataaagcggatcaaagaggaacacaacagcacgtggcactacgacgatgagaatccatataagacctgggcttaccatggctcctatgaagttaaggcgactggctctgcctcaagcatgattaacggggtcgtgaaacttctgacaaagccctgggacgtggtccctatggttacccagatggcaatgactgatacaaccccattcggacagcaacgcgtgtttaaagagaaggtagacacacgaactcccagatccatgccgggtaccaggcgggtgatgggcatcacggctgagtggttatggcgcaccctggggagaaataaaaagcctaggttgtgcacacgagaagagttcactaagaaagtccggaccaacgccgcaatgggagccgtgtttacagaagagaatcagtgggatagtgctaaggccgcggttgaagacgaggatttctggaaactcgtggaccgtgagagagaactgcacaagctaggcaaatgtggttcttgcgtctacaacatgatggggaagcgcgagaagaaacttggagaatttggcaaagcaaaaggcagcagggccatttggtacatgtggctgggggctcggtatctcgagttcgaggccctgggatttttgaatgaagatcattggttctcaagagagaactcctacagtggtgtggaaggcgaggggctgcacaagctcggatatatccttcgcgacataagcaaaatccccggcggtgcaatgtacgctgatgacactgccgggtgggacaccaggattacggaagatgacctgcataatgaggagaagatcacacagcagatggatccagaacaccgacaattagctaacgccatttttaaactgacctatcagaataaggtagttaaggtgcagcggcctactcccacaggaaccgtcatggacatcatatctagaaaagatcagaggggctccggccaagtggggacttacggattgaacaccttcacaaatatggaggcacagctcattcgccagatggaaggtgagggcgtgctgtcaaaggcggacctagaaaacccacaccttcccgagaaaaagatcacgcagtggctggagaccaaaggggtcgaacgtctcaagcggatggccatcagcggagatgactgcgttgtgaagcctattgatgacagatttgctaacgccctgttggcattaaatgatatgggcaaagtaaggaaggacataccacaatggcagccgtcgaaaggttggcatgattggcaacaggtgcccttctgttctcaccatttccacgagctgatcatgaaggacgggcgcaaactcgtcgtgccttgccgaccacaagacgaacttattggacgggctagaatcagtcagggcgccggctggtccctgagggagactgcatgtctagggaaggcctatgcgcagatgtggagcctgatgtactttcaccgcagagatctccggttggcttcaaacgccatttgctccgcagttcccgtgcattgggtccctacatctaggaccacttggagcatccacgcccatcaccaatggatgacaaccgaagacatgctgacggtgtggaatcgtgtatggatagaggataacccatggatggaggacaagacacccgttaccacttgggaaaatgtgccttaccttggaaaacgagaggatcagtggtgtggtagtctgatcggcctcacctcccgcgctacatgggcccagaacattccgactgcaatccagcaagtcaggagcttaattgggaatgaagagttcctggactatatgccatctatgaagcggtttaggaaagaggaagagtcagaaggagctatctggtga

SEQ ID NO: 15502 - RNA, 9873 nt, synthetic construct
  misc_feature 1..9873: note = derived and/or modified CDS sequence (opt3) from DENV-3__FJ882577__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcagggattttctttaccttcgtgctactgctctccggacagatcacgtggcgggatatggctcacactctgattatgataggcagtaatgccagcgacagaatgggtatgggggttacctaccttgcattgatcgccacatttaagattcagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatatccttgacctgttcaaacacgatcttcacactcaccgtcgcttggcgaactgcaaccctgattctagccggtgtgagtctgcttcctgtttgccaaagctcgtccatgcggaaaacagactggctcccaatgactgtggcggctatgggcgtcccacctctgcccttgtttatcttctctctgaaggataccttaaagcgtagaagctggccactcaatgaaggggtaatggccgtgggactggtttcaattcttgcaagttccctgttgaggaacgacgtgcctatggccggccccctcgtcgctggtgggctgctaatcgcatgttacgtgataacgggaacatctgccgatctgaccgtagagaaagcggctgacgtgacttgggaagaggaagccgagcagacaggcgtcagccataaccttatgattaccgttgacgatgacggcactatgcgcatcaaggatgacgagacagaaaatatcctcaccgtgctgttgaaaacggcattactgattgtgtccgggatatttccatactcaatcccggccactctcctggtctggcacacctggcagaagcagacacaacggagcggagtgctttgggatgttcctagtcccccagagacccagaaagctgaactggaggagggtgtatatagaattaagcagcagggcatcttcgggaaaacacaagtgggagtcggcgtgcagaaggaaggtgtttttcatactatgtggcacgtgaccagaggggccgtcttgacgtacaacggaaagcgactagagcccaattgggcatctgtgaaaaaggacctgatttcctatggcggcgggtggcgcctcagcgctcagtggcaaaaaggagaagaggtacaggtcatcgccgtggaacctggtaagaaccccaagaatttccagacaatgcccggcactttccagaccacaaccggggagataggagcgatcgccctggattttaagcctggcacttcgggttcaccgattatcaaccgggaggggaagattgttggactttacggcaatggcgtggtcaccaaaaacgggggatatgtgtctggtatcgcacaaacaaatgctgaaccagacggccccacgcctgagttagaagaggaaatgttcaagaaaagaaacctgactataatggatctccacccagggagtggaaagaccaggaaatacttgcccgccattgttcgtgaggctatcaagcgccggctgagaacactcatcctggcacctaccagggtggtcgccgccgagatggaagaggctcttaagggcctgccgattcgatatcagactacagcgaccaaatccgaacatacgggtcgggagatcgtggacttgatgtgccacgcaacttttacaatgcgcctactgagccccgtaagagtgccaaattacaacctcataattatggatgaagcccatttcaccgaccctgcttctatcgccgcaagggggtacattagcacccgggttggaatgggcgaggccgctgcgatctttatgactgccacacccccaggcaccgcagatgctttccctcagtccaatgcccccatacaggacgaggaacgagacattccagagagatcatggaacagtgggaatgaatggatcacagattttgcaggaaagactgtctggttcgtgccgagcatcaaagccggtaacgacattgctaactgtttacgcaagaatggcaaaaaggtgatccaactgtctaggaagacgtttgataccgagtatcagaaaacaaaacttaacgactgggatttcgtcgtaactaccgacatttccgagatgggggccaattttaaagcggatcgtgtgatagaccctcggagatgcctgaagcccgttatcctcacagatggaccagaaagggtgattttggcaggccccatgcctgtcaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacatcaatacccctgaaggaattataccggctcttttcgagccagagagggaaaagagtgccgcaatcgatggcgagtatcgcctaaaaggggaaagccgtaagacatttgttgagctgatgagacggggagacttgcccgtgtggttagcgcacaaagtcgcctccgaaggtattaagtacactgataggaaatggtgcttcgacggccagcgcaacaatcagatcctggaggagaacatggatgtggaaatttggaccaaggagggggagaagaagaagctccgacctagatggctggacgctcggacatattctgatccccttgccctgaaagagtttaaggacttcgcagctggaaggaaatcgatcgccctcgatttggtaaccgaaataggccgcgtgccaactcacctggcacatagaacaaggaatgccctagacaacctggttatgctccacacgagcgagcatggtgggaaggcttaccggcacgcggtcgaggaacttcctgagaccatggaaactctgttattgctgggcctcatgatcctgcttacaggaggcgccatgctgtttctcatttcagggaaaggaatcggtaagacctccattggcttgatctgtgtgatagcaagttctgggatgctgtggatggctgagattcccttacaatggatcgccagcgccattgtgctagagttctttatgatggtcctgctcatcccagaacctgagaagcagcgtaccccgcaggataatcaacttgcatatgttgtgataggaatcctgacattggctgccattatcgcggctaacgaaatgggcctgctcgagactacgaaacgcgacctgggtatgtccaaggaacccggggtagtgtcaccaacctcttaccttgatgtcgacctccaccctgccagcgcatggacactgtacgccgtggctactaccgttattacacccatgttgcgacataccatcgagaatagtactgcaaacgtgtccctggccgcgatagctaaccaggccgtcgtattaatgggcctagacaaaggatggccaattagcaagatggatctgggcgtgcctctccttgcactggggtgctattctcaggttaatcccttgacgctgacagccgctgtgctcctgcttatcacccactacgccatcattggaccgggcttacaggcaaaagctactagagaggcccaaaagaggaccgcggccggtatcatgaagaacccaacagtcgacgggataatgactattgatctggaccctgtgatctatgattcaaaattcgaaaagcagctcggacaggtcatgttgctggtgctatgtgcagttcagctgctccttatgcggacctcctgggctctgtgcgaggccttgacactggcaacgggccccattaccactctctgggaaggtagtccaggcaaattttggaatacaaccatcgctgtgagcatggccaacatattccgcgggtcgtacctggccggagcgggcttagctttttctatcatgaagtccgtagggactggaaaaagaggcacaggtagccaaggggagacccttggagaaaagtggaagaaaaagctgaatcagctctcaaggaaagagttcgacctatataagaaaagtggcattacggaggtggatcggaccgaagcaaaggagggtctgaaacgaggcgaaatcacacatcacgccgtctctagagggtccgctaagttgcagtggtttgttgagcgcaacatggtgattcccgaaggaagggtcatcgacctgggctgtgggcggggaggctggagctactattgcgccggtctcaagaaagtgactgaggtacgtgggtacaccaagggaggccctggccatgaggaaccggtgcccatgtcaacatacgggtggaatattgttaaacttatgagtggaaaggatgtgttctatctgccacctgagaaatgtgacactttgctgtgcgatatcggtgaaagctccccctctcctaccgtcgaggagagcagaacaataagggtgctcaagatggtcgaaccatggttaaagaacaatcagttctgtattaaagtgctgaacccctacatgcctaccgttatcgagcaccttgaacgcctgcaacggaagcacggcgggatgctagtacgaaatccactctccagaaactcaactcatgagatgtattggatctctaatggaacgggcaacattgtggcaagtgtcaatatggtgtcgaggctgttgctgaaccgctttacaatgacccaccggagacccactatagaaaaagacgttgatctcggtgccgggacccgtcatgtgaacgctgagccggagacacctaatatggacgtcatcggagaaaggattaagcggatcaaagaggaacacaacagcacgtggcactacgacgatgagaatccatataagacctgggcgtaccatggctcctatgaagtgaaggccactggctctgcatcaagcatgattaacggggtagtgaaacttctgacaaagccctgggacgttgtccctatggtgacccagatggctatgactgatacaaccccattcggacagcaacgcgtgtttaaagagaaggtcgacacacgaactcccagatccatgccgggtaccaggcgggttatgggcatcacggccgagtggttatggcgcaccctggggagaaataaaaagcctaggttgtgcacacgagaagagttcactaagaaagtgcggaccaacgcagccatgggagctgtatttacagaagagaatcagtgggatagtgccaaggcggcagtggaagacgaggatttctggaaactcgtcgaccgtgagagagaactgcacaagctaggcaaatgtggttcttgcgtgtacaacatgatggggaagcgcgagaagaaacttggagaatttggcaaagccaaaggcagcagggctatatggtacatgtggctgggggcccggtatctcgagttcgaggcactgggatttttgaatgaagatcattggttctcaagagagaactcctacagtggtgttgaaggcgaggggctgcacaagctcggatatatccttcgcgacattagcaaaatccccggcggtgctatgtacgccgatgacactgctgggtgggacaccaggattacggaagatgacctgcataatgaggagaagatcacacagcagatggatccagaacaccgacaattagccaacgcaatatttaaactgacctatcagaataaggtggtcaaggtgcagcggcctactcccacaggaaccgtaatggacattatctctagaaaagatcagaggggctccggccaagttgggacttacggattgaacaccttcacaaatatggaggcgcagctcatccgccagatggaaggtgagggcgtgctgtcaaaggccgacctagaaaacccacaccttcccgagaaaaagattacgcagtggctggagaccaaaggggtcgaacgtctcaagcggatggctataagcggagatgactgcgtggtgaagcctatcgatgacagatttgccaacgcactgttggctttaaatgatatgggcaaagtcaggaaggacattccacaatggcagccgtcgaaaggttggcatgattggcagcaggttcccttctgttctcaccatttccacgagctgatcatgaaggacgggcgcaaactcgtggtaccttgccgaccacaagacgaacttattggacgggccagaatcagtcagggcgcaggctggtccctgagggagactgcctgtctagggaaggcgtatgctcagatgtggagcctgatgtactttcaccgcagagatctccggttggcctcaaacgcaatatgctccgccgtgcccgtccattgggtgcctacatctaggaccacttggagcatccacgctcatcaccaatggatgacaaccgaagacatgctgacggtttggaatcgtgtgtggattgaggataacccatggatggaggacaagacacccgtcaccacttgggaaaatgtgccttaccttggaaaacgagaggatcagtggtgtggtagtctgatcggcctcacctcccgcgccacatgggcacagaacattccgactgctatccagcaagtaaggagcttaattgggaatgaagagttcctggactatatgccatctatgaagcggtttaggaaagaggaagagtcagaaggagccatatggtga

SEQ ID NO: 15503 - RNA, 9873 nt, synthetic construct
  misc_feature 1..9873: note = derived and/or modified CDS sequence (opt3) from DENV-3__FJ850096__SS-prME
  source 1..9873: mol_type = other RNA
accagcctgtgcctcatgatgatccttcccgccgctctggcattccacttgacatccagggacggcgaacctaggatgattgtggggaagaacgaacggggaaagtctttactgtttaagactgcctcaggtataaatatgtgtacgctgatcgcgatggatctcggcgagatgtgcgacgataccgtcacatacaagtgtccacacattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcctgttgctcacgtggatcgggctaaattccaagaacacatcaatgagttttagctgcattgcgataggaatcattaccttatatctgggcgctgtggttcaggccgacatgggttgtgtcatcaattggaaagggaaggagctaaagtgcggatccggcattttcgtgactaacgaggtgcatacatggaccgaacagtacaaatttcaagcagattctcccaagcggctcgccactgctatcgccggtgcatgggagaatggcgtctgtgggatacgaagcaccacacgcatggaaaacctgctttggaaacagatcgctaatgagttgaactatattctgtgggaaaataacatcaagctcacggttgtggtgggagacattatcggcgtactggagcaggggaaaagaaccttaactccacagcctatggagctgaagtactcatggaaaacatggggaaaggccaagatagtcaccgcggaaacacaaaacagttccttcattatcgatggccccaatactccagagtgccccagcgcctctagggcttggaacgtgtgggaagttgaggactatggttttggggtgttcaccacgaatatttggcttaaattgcgggaagtctacacacagctctgtgaccaccgcctgatgtcagcagccgtgaaggatgagagagctgttcacgccgacatgggatactggatcgagagtcagaaaaacggcagctggaagctagaaaaagcatccctgatagaggtgaagacctgcacttggcctaagtctcataccctctggtcgaatggtgtactggaaagcgatatgatcattccaaaatcccttgcgggcccgatctcacagcacaactataggcccgggtaccatacacaaactgccggaccttggcacttgggcaagctggagttagactttaattattgcgaggggaccacagtcgtgattacggaaaactgtggaacccgtggcccaagtctccggactacaaccgtgtctggtaaactgatccacgagtggtgctgtcgaagctgcactcttccccctctgagatacatgggggaagatggatgttggtatggcatggagataaggccaatttccgaaaaggaggagaatatggtcaaatcattggttagcgctggttctggcgaagtggacaacttcacaatgggggtactctgcctggccatcctatttgaggaagtgatgcgcggaaagttcggcaagaaacatatgatcgcaggggtcttctttaccttcgtgctgctcctgtccggacagattacgtggcgggatatggctcacactcttatcatgattggcagtaatgccagcgacagaatgggtatgggggttacctacttggcactgatagccacatttaagatccagcccttcttagctctcggatttttcctgaggaaacttacctctcgcgagaacctgctactcggcgtgggcctggcgatggccactacattgcaactgccggaagatattgagcagatggcaaatgggatcgctttaggactcatggccctgaaacttattacccagtttgagacatatcagctgtggactgccttgatctccctcacctgttcaaacacgatattcacactgaccgtcgcttggcgaactgcaaccctaatcctggccggtgtgagtcttctccctgtttgccaaagctcgtccatgcggaaaacagactggctgccaatgactgtggcggctatgggcgtcccacctttgcccctgtttattttctctttaaaggataccctcaagcgtagaagctggccactgaatgaaggggtaatggccgtgggacttgtttcaatcctggcaagttccttgctcaggaacgacgtgcctatggccggccccctggtcgctggtgggctactgattgcatgttacgtgatcacgggaacatctgccgatcttaccgtagagaaagcggctgacgtgacttgggaagaggaagccgagcagacaggcgtcagccataacctcatgataaccgttgacgatgacggcactatgcgcattaaggatgacgagacagaaaatatcctgaccgtgttgttaaaaacggcactgctcatcgtgtccgggatttttccatactcaataccggccactctgcttgtctggcacacctggcagaagcagacacaacggagcggagtgctgtgggatgttcctagtcccccagagacccagaaagctgaattggaggagggtgtatatagaatcaagcagcagggcattttcgggaaaacacaagtgggagtcggcgtgcagaaggaaggtgtttttcatactatgtggcacgtgaccagaggggccgtcctaacgtacaacggaaagcgactggagcccaattgggcatctgtgaaaaaggacctcatctcctatggcggcgggtggcgcctgagcgctcagtggcaaaaaggagaagaggtacaggtcattgccgtggaacctggtaagaaccccaagaatttccagacaatgcccggcactttccagaccacaaccggggagatcggagcgatagcccttgattttaagcctggcacttcgggttcaccgatcattaaccgggaggggaaggttgtgggattatacggcaatggcgtcgtgaccaaaaacgggggatatgtttctggtatcgcacaaacaaatgctgaaccagacggccccacgcctgagctggaagaggaaatgttcaagaaaagaaacctcactattatggatttgcacccagggagtggaaagaccaggaaatacctgcccgccatcgtgcgtgaggctataaagcgccggctcagaacactgattcttgcacctaccagggtcgtggccgccgagatggaagaggctctgaagggcttgccgatccgatatcagactacagcgaccaaatccgaacatacgggtcgggagatcgtagacctaatgtgccacgcaacttttacaatgcgcctgctcagccccgtgagagttccaaattacaacttaattatcatggatgaagcccatttcaccgaccctgcttctatagccgcaagggggtacattagcacccgggtcggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttactggaaagacggtgtggttcgtgccgagcattaaagcaggtaacgacatcgccaactgtctgcgcaagaatggcaaaaaggtcatccaactttctaggaagacctttgatacagagtatcagaaaactaagctgaacgactgggatttcgtagtgaccacagacatttccgagatgggggctaattttaaagccgatcgtgttatcgaccctcggagatgcctcaagcccgtgattttgaccgatggaccagaaagggtcatactggcgggccccatgcctgtgactgcagcctcagctgcccagcgccgaggtagagttgggcggaacccacagaaagagaatgaccaatacatcttcacgggccagcccctcaacaatgatgaagaccacgctcattggaccgaggcaaagatgctgcttgacaacattaatacacctgaaggaatcatcccggccctattcgagccagagagggaaaagagtgctgccattgatggcgagtatcgcctgaaaggggaaagccgtaagacttttgtggagttgatgagacggggagacttacccgtctggctggcacacaaagtggcgtccgaaggtataaagtacaccgataggaaatggtgcttcgacggccagcgcaacaatcagatcctcgaggagaacatggatgtagaaatttggacaaaggagggggagaagaagaagctgcgacctagatggcttgacgcccggacctattctgatcccctggctctcaaagagtttaaggacttcgccgcaggaaggaaatcgatcgctttggatctggtgactgaaattggccgcgttccaagccacctagcccatagaacaaggaatgcactggacaacctcgtcatgcttcacacgtcagagcatggtgggaaggcctaccggcacgctgtggaggaactgcctgagaccatggaaactttattgctgctcggcctgatgatccttctgacaggaggcgcgatgctctttttgatatccgggaaaggaatcggtaagaccagtattggcctgatctgtgtgattgcctctagcgggatgttatggatggcagagatccccctacaatggatagcttccgccattgtcctggagttctttatgatggttctccttatcccagaacctgagaagcagcgtaccccgcaggataatcaactggcctatgtggtaattggaatcttgacactggcagctataatcgccgcgaacgaaatgggcctcctggagactacgaaacgcgaccttggtatgtcaaaggaacccggggtggtctctccaaccagctacctcgatgtggacctgcaccctgctagtgcctggacattgtacgcagttgccactaccgtgattacacccatgctgcgacataccatcgaaaattccactgctaacgtcagcttagcagccattgcgaaccaggctgtagtgctaatgggcctggacaaaggatggccaatctctaagatggatctcggcgttcctcttctggccttggggtgctattcacaggtgaatcccctgacgctcacagcagccgtcctgcttttaataacccactacgctattatcggaccgggcctgcaggccaaagcaactagagaggctcaaaagaggaccgccgcgggtatcatgaagaacccaacagtggacgggattatgactatcgatctcgaccctgtcatatatgattccaaattcgagaagcagttgggacaggtgatgctgctagttctgtgtgccgtgcagctccttctgatgcggaccagttgggcattgtgcgaggctctgacactcgccacgggccccattaccactctgtgggaaggtagcccaggcaaattttggaatacaaccatcgcagtatcgatggctaacattttccgcgggtcttacttagccggagccggccttgcgttttccatcatgaaaagcgtggggactggaaaaagaggcacaggttcacaaggggagaccctgggagaaaagtggaagaaaaagctcaatcagctaagtaggaaagagttcgacctgtataagaaatctggcataacggaggtcgatcggaccgaagctaaggagggtttgaaacgaggcgaaatcacacatcacgcagtttccagagggagcgccaagctgcagtggtttgtggagcgcaacatggtcattcccgaaggaagggtgatcgacctcggctgtgggcggggaggctggtcatactattgcgctggtcttaagaaagtaactgaggtgcgtgggtacaccaagggaggccctggccatgaggaaccggttcccatgagtacatacgggtggaatattgtgaaactgatgagcggaaaggatgtcttctatttgccacctgagaaatgtgacactctgctctgcgatatcggtgaatcctctcccagccctaccgtggaggagtccagaacaattagggtcttaaagatggtggaaccatggctgaagaacaatcagttctgtatcaaagttcttaacccctacatgcctaccgtaatagagcacctggaacgcctacaacggaagcacggcgggatgctcgtgcgaaatccactgtcaagaaactctactcatgagatgtattggattagtaatggaacgggcaacatcgtcgcctcggtgaatatggttagcaggttgctgctcaaccgctttacaatgacccaccggagacccactatcgaaaaagacgtggatcttggtgcagggacccgtcatgtcaacgccgagccggagacacctaatatggacgtgattggagaaaggataaagcggatcaaagaggaacacaactccacgtggcactacgacgatgagaatccatataagacctgggcttaccatggctcttatgaagtaaaggcgactggctcagccagctccatgattaacggggtggttaaactgttaacaaagccctgggacgtcgtgcctatggtgacccagatggcaatgactgatacaaccccattcggacagcaacgcgtctttaaagagaaggttgacacacgaactcccagaagtatgccgggtaccaggcgggtgatgggcatcacggctgagtggctgtggcgcaccttggggagaaataaaaagcctaggctctgcacacgagaagagttcactaagaaagtacggaccaacgccgcaatgggagccgtgtttacagaagagaatcagtgggattctgctaaggccgcggtcgaagacgaggatttctggaaactggtggaccgtgagagagaactacacaaacttggcaaatgtggtagctgcgtttacaacatgatggggaagcgcgagaaaaagctgggagaatttggcaaggcaaaaggctcaagggccatttggtacatgtggctcggggctcggtatctggagttcgaggccttgggatttctgaatgaagatcattggttctccagagagaacagttacagcggtgtggaaggcgaggggctccacaaacttggatatatcctgcgcgacatatctaaaatccccggcggtgcaatgtacgctgatgacactgccgggtgggacaccaggattacggaagatgacttacataatgaggagaagatcacacagcagatggatccagaacaccgacaactggctaacgccatttttaaattgacctatcagaataaggtcgtgaaggtacagcggcctactcccacaggaaccgttatggacatcatatccagaaaagatcagaggggctcaggccaagtggggacttacggactcaacaccttcacaaatatggaggcacagctgattcgccagatggaaggtgagggcgtcctaagcaaggcggaccttgaaaacccacatctgcccgagaaaaagatcacgcagtggctcgagaccaaaggggtggaacgtctgaagcggatggccatctcgggagatgactgcgtggtcaagcctattgatgacagatttgctaacgccttgttagcactgaatgatatgggcaaagttaggaaggacataccacaatggcagccgtctaaaggttggcatgattggcaacaggtgcccttctgtagtcaccatttccacgagctcatcatgaaggacgggcgcaaacttgtagtgccttgccgaccacaagacgaactgattggacgggctagaatctcccagggcgccggctggagcctaagggagactgcatgtctggggaaggcctatgcgcagatgtggtcactcatgtactttcaccgcagagatttgcggctggcttccaacgccatttgctctgcagtccccgtgcattgggttcctacaagcaggaccacttggagtatccacgcccatcaccaatggatgacaaccgaagacatgcttacggtgtggaatcgtgtctggatagaggataacccatggatggaggacaagacacccgtgaccacttgggaaaatgtaccttacctgggaaaacgagaggatcagtggtgtggttccctcatcggcttaaccagccgcgctacatgggcccagaacattccgactgcaatccagcaagttagatctctgattgggaatgaagagttcttggactatatgccatcaatgaagcggtttaggaaagaggaagagagtgaaggagctatctggtga

SEQ ID NO: 15504 - RNA, 9873 nt, synthetic construct
  misc_feature 1..9873: note = derived and/or modified CDS sequence (opt3) from DENV-3__FJ882578__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaatcctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtacctggccggagcgggcttagctttttctatcatgaagtccgtcgggactggaaaaagaggcacaggtagccaaggggagacccttggagaaaagtggaagaaaaagctgaatcagctctcaaggaaagagttcgacctatataagaaaagtggcataacggaggttgatcggaccgaagcaaaggagggtctgaaacgaggcgaaatcacacatcacgccgtgtctagagggtccgctaagttgcagtggtttgtcgagcgcaacatggtgattcccgaaggaagggtaatcgacctgggctgtgggcggggaggctggagctactattgcgccggtctcaagaaagtgactgaggttcgtgggtacaccaagggaggccctggccatgaggaaccggtgcccatgtcaacatacgggtggaatattgtcaaacttatgagtggaaaggatgtgttctatctgccacctgagaaatgtgacactttgctgtgcgatatcggtgaaagctccccctctcctaccgtcgaggagagcagaacaattagggtgctcaagatggttgaaccatggttaaagaacaatcagttctgtatcaaagtactgaacccctacatgcctaccgtgatagagcaccttgaacgcctgcaacggaagcacggcgggatgctagtccgaaatccactctccagaaactcaactcatgagatgtattggatttctaatggaacgggcaacatcgtggcaagtgttaatatggtgtcgaggctgttgctgaaccgctttacaatgacccaccggagacccactatcgaaaaagacgtcgatctcggtgccgggacccgtcatgtgaacgctgagccggagacacctaatatggacgtaattggagaaaggataaagcggatcaaagaggaacacaacagcacgtggcactacgacgatgagaatccatataagacctgggcgtaccatggctcctatgaagtgaaggccactggctctgcatcaagcatgattaacggggttgtcaaacttctgacaaagccctgggacgtggtgcctatggtcacccagatggctatgactgatacaaccccattcggacagcaacgcgtttttaaagagaaggtggacacacgaactcccagatccatgccgggtaccaggcgggtaatgggcatcacggccgagtggttatggcgcaccctggggagaaataaaaagcctaggttgtgcacacgagaagagttcactaagaaagtgcggaccaacgcagccatgggagctgtctttacagaagagaatcagtgggatagtgccaaggcggcagtggaagacgaggatttctggaaactcgttgaccgtgagagagaactgcacaagctaggcaaatgtggttcttgcgtgtacaacatgatggggaagcgcgagaagaaacttggagaatttggcaaagccaaaggcagcagggctatttggtacatgtggctgggggcccggtatctcgagttcgaggcactgggatttttgaatgaagatcattggttctcaagagagaactcctacagtggtgtcgaaggcgaggggctgcacaagctcggatatatccttcgcgacataagcaaaatccccggcggtgctatgtacgccgatgacactgctgggtgggacaccaggattacggaagatgacctgcataatgaggagaagatcacacagcagatggatccagaacaccgacaattagccaacgcaatttttaaactgacctatcagaataaggtggtaaaggttcagcggcctactcccacaggaaccgtgatggacatcatatctagaaaagatcagaggggctccggccaagtcgggacttacggattgaacaccttcacaaatatggaggcgcagctcattcgccagatggaaggtgagggcgtgctgtcaaaggccgacctagaaaacccacaccttcccgagaaaaagatcacgcagtggctggagaccaaaggggtggaacgtctcaagcggatggctatcagcggagatgactgcgtcgttaagcctattgatgacagatttgccaacgcactgttggctttaaatgatatgggcaaagtgaggaaggacataccacaatggcagccgtcgaaaggttggcatgattggcagcaggtacccttctgttctcaccatttccacgagctgatcatgaaggacgggcgcaaactcgtggtcccttgccgaccacaagacgaacttattggacgggccagaatcagtcagggcgcaggctggtccctgagggagactgcctgtctagggaaggcgtatgctcagatgtggagcctgatgtactttcaccgcagagatctccggttggcctcaaacgcaatttgctccgccgtgcccgttcattgggtgcctacatctaggaccacttggagcatccacgctcatcaccaatggatgacaaccgaagacatgctgacggtctggaatcgtgtgtggatagaggataacccatggatggaggacaagacacccgtaaccacttgggaaaatgttccttaccttggaaaacgagaggatcagtggtgtggtagtctgatcggcctcacctcccgcgccacatgggcacagaacattccgactgctatccagcaagtgaggagcttaattgggaatgaagagttcctggactatatgccatctatgaagcggtttaggaaagaggaagagtcagaaggagccatctggtga

SEQ ID NO: 15505 - RNA, 9873 nt, synthetic construct
  misc_feature 1..9873: note = derived and/or modified CDS sequence (opt3) from DENV-3__FJ639770__SS-prME
  source 1..9873: mol_type = other RNA
accagcctgtgcctcatgatgatccttcccgccgctctggcattccacttgacttccagagacggcgaacctaggatgattgtggggaagaacgaacggggaaagtctttactgtttaagactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaggtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacgtcattggcgtgctcgagcaggggaaaagaaccctgactttacagccaatggagctgaagtactcatggaaaacatggggaaaggccaagatcgttaccgcggaaacacaaaacagttccttcataattgatggccctaatactcccgagtgcccaagcgcctctagggcttggaacgtgtgggaagtcgaggactatggttttggggtgttcaccacgaatatctggcttaaattgcgggaagtttacacacagctctgtgaccaccgcctgatgtcagcagccgtgaaggatgagagagctgtacacgccgacatgggatactggattgagagtcagaaaaacggcagctggaagctagaaaaagcatccctgatcgaggtcaagacctgcacttggcccaagtctcataccctctggtcgaatggtgtgctggaaagcgatatgataatccctaaatcccttgcgggcccaatttcacagcacaactataggccggggtaccatacacaaactgccggaccctggcacttgggcaagctggagttagactttaattattgcgaggggaccacagtggtcatcacggaaaactgtggaacccgtggccctagtctccggactacaaccgtttctggtaaactgattcacgagtggtgctgtcgaagctgcactcttccacccctgagatacatgggggaagatggatgttggtatggcatggagatcaggcctatatccgaaaaggaggagaatatggtgaaatcattggtaagcgctggttctggcgaagtggacaacttcacaatgggggtcctctgcctggccattctatttgaggaagtgatgcgcggaaagttcggcaagaaacatatgatcgcaggggttttctttaccttcgtgctgctcctgtccggacagatcacgtggcgggatatggctcacactcttattatgatcggcagtaatgccagcgacagaatgggtatgggggtcacctacttggcactgattgccacatttaagatacagccattcttagctctcggatttttcctgaggaaacttacctctcgcgagaacctgctactcggcgtgggcctggcgatggccactacattgcaactgcccgaagatatcgagcagatggcaaatgggattgctttaggactcatggccctgaaacttatcacccagtttgagacatatcagctgtggactgccttgatttccctcacctgttcaaacacgatcttcacactgaccgttgcttggcgaactgcaaccctaatactggccggtgtgagtcttctcccggtctgccaaagctcgtccatgcggaaaacagactggctgcctatgactgtagcggctatgggcgtgccacccttgcctctgtttatcttctctttaaaggataccctcaagcgtagaagctggcccctgaatgaaggggttatggccgtgggacttgtctcaattctggcaagttccttgctcaggaacgacgtgccaatggccggccctctggtagctggtgggctactgatcgcatgttacgtgattacgggaacatctgccgatcttaccgtcgagaaagcggctgacgttacttgggaagaggaagccgagcagacaggcgtgagccataacctcatgatcaccgtggacgatgacggcactatgcgcataaaggatgacgagacagaaaatattctgaccgtcttgttaaaaacggcactgctcatcgtgtccgggatctttccctactcaattccagccactctgcttgtttggcacacctggcagaagcagacacaacggagcggagtactgtgggatgtgccgagtcctcccgagacccagaaagctgaattggaggagggtgtctatagaataaagcagcagggcatcttcgggaaaacacaagtgggagttggcgtgcagaaggaaggtgtctttcatactatgtggcacgtgaccagaggggccgtactaacgtacaacggaaagcgactggagccaaattgggcatctgtcaaaaaggacctcatttcctatggcggcgggtggcgcctgagcgctcagtggcaaaaaggagaagaggtgcaggttatcgccgtggaacccggtaagaaccctaaaaatttccagacaatgccaggcactttccagaccacaaccggggagattggagcgatcgcccttgattttaagcccggcacttcgggttcacctataatcaaccgggaggggaaggtcgtgggattatacggcaatggcgttgtgaccaaaaacgggggatatgtctctggtattgcacaaacaaatgctgaaccggacggcccaacgcccgagctggaagaggaaatgttcaagaaaagaaacctcactatcatggatttgcaccctgggagtggaaagaccaggaaatacctgccagccattgtgcgtgaggctatcaagcgccggctcagaacactgatacttgcacccaccagggtagtggccgccgagatggaagaggctctgaagggcttgcctattcgatatcagactacagcgaccaaatccgaacatacgggtcgggagatcgttgacctaatgtgccacgcaacttttacaatgcgcctgctcagcccggtcagagtgcccaattacaacttaatcattatggatgaagcccatttcaccgacccagcttctatcgccgcaagggggtacataagcacccgggtgggaatgggcgaggccgctgcgatttttatgactgccacacctcccggcaccgcagatgctttcccacagtccaatgcccctatccaggacgaggaacgagacattcccgagagatcatggaacagtgggaatgaatggatcacagattttgcaggaaagactgtctggttcgtaccaagcataaaagccggtaacgacattgctaactgtctgcgcaagaatggcaaaaaggtgatccaactttctaggaagacgtttgataccgagtatcagaaaacaaagctgaacgactgggatttcgttgtgactaccgacatctccgagatgggggccaattttaaagcggatcgtgtcattgacccgcggagatgcctcaagcctgtgatcttgacagatggacccgaaagggttattctggcaggcccaatgcccgtgaccgccgcttcagccgctcagcgccgaggtagagtcgggcggaaccctcagaaagagaatgaccaatacatattcactggccagccactcaacaatgatgaagaccacgcacattggacggaggccaagatgctgcttgacaacatcaatacccccgaaggaattatccctgctctattcgagccggagagggaaaagagtgccgcaatcgatggcgagtatcgcctgaaaggggaaagccgtaagacatttgtggagttgatgagacggggagacttaccagtatggctggcgcacaaagtggcctccgaaggtattaagtacactgataggaaatggtgcttcgacggccagcgcaacaatcagatactcgaggagaacatggatgttgaaatctggaccaaggagggggagaagaagaagctgcgacccagatggcttgacgctcggacatattctgatcctctggccctcaaagagtttaaggacttcgcagctggaaggaaatcgattgccttggatctggtcaccgaaatcggccgcgtgcccagccacctagcacatagaactaggaatgccctggacaacctcgtgatgcttcacacatcagagcatggtgggaaggcttaccggcacgcggtcgaggaactgccagagacgatggaaaccttattgctgctcggcctgatgattcttctgactggaggcgccatgctctttttgatctccgggaaaggaataggtaagacaagtatcggcctgatttgtgttatcgcatctagcgggatgttatggatggctgagattcctctacaatggatcgcctccgccatagtgctggagttctttatgatggtactccttattcccgaaccagagaagcagcgtacccctcaggataatcaactggcatatgtggtcatcggaattttgaccctggctgccatcatagcggctaacgaaatgggcctcctggagacaactaaacgcgaccttggtatgtcaaaggaaccgggggtggtttctcccacgagctacctcgatgtggacctgcacccagccagtgcatggaccttgtacgccgtcgctacaactgtaatcacccctatgctgcgacatacaattgaaaattccaccgcaaacgtgagcttagccgcgatcgctaaccaggccgttgtgctaatgggcctggacaaaggatggcccatttctaagatggatctcggcgtcccacttctggcattggggtgctattcacaggtgaatcctctgactctcacggccgctgtcctgcttttaatcacacactacgccataattggacccggcctgcaggcaaaagctaccagagaggcccaaaagaggactgcggccggtatcatgaagaacccgaccgtggacgggatcatgacaattgatctcgacccagttatctatgattccaaattcgagaagcagttgggacaggtgatgctgctagtactgtgtgcagtgcagctccttctgatgcggacaagttgggctttgtgcgaggccctgaccctcgcaacaggccctataacgaccctgtgggaaggtagccccggcaaattttggaatactacaattgctgtctcgatggccaacatcttccgcgggtcttacttagccggagcgggccttgctttttccattatgaaaagcgttgggaccggaaaaagaggcactggttcacaaggggagacactgggagaaaagtggaagaaaaagctcaatcagctaagtaggaaagagttcgacctgtataagaaatctggcatcaccgaggtggatcggacggaagcaaaggagggtttgaaacgaggcgaaataacccatcacgccgtctccagagggagcgctaagctgcagtggtttgtggagcgcaacatggtaatcccagaaggaagggtgattgacctcggctgtgggcggggaggctggtcatactattgcgccggtcttaagaaagttacagaggtgcgtgggtacactaagggaggccccggccatgaggaacctgtcccgatgagtacctacgggtggaatatcgtgaaactgatgagcggaaaggatgtcttctatttgcccccagagaaatgtgacacactgctctgcgatattggtgaatcctctcctagccccactgtggaggagtccagaaccatcagggttttaaagatggtagaaccttggctgaagaacaatcagttctgtattaaagtgcttaacccatacatgcccacagtcgtggagcacctggaacgcctacaacggaagcacggcgggatgctcgttcgaaatcctctgtcaagaaactctacccatgagatgtattggatcagtaatggaactggcaacatagtggcatcggtcaatatggtgagcaggttgctgctcaaccgctttacgatgacacaccggagaccaaccattgaaaaagacgtagatcttggtgccgggactcgtcatgtgaacgctgagcccgagaccccgaatatggacgttatcggagaaaggatcaagcggattaaagaggaacacaactccacatggcactacgacgatgagaatccttataagacgtgggcgtaccatggctcttatgaagtcaaggccaccggctcagcaagctccatgataaacggggtggtgaaactgttaactaagccatgggacgtcgttcccatggtgacacagatggctatgaccgatactacacctttcggacagcaacgcgtatttaaagagaaggtggacacccgaacaccaagaagtatgcccggtactaggcgggtcatgggcatcaccgccgagtggctgtggcgcacgttggggagaaataaaaagccgaggctctgcacccgagaagagttcacaaagaaagtgcggactaacgcagccatgggagctgtttttaccgaagagaatcagtgggattctgccaaggcggcagtggaagacgaggatttctggaaactggtcgaccgtgagagagaactacacaaacttggcaaatgtggtagctgcgtgtacaacatgatggggaagcgcgagaaaaagctgggagaatttggcaaggccaaaggctcaagggctatttggtacatgtggctcggggcccggtatctggagttcgaggcattgggatttctgaatgaagatcattggttctccagagagaacagttacagcggtgtagaaggcgaggggctccacaaacttggatatatcctgcgcgacatttctaaaatccctggcggtgctatgtacgccgatgacacagctgggtgggacactaggataaccgaagatgacttacataatgaggagaagatcacgcagcagatggatcccgaacaccgacaactggccaacgcaatttttaaattgacatatcagaataaggttgtgaaggtccagcggccaacccctactggaacagtgatggacatcatttccagaaaagatcagaggggctcaggccaagtggggacctacggactcaacactttcaccaatatggaggcgcagctgatccgccagatggaaggtgagggcgtcctaagcaaggccgaccttgaaaacccccgtctgccagagaaaaagataacacagtggctcgagacgaaaggggttgaacggctgaagagaatggctatttcgggagatgactgcgtggtaaagcccatcgatgacaggtttgccaacgcattgttagctctgaatgatatgggcaaagtgcgcaaggacatccctcaatggcagccatctaaaggttggcacgattggcagcaggtcccgttctgtagtcatcacttccatgagctcattatgaaggacgggcgaaaacttgtggttccctgccggcctcaagacgaactgataggaagggccaggatctcccagggcgcaggctggagcctacgcgagaccgcctgtctggggaaggcgtatgctcagatgtggtcactcatgtactttcacagacgggatttgaggctggcctccaacgcaatttgctctgccgtgccagtccactgggtgcccactagccgtacaacctggagtatccatgctcaccatcaatggatgactacagaagacatgcttaccgtatggaatcgagtttggattgaggataacccttggatggaggacaagacgccagtgacaacctgggaaaatgtcccctacctgggaaaacgcgaggatcagtggtgtggttccctcatcggcttaactagcagagccacctgggcacagaacatacctacagctatccagcaagtgcggtctctgattgggaatgaagagttcttggactatatgccgtcaatgaagaggtttcgcaaagaggaagagagtgaaggagccatctggtga

SEQ ID NO: 15506 - RNA, 9873 nt, synthetic construct
  misc_feature 1..9873: note = derived and/or modified CDS sequence (opt3) from DENV-3__FJ639771__SS-prME
  source 1..9873: mol_type = other RNA
accagcctgtgcctcatgatgatccttccagccgctctggcattccacttgacttccagagacggcgaacctaggatgattgtggggaagaacgaacggggaaagtctttactgtttaagactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgagagaaaataacatcaagctgacggtggtggtaggagacgtcattggcgtgctcgagcaggggaaaaggaccctgactccacagcctatggagttaaagtactcatggaaaacatggggaaaggccaagatcgttaccgcggaaacacaaaacagttccttcataattgatggccccaatactccagagtgccccagcgcctctcgggcttggaacgtgtgggaagtcgaggactatggttttggggtgttcaccacgaatatctggctgaaacttcgcgaagtttacacacagttgtgtgaccacagactcatgtcagcagccgtgaaggatgagagggctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactatcgtcccgggtaccatacacaaactgccggaccttggcaccttggcaagttggagctggactttaattattgcgaggggaccacagtggtcatcacggaaaactgtggaacccggggcccaagtttacgaactacaaccgtttctggtaaactcattcacgagtggtgctgtagaagctgcactctgccccctcttaggtacatgggggaagatggatgttggtatggcatggagatccgcccaatatccgaaaaggaggagaatatggtgaaatcactggtaagcgctggttctggcgaagtggacaacttcacaatgggggtcttgtgcctcgccattctgtttgaggaagtgatgcggggaaagttcggcaagaaacatatgatcgcaggggttttctttaccttcgtgctactgctctccggacagatcacgtggagagatatggctcacactctgattatgatcggcagtaatgccagcgacaggatgggtatgggggtcacctaccttgcattgattgccacatttaagatacagcccttcctggctttaggatttttcctccgcaaactgacctctcgagagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatttccttgacctgttcaaacacgatcttcacactcaccgttgcttggcggactgcaaccctgatactagccggtgtgagtctgcttcctgtctgccaaagctcgtccatgcgtaaaacagactggctcccaatgactgtagcggctatgggcgtgccccctctgcccttgtttatcttctctctgaaggataccttaaagagaaggagctggccactcaatgaaggggttatggccgtgggactggtctcaattcttgcaagttccctgttgcgcaacgacgtgcctatggccggccccctcgtagctggtgggctgctaatcgcatgttacgtgattacgggaacatctgccgatctgaccgtcgagaaagcggctgacgttacttgggaagaggaagccgagcagacaggcgtgagccataaccttatgatcaccgtggacgatgacggcactatgcggataaaggatgacgagacagaaaatattctcaccgtcctgttgaaaacggcattactgatcgtgtccgggatctttccatactcaattccggccactctcctggtttggcacacctggcagaagcagacacaaagaagcggagtactttgggatgtgcctagtcccccagagacccagaaagctgaactggaggagggtgtctataggataaagcagcagggcatcttcgggaaaacacaagtgggagttggcgtgcagaaggaaggtgtctttcatactatgtggcacgtgacccgaggggccgtattgacgtacaacggaaagcgcctagagcccaattgggcatctgtcaaaaaggacctgatttcctatggcggcgggtggcggctcagcgctcagtggcaaaaaggagaagaggtgcaggttatcgccgtggaacctggtaagaaccccaagaatttccagacaatgcccggcactttccagaccacaaccggggagattggagcgatcgccctggattttaagcctggcacttcgggttcaccgataatcaacagagaggggaaggtcgtgggactttacggcaatggcgttgtgaccaaaaacgggggatatgtctctggtattgcacaaacaaatgctgaaccagacggccccacgcctgagttagaagaggaaatgttcaagaaaaggaacctgactatcatggatctccacccagggagtggaaagacccgtaaatacttgcccgccattgtgcgcgaggctatcaagcggagactgaggacactcatactggcacctacccgagtagtggccgccgagatggaagaggctcttaagggcctgccgattcggtatcagactacagcgaccaaatccgaacatacgggtcgcgagatcgttgacttgatgtgccacgcaacttttacaatgagactactgagccccgtcagggtgccaaattacaacctcatcattatggatgaagcccatttcaccgaccctgcttctatcgccgcacgggggtacataagcacccgagtgggaatgggcgaggccgctgcgatttttatgactgccacacccccaggcaccgcagatgctttccctcagtccaatgcccccatccaggacgaggaaagagacattccagagcgctcatggaacagtgggaatgaatggatcacagattttgcaggaaagactgtctggttcgtaccgagcataaaagccggtaacgacattgctaactgtttaaggaagaatggcaaaaaggtgatccaactgtctcgtaagacgtttgataccgagtatcagaaaacaaaacttaacgactgggatttcgttgtgactaccgacatctccgagatgggggccaattttaaagcggatcgggtcattgaccctagaaggtgcctgaagcccgtgatcctcacagatggaccagaacgcgttattttggcaggccccatgcctgtgaccgccgcttcagccgctcagcgaagaggtcgggtcgggaggaacccacagaaagagaatgaccaatacatattcactggccagcccctgaacaatgatgaagaccacgcacattggacggaggccaagatgctcctggacaacatcaatacccctgaaggaattatcccggctcttttcgagccagagcgcgaaaagagtgccgcaatcgatggcgagtatcgtctaaaaggggaaagcagaaagacatttgtggagctgatgcggaggggagacttgcccgtatggttagcgcacaaagtggcctccgaaggtattaagtacactgatcgcaaatggtgcttcgacggccagcgaaacaatcagatactggaggagaacatggatgttgaaatctggaccaaggagggggagaagaagaagctcagacctcggtggctggacgctaggacatattctgatccccttgccctgaaagagtttaaggacttcgcagctggacgcaaatcgattgccctcgatttggtcaccgaaatcggcagagtgccaagccacctggcacataggactcggaatgccctagacaacctggtgatgctccacacatcagagcatggtgggaaggcttaccgtcacgcggtcgaggaacttcctgagacgatggaaaccctgttattgctgggcctcatgattctgcttactggaggcgccatgctgtttctcatctccgggaaaggaataggtaagacaagtatcggcttgatttgtgttatcgcatctagcgggctgttatggatggctgagattcccctacaatggatcgcctccgccatagtgctggagttctttatgatggtactccttattccagaacctgagaagcagcgcaccccgcaggataatcaactggcatatgtggtcatcggaattttgaccctggctgccatcatagcggctaacgaaatgggcctcctggagacaactaaacgagaccttggtatgtcaaaggaacccggggtggtttctccaacgagctacctcgatgtggacctgcaccctgccagtgcatggaccttgtacgccgtcgctacaactgtaatcacccccatgctgagacatacaattgaaaattccaccgcaaacgtgagcttagccgcgatcgctaaccaggccgttgtgctaatgggcctggacaaaggatggccaatttctaagatggatctcggcgtccctcttctggcattggggtgctattcacaggtgaatcccctgactctcacggccgctgtcctgcttttaatcacacactacgccataattggaccgggcctgcaggcaaaagctaccagggaggcccaaaagcggactgcggccggtatcatgaagaacccaaccgtggacgggatcatgacaattgatctcgaccctgttatctatgattccaaattcgagaagcagttgggacaggtgatgctgctagtactgtgtgcagtgcagctccttctgatgcgcacaagttgggctttgtgcgaggccctgaccctcgcaacaggccccataacgaccctgtgggaaggtagcccaggcaaattttggaatactacaattgctgtctcgatggccaacatcttcagagggtcttacttagccggagcgggccttgctttttccattatgaaaagcgttgggaccggaaaaaggggcactggttcacaaggggagacactgggagaaaagtggaagaaaaagctcaatcagctaagtcggaaagagttcgacctgtataagaaatctggcatcaccgaggtggatcgaacggaagcaaaggagggtttgaaaagaggcgaaataacccatcacgccgtctcccgcgggagcgctaagctgcagtggtttgtggagaggaacatggtaatccccgaaggacgggtgattgacctcggctgtgggcgtggaggctggtcatactattgcgccggtcttaagaaagttacagaggtgagagggtacactaagggaggccctggccatgaggaaccggtccccatgagtacctacgggtggaatatcgtgaaactgatgagcggaaaggatgtcttctatttgccacctgagaaatgtgacacactgctctgcgatattggtgaatcctctcccagccctactgtggaggagtccaggaccatccgcgttttaaagatggtagaaccatggctgaagaacaatcagttctgtattaaagtgcttaacccctacatgcctacagtcgtggagcacctggaacggctacaacgaaagcacggcgggatgctcgttagaaatccactgtcaaggaactctacccatgagatgtattggatcagtaatggaactggcaacatagtggcatcggtcaatatggtgagccgcttgctgctcaaccggtttacgatgacacacagacgtcccaccattgaaaaagacgtagatcttggtgccgggactaggcatgtgaacgctgagccggagacccctaatatggacgttatcggagaacggatcaagcgcattaaagaggaacacaactccacatggcactacgacgatgagaatccatataagacgtgggcgtaccatggctcttatgaagtcaaggccaccggctcagcaagctccatgataaacggggtggtgaaactgttaactaagccctgggacgtcgttcctatggtgacacagatggctatgaccgatactacaccattcggacagcaacgagtatttaaagagaaggtggacaccagaacacccaggagtatgccgggtactcggcgcgtcatgggcatcaccgccgagtggctgtggagaacgttggggaggaataaaaagcctcgactctgcacccgggaagagttcacaaagaaagtgcgtactaacgcagccatgggagctgtttttaccgaagagaatcagtgggattctgccaaggcggcagtggaagacgaggatttctggaaactggtcgacagagagcgcgaactacacaaacttggcaaatgtggtagctgcgtgtacaacatgatggggaagagggagaaaaagctgggagaatttggcaaggccaaaggctcacgggctatttggtacatgtggctcggggccagatatctggagttcgaggcattgggatttctgaatgaagatcattggttctcccgcgagaacagttacagcggtgtagaaggcgaggggctccacaaacttggatatatcctgagggacatttctaaaatccccggcggtgctatgtacgccgatgacacagctgggtgggacactcgaataaccgaagatgacttacataatgaggagaagatcacgcagcagatggatccagaacaccggcaactggccaacgcaatttttaaattgacatatcagaataaggttgtgaaggtccagagacctacccccactggaacagtgatggacatcatttccaggaaagatcagcgcggctcaggccaagtggggacctacggactcaacactttcaccaatatggaggcgcagctgatccgtcagatggaaggtgagggcgtcctaagcaaggccgaccttgaaaacccacggctgcccgagaaaaagataacacagtggctcgagacgaaaggggttgaaagactgaagaggatggctatttcgggagatgactgcgtggtaaagcctatcgatgaccgctttgccaacgcattgttagctctgaatgatatgggcaaagtgcgaaaggacatcccacaatggcagccgtctaaaggttggcacgattggcagcaggtccccttctgtagtcatcacttccatgagctcattatgaaggacgggcggaaacttgtggttccttgcagaccacaagacgaactgataggaagggcccgcatctcccagggcgcaggctggagcctaagagagaccgcctgtctggggaaggcgtatgctcagatgtggtcactcatgtactttcaccggagggatttgcgtctggcctccaacgcaatttgctctgccgtgcccgtccactgggtgcctactagccgaacaacctggagtatccatgctcaccatcaatggatgactacagaagacatgcttaccgtatggaatcgcgtttggattgaggataacccatggatggaggacaagacgcccgtgacaacctgggaaaatgtcccttacctgggaaaaagagaggatcagtggtgtggttccctcatcggcttaactagccgggccacctgggcacagaacataccgacagctatccagcaagtgaggtctctgattgggaatgaagagttcttggactatatgccatcaatgaagcgctttagaaaagaggaagagagtgaaggagccatctggtga

SEQ ID NO: 15507 - RNA, 9873 nt, synthetic construct
  misc_feature 1..9873: note = derived and/or modified CDS sequence (opt3) from DENV-3__FJ639772__SS-prME
  source 1..9873: mol_type = other RNA
accagcctgtgcctcatgatgatccttcccgcagctctggcattccacttgacttccagggacggcgaacctaggatgattgtggggaagaacgaacggggaaaatctttactgtttaagactgcatcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgccggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagatagtcaccgccgaaacacaaaacagttccttcattatcgatggccccaatactccagagtgccccagcgcttctagggcatggaacgtgtgggaagttgaggactatggttttggggtgttcaccacgaatatttggctgaaacttcgggaagtctacacacagttgtgtgaccaccgcctcatgtcagccgctgtgaaggatgagagagccgttcacgcagacatgggatactggatcgagagtcagaaaaacggcagctggaagctggaaaaagcgtccctaatagaggtgaagacctgcacttggcctaagtctcataccctgtggtcgaatggtgtactcgaaagcgatatgatcattccaaaatccctggccggcccgatctcacagcacaactataggcccgggtaccatacacaaactgctggaccttggcaccttggcaagttggagctggactttaattattgcgaggggaccacagtcgtgattacggaaaactgtggaacccgtggcccaagtttacggactacaaccgtgtctggtaaactcatccacgagtggtgctgtcgaagctgcactctgccccctcttagatacatgggggaagatggatgttggtatggcatggagataaggccaatttccgaaaaggaggagaatatggtcaaatcactggttagcgccggttctggcgaagtggacaacttcacaatgggggtattgtgcctcgcaatcctgtttgaggaagtgatgcgcggaaagttcggcaagaaacatatgatcgctggggtcttctttaccttcgtgctactgctctccggacagattacgtggcgggatatggcccacactctgatcatgattggcagtaatgcaagcgacagaatgggtatgggggttacctaccttgccttgatagctacatttaagatccagcccttcctggcgttaggatttttcctcaggaaactgacctctcgcgagaaccttctgctaggcgtgggcctcgccatggcaactacactgcaattgccggaagatattgagcagatggctaatgggatcgccctgggattaatggccctcaagctgattacccagtttgagacatatcagctttggactgctctgatctccttgacctgttcaaacacgatattcacactcaccgtcgcatggcgaactgccaccctgatcctagcgggtgtgagtctgcttcctgtttgccaaagctcgtccatgcggaaaacagactggattccaatgactgtggctgccatgggcgtcccacctctccccctgtttatcttctctttgaaggataccctgaagcgtagaagctggccattaaatgaaggggtaatggcagtgggactcgtttcaattctggccagttcccttctgaggaacgacgtgcctatggctggccccttggtcgccggtgggctcctgatcgcctgttacgtgataacgggaacatctgcggatctaaccgtagagaaagctgccgacgtgacttgggaagaggaagcagagcagacaggcgtcagccataacctgatgattaccgttgacgatgacggcactatgcgcatcaaggatgacgagacagaaaatatccttaccgtgctcctgaaaacggccttgttaattgtgtccgggatatttccatactcaatcccggctactctgctcgtctggcacacctggcagaagcagacacaacggagcggagtgctgtgggatgttcctagtcccccagagacccagaaagccgaacttgaggagggtgtatatagaattaagcagcagggcatcttcgggaaaacacaagtgggagtcggcgtgcagaaggaaggtgtttttcatactatgtggcacgtgaccagaggggcagtcctgacgtacaacggaaagcgattggagcccaattgggcttctgtgaaaaaggacctaatttcctatggcggcgggtggcgcctgagcgcccagtggcaaaaaggagaagaggtacaggtcatcgcggtggaacctggtaagaaccccaagaatttccagacaatgcccggcactttccagaccacaaccggggagataggagccatcgcactcgattttaagcctggcacttcgggttcaccgattatcaaccgggaggggaagattgttggactgtacggcaatggcgtggtcaccaaaaacgggggatatgtgtctggtatcgctcaaacaaatgccgaaccagacggccccacgcctgagcttgaagaggaaatgttcaagaaaagaaacttaactataatggatctgcacccagggagtggaaagaccaggaaatacctccccgctattgttcgtgaggcaatcaagcgccggttgagaacactgatcctcgcccctaccagggtggtcgccgctgagatggaagaggcgctgaagggccttccgattcgatatcagacttccgcaacaaaaagcgaacataccggtcgggagatcgtggacctgatgtgccacgccacgtttactatgcgcttgctatctcccgtaagagtgccaaattacaacctgataattatggatgaagctcatttcacagaccctgccagcatcgcagccagggggtacatttccacccgggttggaatgggcgaggctgcggccatctttatgaccgcaactcccccaggcacagctgatgccttccctcagtcaaatgcacccatacaggacgaggaacgagacattccagagagaagttggaacagcgggaatgaatggatcaccgattttgccggaaagacagtctggttcgtgccgtctatcaaagctggtaacgacattgccaactgtctccgcaagaatggcaaaaaggtgatccaattatccaggaagacttttgatacggagtatcagaaaaccaagctgaacgactgggatttcgtcgtaacaactgacatttcagagatgggggcgaattttaaagcagatcgtgtgatagaccctcggagatgccttaagcccgttatcctgaccgatggaccagaaagggtgattctcgccggccccatgcctgtcacagctgccagtgctgcacagcgccgaggtagagtggggcggaacccacagaaagagaatgaccaatacatcttcaccggccagcccttgaacaatgatgaagaccacgcccattggactgaggctaagatgctgctcgacaacatcaatacgcctgaaggaattataccggccctgttcgagccagagagggaaaagagcgcagcgatcgatggcgagtatcgccttaaaggggaatcccgtaagacctttgttgagctaatgagacggggagacctgcccgtgtggttggcccacaaagtcgcttctgaaggtattaagtacacagataggaaatggtgcttcgacggccagcgcaacaatcagatcttagaggagaacatggatgtggaaatttggactaaggagggggagaagaagaagctgcgacctagatggctcgacgcccggacctattcggatcccctggcacttaaagagtttaaggacttcgctgccggaaggaaaagcatcgcactggatctcgtaacagaaataggccgcgtgccaacccacttggcccatagaactaggaatgctctggacaacctagttatgctgcacacatcagagcatggtgggaaggcgtaccggcacgccgtcgaggaactccctgagacgatggaaacccttctgttattgggcctgatgatcctcctgactggaggcgcaatgctttttctgatttccgggaaaggaatcggtaagacaagtattggcctcatctgtgtgatagcttctagcgggatgttgtggatggccgagattcccctgcaatggatcgcctccgcaattgtgttagagttctttatgatggtcctactgatcccagaacctgagaagcagcgtaccccgcaggataatcaactcgcttatgttgtgataggaatccttaccctggccgcgattatcgctgccaacgaaatgggcttgctggagacaactaaacgcgacctcggtatgtcaaaggaacccggggtagtgtctccaacgagctacctggatgtcgaccttcaccctgcaagtgcctggaccctctacgctgtggcaacaactgttattacccccatgctgcgacatacaatcgaaaattccaccgccaacgtgagcttggcggctatagccaaccaggcagtcgtactgatgggcttagacaaaggatggccaatttctaagatggatctaggcgtgcctctgctcgcccttgggtgctattcacaggttaatcccctgactttgacggctgccgtgctgctcctgatcacacactacgcaatcattggaccgggccttcaggctaaagccaccagagaggcgcaaaagaggactgccgcaggtatcatgaagaacccaaccgtcgacgggataatgacaattgatttagaccctgtgatctatgattccaaattcgagaagcagctgggacaggtcatgctcttggtgctgtgtgctgttcagctactgctcatgcggacaagttgggccctttgcgaggcactgaccttggctacaggccccattacgaccctgtgggaaggtagcccaggcaaattttggaatactacaatcgccgtgtcgatggccaacatattccgcgggtcttacctcgcgggagctggcctggcattttccatcatgaaaagcgtagggaccggaaaaagaggcactggttcacaaggggagacattaggagaaaagtggaagaagaaacttaatcagctgagtaggaaagagttcgacctctataagaaatctggcattaccgaggtggatcggacggaagccaaagagggtctaaaacgaggcgaaatcacccatcacgctgtctccagagggagcgccaagctgcagtggtttgttgagcgcaacatggtgattcccgaaggaagggtcatcgacttgggctgtgggcggggaggctggtcatactattgcgcaggtctgaagaaagtgacagaggtacgtgggtacactaagggaggccctggccatgaggaaccggtgcccatgagtacctacgggtggaatattgttaaactcatgagcggaaaggatgtgttctatcttccacctgagaaatgtgacacactgttgtgcgatatcggtgaatcctctcccagccctactgtcgaggagtccagaaccataagggtgctgaagatggtcgaaccatggctcaagaacaatcagttctgtattaaagtgttaaacccctacatgcctacagttatcgagcacctggaacgccttcaacggaagcacggcgggatgctggtacgaaatccactatcaagaaactctacccatgagatgtattggatcagtaatggaactggcaacattgtggcctcggtcaatatggtgagcaggctcctgttgaaccgctttacgatgacacaccggagacccaccatagaaaaagacgttgatctgggtgctgggactcgtcatgtgaacgcggagccggagacccctaatatggacgtcatcggagaaaggattaagcggatcaaagaggaacacaactccacatggcactacgacgatgagaatccatataagacgtgggcctaccatggctcttatgaagtgaaggcaaccggctcagctagctccatgattaacggggtagtgaaactccttactaagccctgggacgttgtccctatggtgacacagatggccatgaccgatactacaccattcggacagcaacgcgtgtttaaagagaaggtcgacacccgaacacccagaagtatgccgggtactaggcgggttatgggcatcaccgcagagtggctgtggcgcacgttagggagaaataaaaagcctaggctgtgcacccgagaagagttcacaaagaaagtgcggactaacgccgctatgggagccgtatttaccgaagagaatcagtgggattctgcgaaggcagccgtggaagacgaggatttctggaaattggtcgaccgtgagagagaactccacaagctgggcaaatgtggtagctgcgtgtacaacatgatggggaagcgcgagaaaaagctaggagaatttggcaaggctaaaggctcaagggccatatggtacatgtggcttggggcacggtatctggagttcgaggctctcggatttctgaatgaagatcattggttctccagagagaacagttacagcggtgttgaaggcgaggggttgcacaagctgggatatatcctccgcgacatttctaaaatccccggcggtgccatgtacgctgatgacacagccgggtgggacactaggattaccgaagatgaccttcataatgaggagaagatcacgcagcagatggatccagaacaccgacaactggcaaacgcgatatttaaattaacatatcagaataaggtggtcaaggtgcagcggcctacccccactggaacagtaatggacattatctccagaaaagatcagaggggctcaggccaagttgggacctacggactgaacactttcaccaatatggaggcccagttgatccgccagatggaaggtgagggcgtgctcagcaaggctgacctggaaaacccacacctacccgagaaaaagattacacagtggcttgagacgaaaggggtcgaacgtctgaagcggatggccatatcgggagatgactgcgtggtgaagcctatcgatgacagatttgcaaacgctctcctggccttgaatgatatgggcaaagtcaggaaggacattccacaatggcagccgtctaaaggttggcatgattggcagcaggttcccttctgtagtcaccatttccacgagttaatcatgaaggacgggcgcaaactggtggtaccttgccgaccacaagacgaactcattggacgggcaagaatctcccagggcgccggctggagccttagggagaccgcgtgtctggggaaggcttatgcccagatgtggtcactaatgtactttcaccgcagagatctgcggctcgcatccaacgccatatgctctgctgtgcccgtccattgggtgcctactagcaggacaacctggagtatccacgcccatcaccaatggatgactacagaagacatgttgaccgtttggaatcgtgtgtggattgaggataacccatggatggaggacaagacgcccgtcacaacctgggaaaatgtgccttacctgggaaaacgagaggatcagtggtgtggttcccttatcggcctgactagccgcgcaacctgggctcagaacattccgacagccatccagcaagtaagatctctcattgggaatgaagagttcttagactatatgccatcaatgaagcggtttaggaaagaggaagagagtgaaggagcgatatggtga

SEQ ID NO: 15508 - RNA, 9873 nt, synthetic construct
  misc_feature 1..9873: note = derived and/or modified CDS sequence (opt3) from DENV-3__FJ639774__SS-prME
  source 1..9873: mol_type = other RNA
accagcctgtgcctcatgatgatccttcccgcagctctggcattccacttgacctccagggacggcgagcctaggatgattgtggggaagaacgagcggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaaggacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcgggaccactacagaaacgccaacctggaataggaaagagcttctggtaacttttaagaacgcccacgccaagaagcaagaagttgtggtcttgggctcccaggagggagctatgcacacagccctcaccggcgctacagaaattcaaaattcagggggaacaagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgttccctgtaaaatccctttctccactgaggacggccaaggtaaggcccataacgggcgtcttataaccgctaatccagtggtaactaagaaggaggaacccgtcaacattgaggcggaaccgcctttcggcgagtcaaatatcgtgatcggaattggcgataacgcattgaaaatcaattggtataagaaggggagcagtattggaaaaatgtttgaagccactgctcgcggtgccagaaggatggcaatactgggcgacaccgcctgggatttcgggtctgttggaggcgtgctcaactccctgggtaagatggtccaccagatctttgggagcgcttacacggcccttttctcgggcgtgtcttgggtaatgaaaattggaatcggcgtgctgttgacatggatcgggctcaattccaagaacacctcaatgagttttagctgcattgcaataggaatcattactctgtatttaggcgcggttgtccaggctgacatgggttgtgtgatcaattggaaagggaaggagctgaagtgcggatccggcattttcgtgacaaacgaggtccatacctggactgaacagtacaaatttcaagccgattctcccaagcggctagcaaccgccatcgctggtgcctgggagaatggcgtttgtgggatacgaagcacaacgcgcatggaaaacctcctgtggaaacagatcgcaaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggctaagatagtgacagccgaaactcaaaacagttccttcattatcgatggccccaataccccagagtgccccaacgcgagcagggcctggaatgtttgggaagtggaggactatggttttggggtcttcacgacaaacatttggctgaaacttcgggaagtgtacacccagttgtgtgaccaccgcctcatgtctgctgcagttaaggatgagagagccgtgcacgctgacatgggatactggatcgagtcacagaaaaatggcagttggaagctggaaaaagccagcctaatagaggtaaagacttgcacctggcctaagtcccatacactgtggtctaacggtgtcctcgaatcggatatgatcattccaaaaagcctggcaggcccgatctcccagcacaattataggcccgggtaccatactcaaaccgcgggaccttggcaccttggcaagttggagctggactttaactattgcgaggggacaacggtggtgattaccgaaaattgtggaactcgtggcccatcattacggacaaccactgtcagtggtaaactcatccacgagtggtgctgtcgatcttgcacactgccccctcttagatacatgggggaagatggatgttggtatggcatggagataaggccaattagcgaaaaggaggagaacatggttaaatccctggtgtcagccggtagcggcgaagtagacaatttcaccatgggggtgttgtgcctcgctatcctgtttgaggaagtcatgcgcggaaagttcggcaagaaacatatgatcgccggggtgttctttacgttcgttctactgctctctggacagattacttggcgggatatggcacacaccctgatcatgattggctccaacgctagtgacagaatgggtatgggggtgacataccttgccttgatagcaacctttaagatccagcccttcctggccttaggatttttcctcaggaaactgactagccgcgagaatcttctgctaggcgtcggcctcgctatggcgacaaccctgcaattgccggaagatattgagcagatggccaacgggatcgcactgggattaatggctctcaagctgattacacagtttgagacttatcagctttggaccgccctgatctctttgacgtgttccaatacaatattcaccctcactgtggcctggcgaaccgctacactgatcctagccggtgtttcactgcttcctgtgtgccaaagtagctcgatgcggaaaactgactggctcccaatgaccgtcgccgcgatgggcgtaccccctctgcccttgtttattttctccctgaaggatacgttaaagcgtagatcttggccactcaacgaaggggtgatggctgttggactggtgagcatccttgcctcaagtctgttgaggaacgacgtccctatggcaggccccctcgtggccggtgggctgctaattgcttgttacgtaatcacaggaacctccgcagatctgactgtggagaaagccgcggacgtcacatgggaagaggaagctgagcagaccggcgtttctcataatcttatgataactgtggacgatgacggcacaatgcgcattaaggatgacgagaccgaaaacatcctcacggtgctgttgaaaactgccttactgatcgtcagcgggatttttccatactccataccggcaaccctcctggtgtggcacacatggcagaagcagacccaacggtcaggagttctttgggatgtacctagcccaccagagacacagaaagccgaactggaggagggtgtgtatagaatcaagcagcagggcattttcgggaaaactcaagtcggagtgggcgttcagaaggaaggtgtgtttcataccatgtggcacgtcacgagaggggctgtgttgacatacaatggaaagcgactagagcccaactgggccagtgtcaagaaggacctgatctcttatggcggcgggtggcgcctctccgcacagtggcaaaaaggagaagaggtccaggtgattgctgttgaacctggtaagaatcccaaaaatttccagactatgcccggcaccttccagacaaccactggggagatcggagccatagcgctggattttaagcctggcaccagcggttcgccgatcattaatcgggaggggaaggtggtcggactttacggcaacggcgtggttaccaaaaatgggggatatgtgtcaggtatcgcccaaacgaacgcagaaccagacggccccactcctgagttagaagaggaaatgttcaagaaaagaaatctgaccattatggatctccacccagggtctggaaagacaaggaaatacttgcccgctatcgtccgtgaggccataaagcgccggctgagaaccctcattctggctcctactagggtggtagcagccgagatggaagaggcccttaagggcctgccgatccgatatcagacaaccgctacgaaaagtgaacatactggtcgggagatcgtggacttgatgtgccacgcgacatttaccatgcgcctactgtcccccgttagagtcccaaactacaatctcattatcatggatgaagcacatttcaccgaccctgccagcatagctgccagggggtacatttctactcgggtgggaatgggcgaggcagccgctatctttatgacagcgacacccccaggcacagccgatgcattccctcagagcaacgctcccattcaggacgaggaacgagacatcccagagagatcctggaactcagggaacgaatggataactgattttgccggaaagacggtgtggttcgtcccgagtattaaagcaggtaacgacatcgccaattgtttacgcaagaacggcaaaaaggtaatccaactgagcaggaagacctttgatacagagtatcagaaaactaaacttaatgactgggatttcgtggttaccacagacatttctgagatgggggctaactttaaagccgatcgtgtgatcgaccctcggagatgcctgaagcccgtcattctcaccgatggaccagaaagggtgatattggcgggccccatgcctgttactgcagcctccgctgcccagcgccgaggtagagtggggcggaatccacagaaagagaacgaccaatacatcttcacgggccagcccctgaataacgatgaagaccacgctcattggaccgaggcaaagatgctcctggacaatattaacacacctgaaggaatcatcccggcccttttcgagccagagagggaaaagtcagctgccattgatggcgagtatcgcctaaaaggggaaagtcgtaagacttttgtcgagctgatgagacggggagacttgcccgtgtggttagcacacaaagtagcgagcgaaggtataaagtacaccgataggaaatggtgcttcgacggccagcgcaataaccagatcctggaggagaatatggatgtggaaatttggacaaaggagggggaacggaaaaagctcagacctagatggctggacgccaggacctattccgatccccttgctctgaaggagtttaaagacttcgccgcaggacgcaagtctatcgctctcgatttggttactgaaattggcagagtcccaacacacctggcccataggacgcggaacgcactagacaatctggtgatgctccacacctcggagcatggtgggaaagcctaccgtcacgctgtggaggaacttcctgagactatggaaacactgttattgctgggcctcatgatcctgcttaccggaggcgcgatgctgtttctcataagcgggaagggaatcggtaaaacctcaattggcttgatctgtgtcattgcctccagtgggatgctgtggatggcagagatccccttacaatggatagcttctgccattgttctagagttctttatgatggtgctgctcatcccagaacctgagaagcagcgcacaccgcaggataaccaacttgcctatgtagtgattggaatcctgactttggcagctataatcgccgcgaatgaaatgggcctgctcgagacgaccaagcgagacctgggtatgagcaaagaacccggggtcgtgtccccaacatcataccttgatgttgacctccaccctgcttctgcctggactctgtacgcagtggccaccacagtcattacccccatgttgagacatactatcgagaacagcacggctaacgtaagtctggcagccattgcgaatcaggctgtggttttaatgggcctagacaagggatggccaatctccaaaatggatctgggcgtgcctctccttgccctggggtgctatagccaggtcaaccccttgacactgaccgcagccgtgctcctgcttataactcactacgctattatcggaccgggcttacaggccaaggcaaccagggaggctcaaaaacggacagccgcgggtatcatgaagaatccaactgtcgacgggattatgaccatcgatctggaccctgtgatatatgattctaagttcgaaaaacagctcggacaggttatgttgctggtgctatgtgccgtacagctgctccttatgcgcacatcatgggcactgtgcgaggctttgacgctggccaccggccccattactacactctgggaaggttccccaggcaagttttggaacaccactatcgcagtgagtatggctaatattttcagagggagctacctggccggagccggcttagcgttttcgatcatgaaatctgtcgggacaggaaagaggggcaccggttcccaaggggagacgcttggagaaaaatggaagaagaaactgaaccagctcagccggaaggagttcgacctatataaaaagtcaggcataaccgaggttgatcgaacagaagctaaagagggtctgaagagaggcgaaatcactcatcacgcagtgagtcgcgggtctgccaaattgcagtggtttgtcgagaggaatatggtgattcccgaaggacgggtaatcgacctgggctgtgggcgtggaggctggtcctactattgcgctggtctcaagaaggtgaccgaggttagagggtacacaaaaggaggccctggccatgaggaaccggtgcccatgagcacttacgggtggaacattgtcaaacttatgtcaggaaaagatgtgttctatctgccacctgagaagtgtgacaccttgctgtgcgatatcggtgaaagtagcccctcccctacagtcgaggagtctaggaccattcgcgtgctcaaaatggttgaaccatggttaaagaataaccagttctgtatcaaggtactgaatccctacatgcctgccgtgatagagcaccttgaacggctgcaacgaaaacacggcgggatgctagtcagaaacccactcagcagaaattccactcatgagatgtattggatttcaaacggaacgggcaatatcgtggcatctgttaacatggtgagtcgcctgttgctgaaccggtttacaatgacccacagacgtcccactatcgaaaaggacgtcgatctcggtgccgggaccaggcatgtgaatgctgagccggagacacctaacatggacgtaattggagaacggataaaacgcatcaaggaggaacacaattcgacgtggcactacgacgatgagaacccatataaaacctgggcgtaccatggcagctatgaagtgaaggccactggctccgcatcttcaatgattaatggggttgtcaaacttctgacaaaaccctgggacgtggtgcctatggtcacccagatggctatgactgatacaaccccattcggacagcaacgagtttttaaggagaaagtggacacaagaactcccaggagcatgccgggtacccggcgcgtaatgggcatcacggccgagtggttatggagaaccctggggaggaacaagaaacctcgattgtgcacacgggaagagttcactaagaaggtgcgtaccaatgcagccatgggagctgtctttacagaagagaaccagtgggattccgccaaagcggcagtggaagacgaggatttctggaagctcgttgacagagagcgcgaactgcacaaactaggcaagtgtggtagttgcgtgtacaatatgatggggaaaagggagaagaaacttggagaatttggcaaggccaagggctctcgggctatttggtacatgtggctgggggccagatatctcgagttcgaggcactgggatttttgaacgaagatcattggttcagccgcgaaaattcatactccggtgtcgaaggcgaggggctgcacaaactcggatatatccttagggacataagtaagatccccggcggtgctatgtacgccgatgacactgctgggtgggacacccgaattacggaagatgacctgcataacgaggagaaaatcacacagcagatggatccagaacaccggcaattagccaatgcaatttttaagctgacctatcagaacaaagtggtaaaggttcagagacctactcccacaggaaccgtgatggacatcataagcaggaaggatcagcgcggctctggccaagtcgggacttacggattgaataccttcacaaacatggaggcgcagctcattcgtcagatggaaggtgagggcgtgctgtccaaagccgacctagaaaacccacaccttcccgagaagaaaatcacgcagtggctggagaccaagggggtggaacggctcaaaagaatggctatctcaggagatgactgcgtcgttaagcctattgatgacaggtttgccaatgcactgttggctttaaacgatatgggcaaggtgcgcaaagacataccacaatggcagccgagcaagggttggcatgattggcagcaggtacccttctgttcgcaccatttccacgagctgatcatgaaagacgggcgaaagctcgtggtcccttgccggccacaagacgaacttattggacgagcaaggatctctcagggcgcaggctggagtctgcgcgagactgcctgtctagggaaagcgtatgctcagatgtggtccctgatgtactttcacagacgggatctcaggttggccagcaatgcaatttgctcagccgtgcccgttcattgggtgcctacatcccgtaccacttggtctatccacgctcatcaccaatggatgacaaccgaagacatgctgacggtctggaaccgagtgtggatagaggataatccatggatggaggacaagacacccgtaaccacttgggaaaacgttccttaccttggaaagcgcgaggatcagtggtgtggtagcctgatcggcctcaccagtagagccacatgggcacagaatattccgactgctatccagcaagtgcggtccttaattgggaacgaagagttcctggactatatgccaagcatgaaaaggtttcgcaaggaggaagagtctgaaggagccatctggtga

SEQ ID NO: 15509 - RNA, 9873 nt, synthetic construct
  misc_feature 1..9873: note = derived and/or modified CDS sequence (opt3) from DENV-3__FJ639775__SS-prME
  source 1..9873: mol_type = other RNA
accagcctgtgcctcatgatgatccttccagccgctctggcattccacttgacttccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaagaagaagctccgacctagatggctggacgctcggacatattctgatccccttgccctgaaagagtttaaggacttcgcagctggaaggaaatcgatcgccctcgatttggttaccgaaattggccgcgtcccaagccacctggcacatagaactaggaatgccctagacaacctggtgatgctccacacatcagagcatggtgggaaggcttaccggcacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgtaccccgcaggataatcaacttgcatatgtagtgattggaatcctgaccttggctgccataatcgcggctaacgaaatgggcctgctcgagacaactaaacgcgacctgggtatgtcaaaggaacccggggtcgtgtctccaacgagctaccttgatgttgacctccaccctgccagtgcatggaccctgtacgccgtggctacaactgtcattacccccatgttgcgacatacaatcgaaaattccaccgcaaacgtaagcctggccgcgattgctaaccaggccgtggttttaatgggcctagacaaaggatggccaatctctaagatggatctgggcgtgcctctccttgcactggggtgctattcacaggtcaatcccttgactctgacggccgctgtgctcctgcttataacacactacgccattatcggaccgggcttacaggcaaaagctaccagagaggcccaaaagaggactgcggccggtatcatgaagaacccaaccgtcgacgggattatgacaatcgatctggaccctgtgatatatgattccaaattcgagaagcagctcggacaggttatgttgctggtgctatgtgcagtacagctgctccttatgcggacaagttgggctctgtgcgaggccttgaccctggcaacaggccccattacgaccctctgggaaggtagcccaggcaaattttggaatactacaatcgctgtgtcgatggccaacattttccgcgggtcttacctggccggagcgggcttagctttttccatcatgaaaagcgtcgggaccggaaaaagaggcactggttcacaaggggagacacttggagaaaagtggaagaaaaagctgaatcagctcagtaggaaagagttcgacctatataagaaatctggcataaccgaggttgatcggacggaagcaaaggagggtctgaaacgaggcgaaatcacccatcacgccgtgtccagagggagcgctaagttgcagtggtttgtcgagcgcaacatggtgattcccgaaggaagggtaatcgacctgggctgtgggcggggaggctggtcatactattgcgccggtctcaagaaagtgacagaggttcgtgggtacactaagggaggccctggccatgaggaaccggtgcccatgagtacctacgggtggaatattgtcaaacttatgagcggaaaggatgtgttctatctgccacctgagaaatgtgacacattgctgtgcgatatcggtgaatcctctcccagccctactgtcgaggagtccagaaccattagggtgctcaagatggttgaaccatggttaaagaacaatcagttctgtatcaaagtactgaacccctacatgcctacagtgatagagcaccttgaacgcctgcaacggaagcacggcgggatgctagtccgaaatccactctcaagaaactctacccatgagatgtattggattagtaatggaactggcaacatcgtggcatcggttaatatggtgagcaggctgttgctgaaccgctttacgatgacacaccggagacccaccatcgaaaaagacgtcgatctcggtgccgggactcgtcatgtgaacgctgagccggagacccctaatatggacgtaattggagaaaggataaagcggatcaaagaggaacacaactccacatggcactacgacgatgagaatccatataagacgtgggcgtaccatggctcttatgaagtgaaggccaccggctcagcaagctccatgattaacggggttgtcaaacttctgactaagccctgggacgtggtgcctatggtcacacagatggctatgaccgatactacaccattcggacagcaacgcgtttttaaagagaaggtggacacccgaacacccagaagtatgccgggtactaggcgggccatgggcatcaccgcagagtggttatggcgcacgctggggagaaataaaaagcctaggttgtgcacccgagaagagttcacaaagaaagtacggactaacgccgctatgggagccgtgtttaccgaagagaatcagtgggattctgcgaaggcagccgtcgaagacgaggatttctggaaactcgtggaccgtgagagagaactgcacaagctaggcaaatgtggtagctgcgtttacaacatgatggggaagcgcgagaagaaacttggagaatttggcaaagctaaaggctcaagggccatttggtacatgtggctgggggcacggtatctcgagttcgaggctctgggatttttgaatgaagatcattggttctccagagagaacagttacagcggtgtggaaggcgaggggctgcacaagctcggatatatccttcgcgacatatctaaaatccccggcggtgccatgtacgctgatgacacagccgggtgggacactaggattaccgaagatgacctgcataatgaggagaagatcacgcagcagatggatccagaacaccgacaattagcaaacgcgatttttaaactgacatatcagaataaggtcgtgaaggtacagcggcctacccccactggaacagttatggacatcatatccagaaaagatcagaggggctcaggccaagtggggacctacggattgaacactttcaccaatatggaggcccagctcattcgccagatggaaggtgagggcgtcctgagcaaggctgacctagaaaacccacaccttcccgagaaaaagatcacacagtggctggagacgaaaggggtggaacgtctcaagcggatggccatctcgggagatgactgcgtggtcaagcctattgatgacagatttgcaaacgctctgttggccttaaatgatatgggcaaagttaggaaggacataccacaatggcagccgtctaaaggttggcatgattggcaacaggtgcccttctgtagtcaccatttccacgagctgatcatgaaggacgggcgcaaactcgtagtgccttgccgaccacaagacgaacttattggacgggcaagaatctcccagggcgccggctggagcctgagggagaccgcgtgtctagggaaggcttatgcccagatgtggtcactgatgtactttcaccgcagagatctccggttggcatccaacgccatttgctctgctgtccccgtgcattgggttcctactagcaggacaacctggagtatccacgcccatcaccaatggatgactacagaagacatgctgaccgtgtggaatcgtgtctggatagaggataacccatggatggaggacaagacgcccgtgacaacctgggaaaatgtaccttaccttggaaaacgagaggatcagtggtgtggttccctgatcggcctcactagccgcgcaacctgggctcagaacattccgacagccatccagcaagttagatctttaattgggaatgaagagttcctggactatatgccatcaatgaagcggtttaggaaagaggaagagagtgaaggagcgatctggtga

SEQ ID NO: 15510 - RNA, 9873 nt, synthetic construct
  misc_feature 1..9873: note = derived and/or modified CDS sequence (opt3) from DENV-3__FJ639777__SS-prME
  source 1..9873: mol_type = other RNA
accagcctgtgcctcatgatgacacttcccgccgctctggcattccacttgacttccagagacggcgagcctaggatgatcgtggggaagaacgaacggggaaaatctttactgtttaagacggcctcaggtattaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcaccgccgagacaagcgtagcgtagcccttgcaccccatgtgggcatgggtctggataccagaacgcaaacttggatgtccgccgagggggcttggaggcaggtcgaaaaagtggagacctgggcattgcggcaccctggattcacaatcctcgccctgtttctggctcattacattggcacttctctcacccagaaggttgtgatcttcatattactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccaccagatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtggcggccgaaacacaaaacagttccttcataattgatggccccaatactccagagtgccccagcgcttctagggcatggaacgtttgggaagtggaggactatggttttggggtcttcaccacgaatatctggctgaaacttcgggaagtgtacacacagttgtgtgaccaccgcctcatgtcagccgctgttaaggatgagagagccgtgcacgcagacatgggatactggattgagagtcagaaaaacggcagctggaagctggaaaaagcgtccctaatcgaggtaaagacctgcacttggcctaagtctcataccctgtggtcgaatggtgtcctcgaaagcgatatgataatcccaaaatccctggccggcccgatttcacagcacaactataggcccgggtaccatacacaaactgctggaccttggcaccttggcaagttggagctggactttaattattgcgaggggaccacagtggtgatcacggaaaactgtggaacccgtggcccaagtttacggactacaaccgtctctggtaaactcattcacgagtggtgctgtcgaagctgcactctgccccctcttagatacatgggggaagatggatgttggtatggcatggagatcaggccaatatccgaaaaggaggagaatatggttaaatcactggtgagcgccggttctggcgaagtagacaacttcacaatgggggtgttgtgcctcgcaattctgtttgaggaagtcatgcgcggaaagctaggcaagaaacatatgatcgctggggtgttcttcacctttgttctgctcctgtccggacagatcacgtggcgggatatggcccacactcttattatgatcggcagtaatgcaagcgacagaatgggtatgggggtgacctacttggccctgattgctacattcaagatacagccctttttagcgctcggattctttctgaggaaacttacctctcgcgagaacctgctactcggcgtcggcctggccatggcaactacattgcaactgccggaagatatcgagcagatggctaatgggattgccttaggactcatggccctgaagcttatcacccagttcgagacatatcagctgtggactgctttgatttccctcacctgttcaaacacgatctttacactgaccgtggcatggcgaactgccaccctaatactggcgggtgttagtcttctccctgtgtgccaaagctcgtccatgcggaaaacagactggctgccaatgactgtcgctgccatgggcgtaccccctttgcccctgttcatcttttctttaaaggataccctcaagcgtagaagctggccactgaatgaaggggtgatggcagttggacttgtgtcaattctggccagttccttgctcaggaacgacgtccctatggctggccccctggtggcaggtgggctactgatcgcctgttacgtaattacgggaacatctgcggatcttaccgtggagaaagctgccgacgtcacttgggaagaggaagcagagcagacaggcgttagccataacctcatgatcaccgtggacgatgacggcactatgcgcataaaggatgacgagacagaaaatattctgaccgtgttgttaaaaacggccctgctcatcgtctccgggatcttcccatactcaattccggctactctgcttgtgtggcacacctggcagaagcagacacaacggagcggagttctgtgggatgtacctagtcccccagagacccagaaagccgaattggaggagggtgtgtatagaataaagcagcagggcatctttgggaaaacacaagtcggagtgggcgttcagaaggaaggtgtgttccatactatgtggcacgtcaccaggggggcagtgctaacgtacaacggaaagcgactggagcccaattgggcttctgtaaaaaaggacctcatttcctatggcggcgggtggcgcctgaacgcccagtggcaaaaaggagaagaggtccaggtgatcgcggttgaacctggtaagaatccaaaaaactttcagacaatgcccggcactttccagaccacaaccggggagattggagccatcgcacttgatttcaagcctggcactagcggttcgccgataatcaatcgggaggggaaggtggtcggattatacggcaacggcgtggttaccaaaaatgggggatatgtgtcaggtattgctcaaacaaacgccgaaccagacggccccacgcctgagctggaagaggaaatgtttaagaaaagaaatctcactatcatggatttgcacccagggtctggaaagaccaggaaatacctgcccgctattgtccgtgaggcaatcaagcgccggctcagaacactgatacttgcccctaccagggtggtagccgctgagatggaagaggcgctgaagggcttgccgattcgatatcagactacagcaaccaaaagtgaacatacgggtcgggagatcgtggacctaatgtgccacgccactttcacaatgcgcctgctctcccccgttagagtcccaaactacaatttaatcattatggatgaagctcattttaccgaccctgccagcatcgcagccagggggtacatatctacccgggtgggaatgggcgaggctgcggccattttcatgactgcaacacccccaggcaccgctgatgcctttcctcagagcaacgcacccatccaggacgaggaacgagacattccagagagatcctggaattcagggaacgaatggatcacagatttcgccggaaagactgtgtggtttgtcccgagtataaaagctggtaacgacattgccaattgtctgcgcaagaacggcaaaaaggtaatccaacttagcaggaagacgttcgataccgagtatcagaaaacaaagctgaatgactgggattttgtggttactaccgacatctctgagatgggggcgaacttcaaagcagatcgtgtgattgaccctcggagatgcctcaagcccgtcatcttgacagatggaccagaaagggtgattctggccggccccatacctgttaccgctgcctccgctgcacagcgccgaggtagagtggggcggaatccacagaaagagaacgaccaatacatctttactggccagcccctcaataacgatgaagaccacgcccattggacggaggctaagatgctgcttgacaatattaacacccctgaaggaatcatcccggccctattcgagccagagagggaaaagtcagcagcgattgatggcgagtatcgcctgaaaggggaaagtcgtaagacattcgtcgagttgatgagacggggagacttacccgtgtggctggcccacaaagtagctagcgaaggtataaagtacactgataggaaatggtgctttgacggccagcgcaataaccagatcctcgaggagaatatggatgtggaaatttggaccaaggagggggaaaaaaagaagctgcgacctagatggcttgacgcccggacatattccgatcccctggcactcaaagagttcaaggactttgctgccggaaggaaatctatcgcattggatctggttaccgaaattggccgcgtcccatcgcacctagcccatagaactaggaacgctctggacaatctcgtgatgcttcacacaagcgagcatggtgggaaggcgtaccggcacgccgtggaggaactgcctgagacgatggaaaccttattgctgctcggcctgatgatccttctgactggaggcgcaatgctcttcttgatatcagggaaaggaatcggtaagacatccattggcctgatctgtgtcattgctagttctgggatgttatggatggccgagatccccctacaatggatagccagcgcaattgttctggagtttttcatgatggtgctccttatcccagaacctgagaagcagcgtaccccgcaggataaccaactggcttatgtagtgattggaatcttgaccctggccgcgataatcgctgccaatgaaatgggcctcctggagacaactaaacgcgaccttggtatgtccaaggaacccggggtcgtgtcaccaacgtcttacctcgatgttgacctgcaccctgcaagcgcctggaccttgtacgctgtggcaacaactgtcattacccccatgctgcgacatacaatcgagaacagtaccgccaacgtatccttagcggctattgccaatcaggcagtggttctaatgggcctggacaaaggatggccaatcagcaagatggatctcggcgtgcctcttctggccttggggtgctattctcaggtcaaccccctgactctcacggctgccgtgctgcttttaataacacactacgcaattatcggaccgggcctgcaggctaaagccaccagagaggcgcaaaagaggactgccgcaggtatcatgaagaatccaaccgtcgacgggattatgacaatcgatctcgaccctgtgatatatgattcaaaatttgaaaagcagttgggacaggttatgctgctagtgctgtgtgctgtacagctccttctgatgcggacttcctgggccttgtgcgaggcactgaccctcgctacaggccccattacgaccctgtgggaaggtagtccaggcaaattctggaacactacaatcgccgtgagcatggccaatatttttcgcgggtcgtacatcgcgggagctggcttagcattctctataatgaagtccgtcgggaccggaaaaagaggcactggtagccaaggggagacacttggagaaaagtggaagaaaaagctgaaccagctctcaaggaaagagtttgacctatataagaaaagtggcatcaccgaggttgatcggacggaagccaaggagggtctgaaacgaggcgaaattacccatcacgctgtgtctagagggtccgccaagttgcagtggttcgtcgagcgcaatatggtgacacccgaaggaagggtaatcgacctgggctgtgggcggggaggctggagctactattgcgcaggtctcaagaaagtgactgaggttcgtgggtacaccaagggaggccctggccatgaggaaccggtgcccatgtcaacatacgggtggaacattgtcaaacttatgagtggaaaggatgtgttttatctgccacctgagaaatgtgacactttgctgtgcgatatcggtgaaagctccccctctcctaccgtcgaggagagcagaacaattagggtgctcaagatggttgaaccatggttaaagaataaccagttctgtatcaaagtactgaatccctacatgcctaccgtgatagagcaccttgaacgcctgcaacggaagcacggcgggatgctagtccgatccccactctcaagaaactctactcatgagatgtattggattagtaatggaacgggcaacatcgtggcctcggttaatatggtgagcaggctgttgctgaaccgcttcacaatgacccaccggagacccactatcgaaaaagacgtcgatctcggtgctgggacccgtcatgtgaacgcggagccggagacacctaatatggacgtaattggagaaaggataaagcggatcaaagaggaacacaactccacgtggcactacgacgatgagaatccatataagacctgggcctaccatggctcttatgaagtgaaggcaactggctcagctagctccatgattaacggggttgtcaaacttctgacaaagccctgggacgtggtgcctatggtcacccagatggccatgactgatacaaccccatttggacagcaacgcgttttcaaagagaaggtggacacacgaactcccagaagtatgccgggtaccaggcgggtaatgggcatcacggcagagtggttatggcgcaccctggggagaaataaaaagcctaggttgtgcacacgagaagagtttactaagaaagtgcggaccaacgccgctatgggagccgtcttcacagaagagaatcagtgggattctgcgaaggcagccgtggaagacgaggatttttggaaactcgttgaccgtgagagagaactgcaccgcctaggcaagtgtggtagctgcgtgtacaacatgatggggaaaagggagaagaaacttggagaattcggcaaggctaagggctcacgggccatttggtacatgtggctgggggcaagatatctcgagtttgaggctctgggattcttgaatgaagatcattggttttcccgcgagaacagttacagcggtgtcgaaggcgaggggctgcacaaactcggatatatccttagggacatatctaagatccccggcggtgccatgtacgctgatgacactgccgggtgggacacccgaattacggaagatgacctgcataatgaggagaaaatcacacagcagatggatccagaacaccggcaattagcaaacgcgattttcaagctgacctatcagaataaagtggtaaaggttcagagacctactcccacaggaaccgtgatggacatcatatccaggaaggatcagcgcggctcaggccaagtcgggacttacggattgaacacctttacaaatatggaggcccagctcattcgtcagatggaaggtgagggcgtgctgagcaaagctgacctagaaaacccacaccttcccgagaagaaaatcacgcagtggctggagaccaagggggtggaacggctcaaaagaatggccatctcgggagatgactgcgtcgttaagcctattgatgacaggttcgcaaacgctctgttggccttaaatgatatgggcaaggtgcgcaaagacataccacaatggcagccgtctaagggttggcatgattggcagcaggtacccttttgtagtcaccatttccacgagctgatcatgaaagacgggcgaaagctcgtggtcccttgccggccacaagacgaacttattggaagagcaaggatctcccagggcgccggctggagcctgcgcgagactgcgtgtctagggaaagcttatgcccagatgtggtcactgatgtacttccacagacgggatctcaggttggcatccaacgccatttgctctgctgtgcccgttcattgggtgcctacaagccgtaccacttggagtatccacgcccatcaccaatggatgacaaccgaagacatgctgacggtctggaatcgagtgtggatagaggataacccatggatggaggacaagacacccgtaaccacttgggaaaatgttccttaccttggaaagcgcgaggatcagtggtgtggttccctgatcggcctcaccagcagagcaacatgggctcagaacattccgactgccatccagcaagtgcggtctttaattgggaatgaagagtttctggactatatgccatcaatgaaaaggttccgcaaggaggaagagagtgaaggagcgatctggtga

SEQ ID NO: 15511 - RNA, 9873 nt, synthetic construct
  misc_feature 1..9873: note = derived and/or modified CDS sequence (opt3) from DENV-3__FJ639778__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggacggattaccaacatcacgaccgatagccgctgccctacacagggcgaagctgtcttgccagaggaacaggaccagaattatgtttgtaagcacacttacgtggatcgaggttgggggaacggatgcggcctcttcggcaaagggagtctggtaacctgcgccaagtttcaatgtttagagcccatagagggaaaggtggtccagtatgaaaatctgaaatacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaagaacaaagcgtggatggtgcataggcagtggtttttcgatctccccctgccttggacaagcggggccaccactgaaacaccaacgtggaatcggaaggagcttctggtaacctttaaaaacgcacacgctaagaaacaagaagttgtggtcttgggctcccaggagggagccatgcacactgctctcacaggcgccaccgaaattcagaattcagggggaacaagtatattcgcaggtcatctgaagtgtcgtttaaagatggacaaactggagctaaagggcatgagctacgccatgtgcactaacacctttgtgctcaaaaaggaggtctctgaaacgcagcacgggaccatcctgattaaagtggagtacaagggagaagatgttccctgtaagatccctttctccacagaggacggccaaggtaaagctcataacgggcgccttataactgcgaatccagtggtaaccaagaaagaggaacccgtcaacattgaggcagaaccgcctttcggcgagtcaaatatggtgatcggaatcggcgataacgccttgaagattaattggtataaaaaggggagcagtatcggaaagatgtttgaagctacagccagaggtgcaaggcggatggccattctgggcgacactgcttgggatttcgggtctgttggaggcgtgctcaactccctgggtaaaatggtccaccagatatttgggagcgcctacaccgcacttttctcgggcgtgtcttgggtaatgaagatcggaattggcgtgctgttgacgtggatcgggctcaattccaaaaacacatcaatgagttttagctgcatcgcgattggaataatcaccctgtatttaggcgctgttgtccaggccgacatgggttgtgtgattaattggaaggggaaagagctgaagtgcggatccggcatcttcgtgactaacgaggtccatacatggaccgaacagtacaagtttcaagcagattctcccaaacgactagccactgctattgccggtgcatgggagaatggcgtttgtgggatccgcagcaccacaagaatggaaaacctcctgtggaagcagatagctaatgagcttaactatatcttgtgggaaaataacattaaactgacggtggtggtaggagacatcattggcgtcctcgagcaggggaagaggaccctgactccacagcctatggagttaaaatactcatggaagacatggggaaaagccaagatcgtgaccgcggaaacacaaaacagttccttcataattgatggccccaatactccagagtgccccagcgcctctcgggcttggaacgtttgggaagtggaggactatggttttggggtcttcaccacgaatatctggctgaagcttcgcgaagtgtacacacagttgtgtgaccacagactcatgtcagcagccgttaaagatgagagggctgtgcacgccgacatgggatactggattgagagtcagaagaacggcagctggaaactggaaaaggcatccctaatcgaggtaaaaacctgcacttggcctaagtctcataccctgtggtcgaatggtgtcctcgaaagcgatatgataatcccaaagtccctggcgggcccgatttcacagcacaactatcgtcccgggtaccatacacaaactgccggaccttggcaccttggcaaattggagctggactttaattattgcgaggggaccacagtggtgatcacggaaaactgtggaacccggggcccaagtttacgaactacaaccgtctctggtaagctcattcacgagtggtgctgtagaagctgcactctgccccctcttaggtacatgggggaagatggatgttggtatggcatggagatccgcccaatatccgaaaaagaggagaatatggttaagtcactggtgagcgctggttctggcgaagtagacaacttcacaatgggggtgttgtgcctcgccattctgtttgaggaagtcatgcggggaaaattcggcaagaagcatatgatcgcaggggtgttctttaccttcgttctactgctctccggacagatcacgtggagagatatggctcacactctgattatgatcggcagtaatgccagcgacaggatgggtatgggggtgacctaccttgcattgattgccacatttaaaatacagcccttcctggctttaggatttttcctccgcaagctgacctctcgagagaaccttctgctaggcgtcggcctcgcgatggccactacactgcaattgccggaagatatcgagcagatggcaaatgggattgctctgggattaatggccctcaaactgatcacccagtttgagacatatcagctttggactgccctgatttccttgacctgttcaaacacgatcttcacactcaccgtggcttggcggactgcaaccctgatactagccggtgttagtctgcttcctgtgtgccaaagctcgtccatgcgtaagacagactggctcccaatgactgtcgcggctatgggcgtaccccctctgcccttgtttatcttctctctgaaagataccttaaagagaaggagctggccactcaatgaaggggtgatggccgttggactggtgtcaattcttgcaagttccctgttgaagaacgacgtccctatggccggccccctcgtggctggtgggctgctaatcgcatgttacgtaattacgggaacatctgccgatctgaccgtggagaaagcggctgacgtcacttgggaagaggaagccgagcagacaggcgttagccataaccttatgatcaccgtggacgatgacggcactatgcgcataaaggatgacgagacagaaaatattctcaccgtgctgttgaaaacggcattactgatcgtctccgggatctttccatactcaattccggccactctcctggtgtggcacacctggcagaagcagacacaacggagcggagttctttgggatgtacctagtcccccagagacccagaaagctgaactggaggagggtgtgtatagaataaagcagcagggcatcttcgggaaaacacaagtcggagtgggcgttcagaaggaaggtgtgtttcatactatgtggcacgtcaccaggggggccgtgttgacgtacaacggaaagcgactagagcccaattgggcatctgtaaaaaaggacctgatttcctatggcggcgggtggcgcctcagcgctcagtggcaaaaaggagaagaggtccaggtgatcgccgttgaacctggtaagaacccaaaaaatttccagacaatgcccggcactttccagaccacaaccggggagattggagcgatcgccctggattttaagcctggcacttcgggttcaccgataatcaaccgggaggggaaggtggtcggactttacggcaatggcgtggttaccaaaaacgggggatatgtgtctggtattgcacaaacaaatgctgaaccagacggccccacgcctgagttagaagaggaaatgttcaagaaaagaaacctgactatcatggatctccacccagggagtggaaagaccaggaaatacttgcccgccattgtccgtgaggctatcaagcgccggctgagaacactcatactggcacctaccagggtggtagccgccgagatggaagaggctcttaagggcctgccgattcgatatcagactacagcgaccaaatccgaacatacgggtcgggagatcgtggacttgatgtgccacgcaacttttacaatgcgcctactgagccccgttagagtcccaaattacaacctcatcattatggatgaagcccatttcaccgaccctgcttctatcgccgcaagggggtacataagcacccgggtgggaatgggcgaggccgctgcgatttttatgactgccacacccccaggcaccgcagatgctttccctcagtccaatgcccccatccaggacgaggaacgagacattccagagagatcatggaacagtgggaatgaatggatcacagattttgcaggaaagactgtgtggttcgtcccgagcataaaagccggtaacgacattgctaactgtttacgcaagaatggcaaaaaggtaatccaactgtctaggaagacgtttgataccgagtatcagaaaacaaagcttaacgactgggatttcgtggttactaccgacatctccgagatgggggccaattttaaagcggatcgtgtgattgaccctcggagatgcctgaagcccgtcatcctcacagatggaccagaaagggtgattttggcaggccccatgcctgttaccgccgcttcagccgctcagcgccgaggtagagtggggcggaacccacagaaagagaatgaccaatacatattcactggccagcccctgaacaatgatgaagaccacgcacattggacggaggccaagatgctcctggacaacatcaatacccctgaaggaattatcccggctcttttcgagccagagagggaaaagagtgccgcaatcgatggcgagtatcgcctaaaaggggaaagccgtaagacatttgtcgagctgatgagacggggagacttgcccgtgtggttagcgcacaaagtagcctccgaaggtattaagtacactgataggaaatggtgcttcgacggccagcgcaacaatcagatactggaggagaacatggatgtggaaatctggaccaaggagggggaaaaaaagaagctccgacctagatggctggacgctcggacatattctgatccccttgccctgaaagagtttaaggacttcgcagctggaaggaaatcgattgccctcgatttggttaccgaaatcggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgattctgcttacaggaggcgccatgctgtttctcatctcagggaaaggaataggtaagacctccatcggcttgatttgtgtcatcgcaagttctgggatgctgtggatggctgagattcccttacaatggatcgccagcgccatagttctagagttctttatgatggtgctgctcattccagaacctgagaagcagcgtaccccgcaggataatcaacttgcatatgtagtgatcggaattctgacattggctgccatcatagcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcatcacacccatgttgcgacataccattgagaatagtactgcaaacgtatccctggccgcgatcgctaaccaggccgtggttttaatgggcctagacaaaggatggccaattagcaagatggatctgggcgtgcctctccttgcactggggtgctattctcaggtcaatcccttgacgctgacagccgctgtgctcctgcttatcacccactacgccataattggaccgggcttacaggcaaaagctactagagaggcccaaaagaggaccgcggccggtatcatgaagaacccaacagtcgacgggatcatgactattgatctggaccctgtgatctatgattcaaaattcgaaaagcagctcggacaggttatgttgctggtgctatgtgcagtacagctgctccttatgcggacctcctgggctctgtgcgaggccttgacactggcaacgggccccataaccactctctgggaaggtagtccaggcaaattttggaatacaaccattgctgtgagcatggccaacatcttccgcgggtcgtacctggccggagcgggcttagctttttctattatgaagtccgtcgggactggaaaaagaggcacaggtagccaaggggagacccttggagaaaagtggaagaaaaagctgaatcagctctcaaggaaagagttcgacctatataagaaaagtggcatcacggaggttgatcggaccgaagcaaaggagggtctgcgaagaggcgaaataacacatcacgccgtgtctcgcgggtccgctaaattgcagtggtttgtcgagaggaacatggtgatccccgaaggacgggtaattgacctgggctgtgggcgtggaggctggagctactattgcgccggtctcaagaaggtgactgaggttagagggtacaccaaaggaggccctggccatgaggaaccggtgcccatgtcaacatacgggtggaatatcgtcaagcttatgagtggaaaagatgtgttctatctgccacctgagaagtgtgacactttgctgtgcgatattggtgaaagctccccctctcctaccgtcgaggagagcaggacaatccgcgtgctcaaaatggttgaaccatggttaaagaacaatcagttctgtattaaggtactgaacccctacatgcctaccgtgatcgagcaccttgaacggctgcaacgaaaacacggcgggatgctagtcagaaatccactctccaggaactcaactcatgagatgtattggatatctaatggaacgggcaacattgtggcaagtgttaatatggtgtcgcgcctgttgctgaaccggtttacaatgacccacagacgtcccactatcgaaaaggacgtcgatctcggtgccgggaccaggcatgtgaacgctgagccggagacacctaatatggacgtaatcggagaacggattaaacgcataaaggaggaacacaacagcacgtggcactacgacgatgagaatccatataaaacctgggcgtaccatggctcctatgaagtgaaggccactggctctgcatcaagcatgatcaacggggttgtcaagcttctgacaaaaccctgggacgtggtgcctatggtcacccagatggctatgactgatacaaccccattcggacagcaacgagtttttaaggagaaagtggacacaagaactcccaggtccatgccgggtacccggcgcgtaatgggcattacggccgagtggttatggagaaccctggggaggaataagaaacctcgattgtgcacacgggaagagttcactaagaaggtgcgtaccaacgcagccatgggagctgtctttacagaagagaatcagtgggatagtgccaaagcggcagtggaagacgaggatttctggaagctcgttgacagagagcgcgaactgcacaaactaggcaagtgtggttcttgcgtgtacaacatgatggggaaaagggagaagaaacttggagaatttggcaaggccaagggcagccgggctatctggtacatgtggctgggggccagatatctcgagttcgaggcactgggatttttgaatgaagatcattggttctcacgcgagaactcctacagtggtgtcgaaggcgaggggctgcacaaactcggatatattcttagggacatcagcaagatacccggcggtgctatgtacgccgatgacactgctgggtgggacacccgaatcacggaagatgacctgcataatgaggagaaaattacacagcagatggatccagaacaccggcaattagccaacgcaatctttaagctgacctatcagaataaagtggtaaaggttcagagacctactcccacaggaaccgtgatggacattatctctaggaaggatcagcgcggctccggccaagtcgggacttacggattgaacaccttcacaaatatggaggcgcagctcatacgtcagatggaaggtgagggcgtgctgtcaaaagccgacctagaaaacccacaccttcccgagaagaaaattacgcagtggctggagaccaagggggtggaacggctcaaaagaatggctatcagcggagatgactgcgtcgttaagcctatcgatgacaggtttgccaacgcactgttggctttaaatgatatgggcaaggtgcgcaaagacattccacaatggcagccgtcgaagggttggcatgattggcagcaggtacccttctgttctcaccatttccacgagctgataatgaaagacgggcgaaagctcgtggtcccttgccggccacaagacgaacttatcggaagagccaggattagtcagggcgcaggctggtccctgcgcgagactgcctgtctagggaaagcgtatgctcagatgtggagcctgatgtactttcacagacgggatctcaggttggcctcaaacgcaatctgctccgccgtgcccgttcattgggtgcctacatctcgtaccacttggagcattcacgctcatcaccaatggatgacaaccgaagacatgctgacggtctggaatcgagtgtggatcgaggataacccatggatggaggacaagacacccgtaaccacttgggaaaatgttccttaccttggaaagcgcgaggatcagtggtgtggtagtctgataggcctcacctccagagccacatgggcacagaacatcccgactgctattcagcaagtgcggagcttaatcgggaatgaagagttcctggactatatgccatctatgaaaaggtttcgcaaggaggaagagtcagaaggagccatttggtga

SEQ ID NO: 15512 - RNA, 9873 nt, synthetic construct
  misc_feature 1..9873: note = derived and/or modified CDS sequence (opt3) from DENV-3__FJ639779__SS-prME
  source 1..9873: mol_type = other RNA
accagcctgtgcctcatgatgatccttccagccgctctggcattccacttgacatccagggacggcgaacctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaacgtaaggctcataacggtcgccttataactgcgaatccagtggtaaccaaaaaggaggaacccgtcaacattgaggcagaaccgcctttcggggagtcaaatatcgtgatcggcattggagataacgccttgaaaatcaattggtataagaagggcagcagtattgggaaaatgtttgaagctacagccagaggagcaaggcggatggccatactgggtgacactgcttgggatttcggctctgttgggggagtgctcaactccctgggcaagatggtccaccagatctttggtagcgcctacaccgcacttttctcgggggtgtcttgggtaatgaaaattggcatcggagtgctgttgacgtggatcggcctcaattccaagaacacatcaatgagttttagctgcattgcgatagggatcattaccctgtatttaggagctgttgtccaggccgacatgggctgtgtgatcaattggaaaggtaaggagctgaagtgcgggtccggaattttcgtgactaacgaggtccatacatggaccgaacagtacaaatttcaagcagattctcccaagcgactagccactgctatcgccggcgcatgggagaatggtgtttgtggcatacgcagcaccacaagaatggaaaacctcctgtggaaacagatcgctaatgagcttaactatattttgtgggaaaataacatcaagctgacggtggtggtaggggacattatcggagtcctcgagcagggcaaaaggaccctgactccacagcctatggagttaaagtactcatggaaaacatgggggaaggccaagatagtgaccgcggaaacacaaaacagttccttcattatcgatggacccaatactccagagtgccccagcgcctctcgggcttggaacgtttgggaagtggaggactatggctttggtgtcttcaccacgaatatttggctgaaacttcgcgaagtgtacacacagttgtgtgaccacagactcatgtcagcagccgttaaggatgagagggctgtgcacgccgacatggggtactggatcgagagtcagaaaaacggaagctggaagctggaaaaagcatccctaatagaggtaaagacctgcacttggcctaagtctcataccctgtggtcgaatggcgtcctcgaaagcgatatgatcattccaaaatccctggcgggtccgatctcacagcacaactatcgtcccggctaccatacacaaactgccgggccttggcaccttggaaagttggagctggactttaattattgcgagggcaccacagtggtgattacggaaaactgtgggacccggggaccaagtttacgaactacaaccgtctctggcaaactcatccacgagtggtgctgtagaagctgcactctgccccctcttaggtacatgggtgaagatgggtgttggtatggaatggagatacgcccaatttccgaaaaggaggagaatatggttaaatcactggtgagcgctggctctggtgaagtagacaacttcacaatgggcgtgttgtgcctcgccatcctgtttgaggaagtcatgcgggggaagttcggaaagaaacatatgatcgcaggcgtgttctttaccttcgttctactgctctccgggcagattacgtggagagatatggctcacactctgatcatgattggaagtaatgccagcgacaggatgggcatgggtgtgacctaccttgcattgatagccacatttaagatccagcccttcctggctttagggtttttcctccgcaaactgacctctcgagagaaccttctgctaggagtcggcctcgcgatggccactacactgcaattgccggaagattttgagcagatggcaaatggcattgctctggggttaatggccctcaagctgatcacccagttcgagacatatcagctttggactgccctgatttccttgacctgttcaaacacgatctttacactcaccgtggcttggcggactgcaaccctgatactagccggagttagtctgcttcctgtgtgccaaagctcgtccatgcgtaaaacagactggctcccaatgactgtcgcggctatgggtgtaccccctctgcccttgttcatcttttctctgaaggataccttaaagagaaggagctggccactcaatgaaggcgtgatggccgttgggctggtgtcaattcttgcaagttccctgttgcgcaacgacgtccctatggccggacccctcgtggctggcggtctgctaatcgcatgttacgtaattacggggacatctgccgatctgaccgtggagaaagcggctgacgtcacttgggaagaggaagccgagcagacaggagttagccataaccttatgatcaccgtggacgatgacggcactatgcggataaaggatgacgagacagaaaatattctcaccgtgctgttgaaaacggcattactgatcgtctccggcatcttcccatactcaattccggccactctcctggtgtggcacacctggcagaagcagacacaaagaagcggggttctttgggatgtacctagtcccccagagacccagaaagctgaactggaggagggagtgtataggataaagcagcagggtatctttggcaaaacacaagtcggggtgggagttcagaaggaaggcgtgttccatactatgtggcacgtcacccgaggtgccgtgttgacgtacaacgggaagcgcctagagcccaattgggcatctgtcaagaaggacctgatttcctatggaggcggctggcggctcagcgctcagtggcaaaaaggggaagaggtccaggtgatcgccgttgaacctggaaagaaccccaagaatttccagacaatgcccggtacttttcagaccacaaccggcgagattggggcgatcgccctggatttcaagcctggaacttcgggctcaccgataatcaacagagagggtaaggtggtcgggctttacggaaatggcgtggttaccaaaaacggcgggtatgtgtctggaattgcacaaacaaatgctgaaccagacggtcccgcccctgagttagaagaggaaatgtttaagaaaaggaacctgacgatcatggatctccacccaggcagtgggaagactcgtaaatacttgcccgctattgtccgcgaggcaatcaagcggagactgaggaccctcatactggcccctacacgagtggtagccgctgagatggaagaggcgcttaagggactgccgattcggtatcagaccactgcaacaaaatccgaacataccggccgcgagatcgtggacttgatgtgccacgccacgttcactatgagactactgagccccgttagggtcccaaattacaacctcatcattatggatgaagctcattttacagaccctgcctctatcgcagcccggggttacataagcacccgagtggggatgggagaggctgcggccattttcatgaccgcaactcccccaggcacagctgatgcctttcctcagtccaatgcacccatccaggacgaggaaagagacattccagagcgctcatggaacagtggcaatgaatggatcaccgatttcgccgggaagacagtgtggtttgtcccgagcataaaagctggaaacgacattgccaactgtttaaggaagaatggtaaaaaggtaatccaactgtctcgtaagactttcgatacggagtatcagaaaaccaaacttaacgactgggattttgtggttacaactgacatctccgagatgggcgcgaatttcaaagcagatcgggtgattgaccctagaaggtgcctgaagcccgtcatcctcaccgatgggccagaacgcgtgattttggccggacccatgcctgttacagctgcctcagctgcacagcgaagaggccgggtgggtaggaacccacagaaagagaatgaccaatacatattcaccgggcagcccctgaacaatgatgaagaccacgcccattggactgaggctaagatgctcctggacaacatcaatacgcctgaaggcattatcccggccctttttgagccagagcgcgaaaagagtgcagcgatcgatggagagtatcgtctaaaaggcgaaagcagaaagaccttcgtcgagctgatgcggagaggggacttgcccgtgtggttagcccacaaagtagcttccgaaggaattaagtacacagatcgcaaatggtgctttgacggtcagcgaaacaatcagatactggaggagaacatggatgtggaaatctggactaaggagggcgagaagaagaagctcagacctcggtggctggacgccaggacctattctgatccccttgcactgaaagagttcaaggactttgctgccgggcgcaaatcgattgcactcgatttggttacagaaatcggaagagtcccaacccacctggcccataggactcggaatgctctagacaacctggtgatgctccacacaagcgagcatggcggtaaggcgtaccgtcacgccgtggaggaacttcctgagacgatggaaaccctgttattgctggggctcatgattctgcttactggcggagcaatgctgttcctcatctcaggcaaagggataggaaagacatccatcggtttgatttgtgtcatcgctagttctggcatgctgtggatggccgagattcccttacaatggatcgccagcgcaatagttctagagtttttcatgatggtgctgctcattccagaacctgagaagcagcgcaccccgcaggataatcaacttgcttatgtagtgatcgggattctgaccttggccgcgatcatagctgccaacgaaatgggactgctcgagacaactaaacgagacctgggcatgtccaaggaacccggtgtcgtgtcaccaacgtcttaccttgatgttgacctccaccctgcaagcgcctggaccctgtacgctgtggcaacaactgtcatcacccccatgttgagacatacaattgagaatagtaccgccaacgtatccctggcggctatcgccaaccaggcagtggttttaatggggctagacaaaggctggccaattagcaagatggatctgggagtgcctctccttgccctgggctgctattctcaggtcaatcccttgactctgacggctgccgtgctcctgcttatcacacactacgcaataattgggccgggattacaggctaaagccaccagggaggcgcaaaagcggactgccgcaggcatcatgaagaacccaaccgtcgacggtatcatgacaattgatctggaccctgtgatctatgattcaaaatttgaaaagcagctcgggcaggttatgttgctggtgctatgtgctgtacagctgctccttatgcgcacttcctgggccctgtgcgaggcattgaccctggctacaggacccataacgaccctctgggaaggcagtccaggtaaattctggaatactacaattgccgtgagcatggccaacatctttagaggctcgtacctggcgggggctggattagcattctctattatgaagtccgtcggcaccgggaaaaggggaactggcagccaaggtgagacacttggggaaaagtggaagaaaaagctgaatcagctctcacggaaagagtttgacctatataagaaaagtggaatcaccgaggttgatcgaacggaagccaaggagggcctgaaaagaggtgaaataacccatcacgctgtgtctcgcggctccgccaagttgcagtggttcgtcgagaggaacatggtgatccccgaagggcgggtaattgacctgggatgtggccgtgggggatggagctactattgcgcaggcctcaagaaagtgacagaggttagaggttacactaaagggggacctggccatgaggaaccggtgcccatgtcaacctacggctggaatatcgtcaaacttatgagtgggaaggatgtgttctatctgccacctgagaaatgtgacacattgctgtgcgatattggagaaagctccccctctcctactgtcgaggagagcaggaccatccgcgtgctcaagatggttgaaccatggttaaagaacaatcagttttgtattaaagtactgaacccctacatgcctacagtgatcgagcaccttgaacggctgcaacgaaagcacggtggcatgctagtcagaaatccactctccaggaactcaacccatgagatgtattggatatctaatgggactggaaacattgtggccagtgttaatatggtgtcgcgcctgttgctgaaccggttcacgatgacacacagacgtcccaccatcgaaaaagacgtcgatctcggcgctggtactaggcatgtgaacgcggagccggagacccctaatatggacgtaatcggggaacggattaagcgcataaaagaggaacacaacagcacatggcactacgacgatgagaatccatataagacgtgggcctaccatggatcctatgaagtgaaggcaaccggctctgcttcaagcatgatcaacggcgttgtcaaacttctgactaagccctgggacgtggtgcctatggtcacacagatggccatgaccgatactacaccatttgggcagcaacgagttttcaaagagaaggtggacaccagaacacccaggtccatgccgggaactcggcgcgtaatgggtattaccgcagagtggttatggagaacgctgggcaggaataaaaagcctcgattgtgcacccgggaagagtttacaaagaaagtgcgtactaacgccgctatgggggccgtcttcaccgaagagaatcagtgggatagtgcgaaggcagccgtggaagacgaggatttttggaaactcgttgacagagagcgcgaactgcacaagctaggaaaatgtggctcttgcgtgtacaacatgatgggtaagagggagaagaaacttggggagttcggaaaagctaaaggcagccgggccatctggtacatgtggctgggcgcaagatatctcgagtttgaggctctggggttcttgaatgaagatcattggttttcacgcgagaactcctacagtggagtcgaaggtgagggcctgcacaagctcgggtatattcttagggacatcagcaaaatacccggaggcgccatgtacgctgatgacacagccggttgggacactcgaatcaccgaagatgacctgcataatgaggagaagattacgcagcagatggatccagaacaccggcaattagcaaacgcgatcttcaaactgacatatcagaataaggtggtaaaggttcagagacctacccccactgggacagtgatggacattatctctaggaaagatcagcgcggatccggccaagtcggcacctacgggttgaacacttttaccaatatggaggcccagctcatacgtcagatggaaggagagggtgtgctgtcaaaggctgacctagaaaacccacaccttcccgagaaaaagattacacagtggctggagacgaaaggcgtggaacggctcaagagaatggccatcagcggggatgactgcgtcgttaagcctatcgatgacaggttcgcaaacgctctgttggccttaaatgatatgggaaaagtgcgcaaggacattccacaatggcagccgtcgaaaggctggcatgattggcagcaggtacccttctgttctcaccattttcacgagctgataatgaaggacggtcgaaaactcgtggtcccttgccggccacaagacgaacttatcgggagagcaaggattagtcagggagccggctggtccctgcgcgagaccgcgtgtctaggcaaggcttatgcccagatgtggagcctgatgtacttccacagacgggatctcaggttggcatcaaacgccatctgctccgctgtgcccgttcattgggtgcctacttctcgtacaacctggagcattcacgcccatcaccaatggatgactacagaagacatgctgaccgtctggaatcgagtgtggatcgaggataacccatggatggaggacaagacgcccgtaacaacctgggaaaatgttccttaccttgggaaacgcgaggatcagtggtgtggaagtctgataggtctcacttccagagcaacctgggctcagaacatcccgacagccattcagcaagtgcggagcttaatcggcaatgaagagtttctggactatatgccagcgatgaagaggttccgcaaagaggaagagtctgaaggggctatttggtga

SEQ ID NO: 15513 - RNA, 9873 nt, synthetic construct
  misc_feature 1..9873: note = derived and/or modified CDS sequence (opt3) from DENV-3__FJ639780__SS-prME
  source 1..9873: mol_type = other RNA
accagcctgtgcctcatgatgatccttcccgcagctctggcattccacttgacctccagggacggcgagcctaggatgattgtggggaagaacgagcggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaaggacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcgggaccactacagaaacgccaacctggaataggaaagagcttctggtaacttttaagaacgcccacgccaagaagcaagaagttgtggtcttgggctcccaggagggagctatgcacacagccctcaccggcgctacagaaattcaaaattcagggggaacaagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgttccctgtaaaatccctttctccactgaggacggccaaggtaaggcccataacgggcgtcttataaccgctaatccagtggtaactaagaaggaggaacccgtcaacattgaggcggaaccgcctttcggcgagtcaaatatcgtgatcggaattggcgataacgcattgaaaatcaattggtataagaaggggagcagtattggaaaaatgtttgaagccactgctcgcggtgccagaaggatggcaatactgggcgacaccgcctgggatttcgggtctgttggaggcgtgctcaactccctgggtaagatggtccaccagatctttgggagcgcttacacggcccttttctcgggcgtgtcttgggtaatgaaaattggaatcggcgtgctgttgacatggatcgggctcaattccaagaacacctcaatgagttttagctgcattgcaataggaatcattactctgtatttaggcgcggttgtccaggctgacatgggttgtgtgatcaattggaaagggaaggagctgaagtgcggatccggcattttcgtgacaaacgaggtccatacctggactgaacagtacaaatttcaagccgattctcccaagcggctagcaaccgccatcgctggtgcctgggagaatggcgtttgtgggatacgaagcacaacgcgcatggaaaacctcctgtggaaacagatcgcaaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggctaagatagtgacagccgaaactcaaaacagttccttcattatcgatggccccaataccccagagtgccccaacgcgagcagggcctggaatgtttgggaagtggaggactatggttttggggtcttcacgacaaacatttggctgaaacttcgggaagtgtacacccagttgtgtgaccaccgcctcatgtctgctgcagttaaggatgagagagccgtgcacgctgacatgggatactggatcgagtcacagaaaaatggcagttggaagctggaaaaagccagcctaatagaggtaaagacttgcacctggcctaagtcccatacactgtggtctaacggtgtcctcgaatcggatatgatcattccaaaaagcctggcaggcccgatctcccagcacaattataggcccgggtaccatactcaaaccgcgggaccttggcaccttggcaagttggagctggactttaactattgcgaggggacaacggtggtgattaccgaaaattgtggaactcgtggcccatcattacggacaaccactgtcagtggtaaactcatccacgagtggtgctgtcgatcttgcacactgccccctcttagatacatgggggaagatggatgttggtatggcatggagataaggccaattagcgaaaaggaggagaacatggttaaatccctggtgtcagccggtagcggcgaagtagacaatttcaccatgggggtgttgtgcctcgctatcctgtttgaggaagtcatgcgcggaaagttcggcaagaaacatatgatcgccggggtgttctttacgttcgttctactgctctctggacagattacttggcgggatatggcacacaccctgatcatgattggctccaacgctagtgacagaatgggtatgggggtgacataccttgccttgatagcaacctttaagatccagcccttcctggccttaggatttttcctcaggaaactgactagccgcgagaatcttctgctaggcgtcggcctcgctatggcgacaaccctgcaattgccggaagatattgagcagatggccaacgggatcgcactgggattaatggctctcaagctgattacacagtttgagacttatcagctttggaccgccctgatctctttgacgtgttccaatacaatattcaccctcactgtggcctggcgaaccgctacactgatcctagccggtgtttcactgcttcctgtgtgccaaagtagctcgatgcggaaaactgactggctcccaatgaccgtcgccgcgatgggcattccccctctgcccttgtttatcttctccctgaaggatacgttaaagcgtagatcttggccactcaacgaaggggtaatggctgtgggactggttagcattcttgcctcaagtctgttgaggaacgacgtgcctatggcaggccccctcgtcgccggtgggctgctaatcgcttgttacgtgataacaggaacctccgcagatctgactgtagagaaagccgcggacgtgacatgggaagaggaagctgagcagaccggcgtctctcataatcttatgattactgttgacgatgacggcacaatgcgcatcaaggatgacgagaccgaaaacatcctcacggtgctgttgaaaactgccttactgattgtgagcgggatatttccatactccatcccggcaaccctcctggtctggcacacatggcagaagcagacccaacggtcaggagtgctttgggatgttcctagcccaccagagacacagaaagccgaactggaggagggtgtatatagaattaagcagcagggcatcttcgggaaaactcaagtgggagtcggcgtgcagaaggaaggtgtttttcataccatgtggcacgtgacgagaggggctgtcttgacatacaatggaaagcgactagagcccaactgggccagtgtgaaaaaggacctgatttcttatggcggcgggtggcgcctctccgcacagtggcaaaaaggagaagaggtacaggtcatcgctgtggaacctggtaagaatcccaagaatttccagactatgcccggcaccttccagacaaccactggggagataggagccatcgcgctggattttaagcctggcaccagcggttcgccgattatcaatcgggaggggaaggttgtgggactttacggcaacggcgtcgtgaccaaaaatgggggatatgtttcaggtattgcccaaacgaacgcagaaccagacggccccactcctgagttagaagaggaaatgttcaagaaaagaaatctgaccatcatggatctccacccagggtctggaaagacaaggaaatacttgcccgctatagtgcgtgaggccattaagcgccggctgagaaccctcatcctggctcctactagggtcgtggcagccgagatggaagaggcccttaagggcctgccgatccgatatcagacaaccgctacgaaaagtgaacatactggtcgggagattgtagacttgatgtgccacgcgacatttaccatgcgcctactgtcccccgtgagagttccaaactacaatctcatcataatggatgaagcacatttcaccgaccctgccagcattgctgccagggggtacatctctactcgggtcggaatgggcgaggcagccgctatttttatgacagcgacacccccaggcacagccgatgcattccctcagagcaacgctcccatccaggacgaggaacgagacataccagagagatcctggaactcagggaacgaatggattactgattttgccggaaagacggtgtggttcgtgccgagtatcaaagcaggtaacgacatcgccaattgtttacgcaagaacggcaaaaaggtcattcaactgagcaggaagacctttgatacagagtatcagaaaactaaacttaatgactgggatttcgtagtgaccacagacatctctgagatgggggctaactttaaagccgatcgtgttattgaccctcggagatgcctgaagcccgtgatactcaccgatggaccagaaagggtcatcttggcgggccccatgcctgtgactgcagcctccgctgcccagcgccgaggtagagttgggcggaatccacagaaagagaacgaccaatacattttcacgggccagcccctgaataacgatgaagaccacgctcattggaccgaggcaaagatgctcctggacaatatcaacacacctgaaggaatcattccggcccttttcgagccagagagggaaaagtcagctgccatagatggcgagtatcgcctaaaaggggaaagtcgtaagacttttgtggagctgatgagacggggagacttgcccgtctggttagcacacaaagtggcgagcgaaggtatcaagtacaccgataggaaatggtgcttcgacggccagcgcaataaccagattctggaggagaatatggatgtagaaatctggacaaaggagggggaacggaaaaagctcagacctagatggctggacgccaggacctattccgatccccttgctctgaaggagtttaaagacttcgccgcaggacgcaagtctattgctctcgatttggtgactgaaatcggcagagttccaacacacctggcccataggacgcggaacgcactagacaatctggtcatgctccacacctcggagcatggtgggaaagcctaccgtcacgctgtggaggaacttcctgagactatggaaacactgttattgctgggcctcatgatactgcttaccggaggcgcgatgctgtttctcatcagcgggaagggaattggtaaaacctcaatcggcttgatttgtgtgatcgcctccagtgggatgctgtggatggcagagatacccttacaatggattgcttctgccatcgtcctagagttctttatgatggttctgctcattccagaacctgagaagcagcgcacaccgcaggataaccaacttgcctatgtggtaatcggaatactgactttggcagctatcattgccgcgaatgaaatgggcctgctcgagacgaccaagcgagacctgggtatgagcaaagaacccggggtggtctccccaacatcataccttgatgtggacctccaccctgcttctgcctggactctgtacgcagttgccaccacagtgatcacccccatgttgagacatactattgagaacagcacggctaacgtcagtctggcagccatcgcgaatcaggctgtagtgttaatgggcctagacaagggatggccaatatccaaaatggatctgggcgttcctctccttgccctggggtgctatagccaggtgaaccccttgacactgaccgcagccgtcctcctgcttattactcactacgctatcatcggaccgggcttacaggccaaggcaaccagggaggctcaaaaacggacagccgcgggtattatgaagaatccaactgtggacgggatcatgaccatagatctggaccctgtcatttatgattctaagttcgaaaaacagctcggacaggtgatgttgctggttctatgtgccgtgcagctgctccttatgcgcacatcatgggcactgtgcgaggctttgacgctggccaccggccccatcactacactctgggaaggttccccaggcaagttttggaacaccactattgcagtaagtatggctaatatcttcagagggagctacctggccggagccggcttagcgttttcgataatgaaatctgtggggacaggaaagaggggcaccggttcccaaggggagacgcttggagaaaaatggaagaagaaactgaaccagctcagccggaaggagttcgacctatataaaaagtcaggcatcaccgaggtcgatcgaacagaagctaaagagggtctgaagagaggcgaaattactcatcacgcagttagtcgcgggtctgccaaattgcagtggtttgtggagaggaatatggtcatccccgaaggacgggtgattgacctgggctgtgggcgtggaggctggtcctactattgcgctggtctcaagaaggtaaccgaggtgagagggtacacaaaaggaggccctggccatgaggaaccggttcccatgagcacttacgggtggaacatcgtgaaacttatgtcaggaaaagatgtcttctatctgccacctgagaagtgtgacaccttgctgtgcgatattggtgaaagtagcccctcccctacagtggaggagtctaggaccatccgcgtcctcaaaatggtggaaccatggttaaagaataaccagttctgtataaaggttctgaatccctacatgcctgccgtaattgagcaccttgaacggctgcaacgaaaacacggcgggatgctagtgagaaacccactcagcagaaattccactcatgagatgtattggatctcaaacggaacgggcaatatcgtcgcatctgtgaacatggttagtcgcctgttgctgaaccggtttacaatgacccacagacgtcccactattgaaaaggacgtggatctcggtgccgggaccaggcatgtcaatgctgagccggagacacctaacatggacgtgataggagaacggatcaaacgcattaaggaggaacacaattcgacgtggcactacgacgatgagaacccatataaaacctgggcgtaccatggcagctatgaagtaaaggccactggctccgcatcttcaatgatcaatggggtggttaaacttctgacaaaaccctgggacgtcgtgcctatggtgacccagatggctatgactgatacaaccccattcggacagcaacgagtctttaaggagaaagttgacacaagaactcccaggagcatgccgggtacccggcgcgtgatgggcattacggccgagtggttatggagaaccctggggaggaacaagaaacctcgattgtgcacacgggaagagttcactaagaaggtacgtaccaatgcagccatgggagctgtgtttacagaagagaaccagtgggattccgccaaagcggcagtcgaagacgaggatttctggaagctcgtggacagagagcgcgaactgcacaaactaggcaagtgtggtagttgcgtttacaatatgatggggaaaagggagaagaaacttggagaatttggcaaggccaagggctctcgggctatctggtacatgtggctgggggccagatatctcgagttcgaggcactgggatttttgaacgaagatcattggttcagccgcgaaaattcatactccggtgtggaaggcgaggggctgcacaaactcggatatatacttagggacatcagtaagattcccggcggtgctatgtacgccgatgacactgctgggtgggacacccgaatcacggaagatgacctgcataacgaggagaaaattacacagcagatggatccagaacaccggcaattagccaatgcaatctttaagctgacctatcagaacaaagtcgtgaaggtacagagacctactcccacaggaaccgttatggacataattagcaggaaggatcagcgcggctctggccaagtggggacttacggattgaataccttcacaaacatggaggcgcagctcatccgtcagatggaaggtgagggcgtcctgtccaaagccgacctagaaaacccacaccttcccgagaagaaaatcacgcagtggctggagaccaagggggtggaacggctcaaaagaatggctatttcaggagatgactgcgtggtcaagcctatagatgacaggtttgccaatgcactgttggctttaaacgatatgggcaaggttcgcaaagacatcccacaatggcagccgagcaagggttggcatgattggcaacaggtgcccttctgttcgcaccatttccacgagctgattatgaaagacgggcgaaagctcgtagtgccttgccggccacaagacgaacttatcggacgagcaaggatttctcagggcgcaggctggagtctgcgcgagactgcctgtctagggaaagcgtatgctcagatgtggtccctgatgtactttcacagacgggatctcaggttggccagcaatgcaatctgctcagccgtccccgtgcattgggttcctacatcccgtaccacttggtctatacacgctcatcaccaatggatgacaaccgaagacatgctgacggtgtggaaccgagtctggatcgaggataatccatggatggaggacaagacacccgtgaccacttgggaaaacgtaccttaccttggaaagcgcgaggatcagtggtgtggtagcctgattggcctcaccagtagagccacatgggcacagaatatcccgactgctattcagcaagttcggtccttaatcgggaacgaagagttcctggactatatgccaagcatgaaaaggtttcgcaaggaggaagagtctgaaggagccatttggtga

SEQ ID NO: 15514 - RNA, 9873 nt, synthetic construct
  misc_feature 1..9873: note = derived and/or modified CDS sequence (opt3) from DENV-3__FJ639781__SS-prME
  source 1..9873: mol_type = other RNA
accagcctgtgcctcatgatgatccttcccgcagctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcagtacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcatggcgggtgcgtgacgactatggcgaagaataaacccacactagacattgagctccaaaagaccgaagcaactcagctggccacacttaggaaactgtgtatcgagggaaagattaccaacatcacgaccgatagccggtgccctacacagggcgaagctgtcttgccagaggaacaggaccaaaattatgtttgtaaacacacttacgtggatcgcggttgggggaacggatgcggcctcttcggcaaggggagtctggtaacctgcgccaagtttcagtgtttagagcccatagagggaaaagtggtccagtatgaaaatctgaagtacacagtgattatcactgttcacaccggtgaccagcatcaagtgggcaacgagacacagggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcacagacaatggtttttcgatctccccctgccttggacaagcggggccaccactgaaacaccaacgtggaataggaaagagcttctggtaacctttaagaacgcacatgctaaaaagcaggaagttgtggtcttgggctcccaggagggagccatgcacactgctctcacaggcgccaccgaaattcaaaattcagggggaacaagtatattcgcaggtcacctgaagtgtcggttaaaaatggacaagctggagctaaaaggcatgagctacgccatgtgcactaacacctttgtgctcaagaaagaggtctctgaaacgcaacatgggaccatcctgattaaggtggagtacaagggagaagatgttccctgtaaaatccctttctccacagaggacggccagggtaaggctcacaacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccatcagatctttgggagcgcctacaccgcacttttctcgggcgtgtcttgggtaatgaaaattggaatcggcgtgctgttgacgtggatcgggctcaattccaagaacatttcaatgagttttagctgcatagcgatcggaattatcacactgtatttaggcgctgttgtccaggccgacatgggttgtgtgattaattggaaagggaaggagctgaagtgcggatccggcatcttcgtgaccaacgaggtccacacttggacagaacaatacaaatttcaggcagattctcccaagcggctagccaccgctatagccggtgcatgggagaatggcgtttgtgggatccgaagcactacccgcatggaaaacctcctgtggaaacagattgctaatgagcttaactatatcttgtgggaaaataacattaagctgacagtggtggtaggagacacgatcggcgtcctcgagcaggggaaaagaaccctgactccacaacctatggagttaaagtactcatggaaaacatggggaaaggccaagatagtgaccgcggaaacacagaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccatcgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcacaccctgtggtcgaatggtgtcctcgaaagcgatatgatcattccaaaatccctggcgggcccgatctcacaacataactataggcccgggtaccacacacagactgccggaccttggcatcttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacacatgatcgcaggggtgttctttaccttcgctctactgctctccggacagattacgtggcgggatatggcccatactctgatcatgattggcagtaatgcaagcgacagaatgggtatgggggttacctaccttgccttgatagctacatttaagatccaacccttcctggcgttaggatttttcctcaggaaactgacctctcgcgagaaccttctgctaggcgtgggcctcgccatggcaactacactgcagttgccggaagatattgagcagatggctaatgggatcgccctgggattaatggccctcaagctgattacccagtttgagacatatcaactttggactgctctgatctccttgacctgttcaaacacgatattcacactcaccgtcgcatggcgaactgccaccctgatcctagcgggtgtgagtctgcttcctgtttgccagagctcgtccatgcggaaaacagactggctcccaatgactgtggctgccatgggcgtcccacctctgcccttgtttattttctctctgaaggataccttaaagcgtagaagctggccactcaatgaaggggtaatggcagtgggactggtttcaatccttgccagttccctgttgaggaacgacgtgcctatggctggccccctcgtcgccggtgggctgctaattgcctgttacgtgatcacgggaacatctgcggatctgaccgtagagaaagctgccgacgtgacttgggaagaggaagcagagcagacaggcgtcagccacaaccttatgataaccgttgacgatgacggcactatgcgcattaaggatgacgagacagaaaatatcctcaccgtgctgttgaaaacggccttactgatcgtgtccgggatttttccatactcaataccggctactctcctggtctggcatacctggcagaagcaaacacagcggagcggagtgctttgggatgttcctagtcccccagagacccagaaagccgaactggaggagggtgtatatagaatcaagcagcaaggcattttcgggaaaacacaggtgggagtcggcgtgcagaaggaaggtgtttttcacactatgtggcatgtgaccagaggggcagtcttgacgtacaacggaaagcgactagagcccaattgggcttctgtgaaaaaggacctgatctcctatggcggcgggtggcgcctcagcgcccaatggcagaaaggagaagaggtacaggtcattgcggtggaacctggtaagaaccccaagaatttccagacaatgcccggcactttccaaaccacaaccggggagatcggagccatagcactggattttaagcctggcacttcgggttcaccgatcattaaccgggaggggaaggttgtgggactttacggcaatggcgtcgtgaccaaaaacgggggatatgtttctggtatcgctcagacaaatgccgaaccagacggccccacgcctgagttagaagaggaaatgttcaagaaaagaaacctgactattatggatctccacccagggagtggaaagaccaggaaatacttgcccgctatcgtgcgtgaggcaataaagcgccggctgagaacactcattctggcccctaccagggtcgtggccgctgagatggaagaggcgcttaagggcctgccgatccgatatcagactacagcaaccaaatccgaacacacgggtcgggagatcgtagacttgatgtgccatgccacttttacaatgcgcctactgagccccgtgagagttccaaattacaacctcattatcatggatgaagctcacttcaccgaccctgcctctatagcagccagggggtacattagcacccgggtcggaatgggcgaggctgcggccatctttatgactgcaacacccccaggcaccgctgatgccttccctcagtccaatgcacccattcaagacgaggaacgagacatcccagagagatcatggaacagtgggaatgaatggataacagattttgccggaaagactgtgtggttcgtgccgagcattaaagctggtaacgacatcgccaactgtttacgcaagaatggcaaaaaggtcatccagctgtctaggaagacgtttgataccgagtatcagaaaacaaaacttaacgactgggatttcgtagtgactaccgacatttccgagatgggggcgaattttaaagcagatcgtgttatcgaccctcggagatgcctgaagcccgtgattctcacagatggaccagaaagggtcatattggccggccccatgcctgtgaccgctgcctcagctgcacagcgccgaggtagagttgggcggaacccacaaaaagagaatgaccagtacatcttcactggccagcccctgaacaatgatgaagaccatgcccactggacggaggctaagatgctcctggacaacattaatacccctgaaggaatcatcccggcccttttcgagccagagagggaaaagagtgcagcgattgatggcgagtatcgcctaaaaggggaaagccgtaagacatttgtggagctgatgagacggggagacttgcccgtctggttagcccataaagtggcttccgaaggtataaagtacactgataggaaatggtgcttcgacggccagcgcaacaatcaaatcctggaggagaacatggatgtagaaatttggaccaaggagggggagaagaagaagctccgacctagatggctggacgcccggacatattctgatccccttgcactgaaagagtttaaggacttcgctgccggaaggaaatcgatcgcactcgatttggtgaccgaaattggccgcgttccaactcacctggcccacagaacaaggaatgctctagacaacctggtcatgctccatacgagcgagcacggtgggaaggcgtaccggcatgccgtggaggaacttcctgagaccatggaaactctgttattgctgggcctcatgatcctgcttacaggaggcgcaatgctgtttctcatatcagggaaaggaatcggtaagacctccattggcttgatctgtgtgattgctagttctgggatgctgtggatggccgagatccccttacagtggatagccagcgcaattgtcctagagttctttatgatggttctgctcatcccagaacctgagaagcagcgtaccccgcaagataatcagcttgcttatgtggtaattggaatcctgacattggccgcgactatagctgccaacgaaatgggcctgctcgagacgaccaaacgcgacctgggtatgtccaaggaacccggggtggtctcaccaacatcttaccttgatgtggacctccaccctgcaagcgcctggactctgtacgctgttgcaaccacagtgatcacccccatgttgcgacacactattgagaatagtacggccaacgtctccctggcggctatcgccaaccaggcagtagtgttaatgggcctagacaaaggatggccaattagcaagatggatctgggcgttcctctccttgccctggggtgctattctcaggtgaatcccttgacactgaccgctgccgtcctcctgcttatcactcattacgcaataattggaccgggcttacaagctaaagccaccagagaggcgcagaagaggacagccgcaggtatcatgaagaacccaactgtggacgggatcatgaccattgatctggaccctgtcatctatgattcaaaattcgaaaagcagctcggacaggtgatgttgctggttctatgtgctgtgcaactgctccttatgcggacatcctgggccctgtgcgaggcattgacgctggctaccggccccataactacactctgggaaggtagtccaggcaaattttggaataccactattgccgtaagcatggccaacatcttccgcgggtcgtacctggcgggagctggcttagcattttctattatgaagtccgtggggacaggaaaaagaggcaccggtagccagggggagacgcttggagaaaagtggaagaaaaagctgaatcagctctcaaggaaagagttcgacctatataagaaaagtggcatcaccgaggtcgatcggacagaagccaaggagggtctgaaacgaggcgaaataactcaccatgctgtttctagagggtccgccaagttgcagtggtttgtggagcgcaacatggtcatccccgaaggaagggtgattgacctgggctgtgggcggggaggctggagctactattgcgcaggtctcaagaaagtaaccgaggtgcgtgggtacacaaagggaggccctggccacgaggaaccggttcccatgtcaacttacgggtggaatatcgtgaaacttatgagtggaaaggatgtcttctatctgccacctgagaaatgtgacaccttgctgtgcgatattggtgaaagctccccctctcctacagtggaggagagcagaaccatcagggtcctcaagatggtggaaccatggttaaagaacaatcaattctgtattaaagttctgaacccctacatgcctactgtaatcgagcatcttgaacgcctgcagcggaagcacggcgggatgctagtgcgaaatccactctccagaaactcaacgcacgagatgtattggatatctaatggaacaggcaacattgtcgccagtgtgaatatggtttcgaggctgttgctgaaccgctttaccatgactcatcggagacccaccatcgaaaaagacgtggatctcggtgctgggacacgtcacgtcaacgcggagccggagacgcctaatatggacgtgatcggagaaaggattaagcggataaaagaggaacataacagcacctggcactacgacgatgagaatccatataagacttgggcctaccacggctcctatgaagtaaaggcaacaggctctgcttcaagcatgatcaacggggtggttaaacttctgaccaagccctgggacgtcgtgcctatggtgactcagatggccatgacagataccacaccattcggacaacagcgcgtctttaaagagaaggttgacactcgaacccccagatccatgccgggtacgaggcgggtgatgggcattaccgcagagtggttatggcgcacactggggagaaataaaaagcctaggttgtgcactcgagaagagttcaccaagaaagtacggacaaacgccgctatgggagccgtgtttactgaagagaatcagtgggatagtgcgaaggcagccgtcgaagacgaggatttctggaaactcgtggaccgtgagagagaactgcataagctaggcaaatgtggttcttgcgtttacaacatgatggggaagcgcgagaagaaacttggagaatttggcaaagctaaaggcagcagggccatctggtacatgtggctgggggcacggtatctcgagttcgaggctctgggatttttgaatgaagatcactggttctcaagagagaactcctacagtggtgtggaaggcgaggggctgcataagctcggatatattcttcgcgacatcagcaaaatacccggcggtgccatgtacgctgatgacaccgccgggtgggacacgaggatcacagaagatgacctgcacaatgaggagaagattacccagcaaatggatccagaacatcgacagttagcaaacgcgatctttaaactgacttatcagaataaggtcgtgaaggtacagcggcctacacccaccggaactgttatggacattatctctagaaaagatcaaaggggctccggccaggtggggacctacggattgaacacattcacgaatatggaggcccagctcatacgccagatggaaggtgagggcgtcctgtcaaaggctgacctagaaaacccacaccttcccgagaaaaagattacccaatggctggagactaaaggggtggaacgtctcaagcggatggccatcagcggagatgactgcgtggtcaagcctatcgatgacagatttgcaaacgctctgttggccttaaatgatatgggcaaagttaggaaggacattccacagtggcagccgtcgaaaggttggcacgattggcagcaagtgcccttctgttctcatcacttccatgagctgataatgaaggacgggcgcaaactcgtagtgccttgccgaccacaggacgaacttatcggacgggcaagaattagtcagggcgccggctggtccctgagggagacagcgtgtctagggaaggcttatgcccaaatgtggagcctgatgtactttcaccgcagagatctccggttggcatcaaacgccatctgctccgctgtccccgtgcactgggttcctacctctaggactacatggagcattcatgcccaccatcagtggatgaccacggaagacatgctgacagtgtggaatcgtgtctggatcgaggataacccatggatggaggacaagacccccgtgactacctgggaaaatgtaccttaccttggaaaacgagaggatcagtggtgtggtagtctgataggcctcacatcccgcgcaacttgggctcagaacatcccgaccgccattcaacaggttaggagcttaatcgggaatgaagagttcctggactatatgccatctatgaagcggtttaggaaagaggaagagtcagaaggagcgatttggtga

SEQ ID NO: 15515 - RNA, 9873 nt, synthetic construct
  misc_feature 1..9873: note = derived and/or modified CDS sequence (opt3) from DENV-3__FJ639782__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaagatcgtgggactttacggcaatggcgtcgtgaccaaaaacgggggatatgtttctggtattgcacaaacaaatgctgaaccagacggccccacgcctgagttagaagaggaaatgttcaagaaaagaaacctgactatcatggatctccacccagggagtggaaagaccaggaaatacttgcccgccatagtgcgtgaggctattaagcgccggctgagaacactcatcctggcacctaccagggtcgtggccgccgagatggaagaggctcttaagggcctgccgatccgatatcagactacagcgaccaaatccgaacatacgggtcgggagattgtagacttgatgtgccacgcaacttttacaatgcgcctactgagccccgtgagagttccaaattacaacctcatcataatggatgaagcccatttcaccgaccctgcttctattgccgcaagggggtacatcagcacccgggtcggaatgggcgaggccgctgcgatttttatgactgccacacccccaggcaccgcagatgctttccctcagtccaatgcccccatccaggacgaggaacgagacataccagagagatcatggaacagtgggaatgaatggattacagattttgcaggaaagactgtgtggttcgtgccgagcatcaaagccggtaacgacatcgctaactgtttacgcaagaatggcaaaaaggtcattcaactgtctaggaagacgtttgataccgagtatcagaaaacaaaacttaacgactgggatttcgtagtgactaccgacatctccgagatgggggccaattttaaagcggatcgtgttattgaccctcggagatgcctgaagcccgtgatactcacagatggaccagaaagggtcatcttggcaggccccatgcctgtgaccgccgcttcagccgctcagcgccgaggtagagttgggcggaacccacagaaagagaatgaccaatacattttcactggccagcccctgaacaatgatgaagaccacgcacattggacggaggccaagatgctcctggacaacatcaatacccctgaaggaatcattccggctcttttcgagccagagagggaaaagagtgccgcaatagatggcgagtatcgcctaaaaggggaaagccgtaagacatttgtggagctgatgagacggggagacttgcccgtctggttagcgcacaaagtggcctccgaaggtatcaagtacactgataggaaatggtgcttcgacggccagcgcaacaatcagattctggaggagaacatggatgtagaaatctggaccaaggagggggagaaaaagaagctccgacctagatggctggacgctcggacatattctgatccccttgccctgaaagagtttaaggacttcgcagctggaaggaaatcgattgccctcgatttggtgaccgaaatcggccgcgttccaactcacctggcacatagaacaaggaatgccctagacaacctggtcatgctccacacgagcgagcatggtgggaaggcttaccggcacgcggtggaggaacttcctgagaccatggaaactctgttattgctgggcctcatgatactgcttacaggaggcgccatgctgtttctcatctcagggaaaggaattggtaagacctccatcggcttgatttgtgtgatcgcaagttctgggatgctgtggatggctgagatacccttacaatggattgccagcgccatcgtcctagagttctttatgatggttctgctcattccagaacctgagaagcagcgtaccccgcaggataatcaacttgcatatgtggtaatcggaatactgacattggctgccactatcgcggctaacgaaatgggcctgctcgagacgaccaaacgcgacctgggtatgtccaaggaacccggggtggtctcaccaacatcttaccttgatgtggacctccaccctgccagcgcatggactctgtacgccgttgctaccacagtgattacccccatgttgcgacatactatcgagaatagtacggcaaacgtctccctggccgcgattgctaaccaggccgtagtgttaatgggcctagacaaaggatggccaatcagcaagatggatctgggcgttcctctccttgcactggggtgctattctcaggtgaatcccttgacactgaccgccgctgtcctcctgcttataactcactacgccattatcggaccgggcttacaggcaaaagctaccagagaggcccaaaagaggacagcggccggtatcatgaagaacccaactgtggacgggattatgaccatcgatctggaccctgtcatatatgattcaaaattcgaaaagcagctcggacaggtgatgttgctggttctatgtgcagtgcagctgctccttatgcggacatcctgggctctgtgcgaggccttgacgctggcaaccggccccattactacactctgggaaggtagtccaggcaaattttggaataccactatcgctgtaagcatggccaacattttccgcgggtcgtacctggccggagcgggcttagctttttctatcatgaagtccgtggggacaggaaaaagaggcaccggtagccaaggggagacgcttggagaaaagtggaagaaaaagctgaatcagctctcaaggaaagagttcgacctatataagaaaagtggcataaccgaggtcgatcggacagaagcaaaggagggtctgaaacgaggcgaaatcactcatcacgccgtttctagagggtccgctaagttgcagtggtttgtggagcgcaacatggtcattcccgaaggaagggtgatcgacctgggctgtgggcggggaggctggagctactattgcgccggtctcaagaaagtaaccgaggtgcgtgggtacacaaagggaggccctggccatgaggaaccggttcccatgtcaacttacgggtggaatattgtgaaacttatgagtggaaaggatgtcttctatctgccacctgagaaatgtgacaccttgctgtgcgatatcggtgaaagctccccctctcctacagtggaggagagcagaaccattagggtcctcaagatggtggaaccatggttaaagaacaatcagttctgtatcaaagttctgaacccctacatgcctactgtaatagagcaccttgaacgcctgcaacggaagcacggcgggatgctagtgcgaaatccactctccagaaactcaacgcatgagatgtattggatttctaatggaacaggcaacatcgtcgcaagtgtgaatatggtttcgaggctgttgctgaaccgctttaccatgacttaccggagacccaccatcgaaaaagacgtggatctcggtgccgggacacgtcacgtcaacgctgagccggagacgcctaatatggacgtgattggagaaaggataaagcggatcaaagaggaacataacagcacctggcactatgacgatgagaatccatacaagacttgggcgtatcacggctcctacgaagtaaaggccacaggctctgcatcaagcatgattaacggggtggttaaacttctgaccaagccctgggacgtcgtgcctatggtgactcagatggctatgacagataccacaccattcggacagcaacgcgtctttaaagagaaggttgacactcgaacccccagatccatgccgggtacgaggcgggtgatgggcatcaccgccgagtggttatggcgcacactggggagaaataaaaagcctaggttgtgcactcgagaagagttcaccaagaaagtacggacaaacgcagccatgggagctgtgtttactgaagagaatcagtgggatagtgccaaggcggcagtcgaagacgaggatttctggaaactcgtggaccgtgagagagaactgcataagctaggcaaatgtggttcttgcgtttacaacatgatggggaagcgcgagaagaaacttggagaatttggcaaagccaaaggcagcagggctatttggtatatgtggctgggggcccggtacctcgagttcgaggcactgggatttttgaatgaagatcactggttctcaagagagaactcctatagtggtgtggaaggcgaggggctgcataagctcggatacatccttcgcgacataagcaaaatccccggcggtgctatgtatgccgatgacaccgctgggtgggacacgaggattacagaagatgacctgcacaatgaggagaagatcacccagcagatggatccagaacatcgacaattagccaacgcaatttttaaactgacttaccagaataaggtcgtgaaggtacagcggcctacacccaccggaactgttatggacatcatatctagaaaagatcagaggggctccggccaagtggggacctatggattgaacacattcacgaatatggaggcgcagctcattcgccagatggaaggtgagggcgtcctgtcaaaggccgacctagaaaacccacaccttcccgagaaaaagatcacccagtggctggagactaaaggggtggaacgtctcaagcggatggctatcagcggagatgactgcgtggtcaagcctattgatgacagatttgccaacgcactgttggctttaaatgatatgggcaaagttaggaaggacataccacaatggcagccgtcgaaaggttggcacgattggcaacaggtgcccttctgttctcatcacttccatgagctgatcatgaaggacgggcgcaaactcgtagtgccttgccgaccacaagacgaacttattggacgggccagaatcagtcagggcgcaggctggtccctgagggagacagcctgtctagggaaggcgtacgctcagatgtggagcctgatgtactttcaccgcagagatctccggttggcctcaaacgcaatttgctccgccgtccccgtgcactgggttcctacctctaggactacatggagcatccatgctcaccatcaatggatgaccacggaagacatgctgacagtgtggaatcgtgtctggatagaggataacccatggatggaggacaagacccccgtgactacctgggaaaatgtaccttatcttggaaaacgagaggatcagtggtgtggtagtctgatcggcctcacatcccgcgccacttgggcacagaacattccgaccgctatccagcaagttaggagcttaattgggaatgaagagttcctggactacatgccatctatgaagcggtttaggaaagaggaagagtcagaaggagccatctggtga

SEQ ID NO: 15516 - RNA, 9873 nt, synthetic construct
  misc_feature 1..9873: note = derived and/or modified CDS sequence (opt3) from DENV-3__FJ639785__SS-prME
  source 1..9873: mol_type = other RNA
accagcctgtgcctcatgatgatccttcccgccgctctggcattccacttgacctccagagacggagagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaagatacagcccttcctggctttaggatttttcctcaggaaactgacttctcgcgagaaccttctgctaggcgtcggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaaaactgactggctcccaatgaccgtcgcggctatgggcgtaccccctctgcccttgtttatcttctctctgaaggatacgttaaagcgtagaagctggccactcaatgaaggggtgatggccgttggactggtgtcaattcttgcaagttccctgttgaggaacgacgtccctatggccggccccctcgtggctggtgggctgctaatcgcatgttacgtaattacaggaacctctgccgatctgactgtggagaaagcggctgacgtcacatgggaagaggaagccgagcagaccggcgttagccataaccttatgatcactgtggacgatgacggcacaatgcgcataaaggatgacgagaccgaaaatattctcacggtgctgttgaaaactgcattactgatcgtctccgggatctttccatactcaattccggccaccctcctggtgtggcacacatggcagaagcagacccaacggagcggagttctttgggatgtacctagtcccccagagacacagaaagctgaactggaggagggtgtgtatagaataaagcagcagggcatcttcgggaaaactcaagtcggagtgggcgttcagaaggaaggtgtgtttcataccatgtggcacgtcacgagaggggccgtgttgacatacaacggaaagcgactagagcccaattgggcatctgtcaagaaggacctgatttcctatggcggcgggtggcgcctcagcgctcagtggcaaaaaggagaagaggtccaggtgatcgccgttgaacctggtaagaaccccaagaatttccagactatgcccggcaccttccagacaaccactggggagattggagcgatcgccctggattttaagcctggcacctcgggttcaccgataatcaaccgggaggggaaggtggtcggactttacggcaatggcgtggttaccaaaaacgggggatatgtgtctggtattgcacaaacgaatgctgaaccagacggccccactcctgagttagaagaggaaatgttcaagaaaagaaacctgaccatcatggatctccacccagggagtggaaagacaaggaaatacttgcccgccattgtccgtgaggctatcaagcgccggctgagaaccctcatactggcacctactagggtggtagccgccgagatggaagaggctcttaagggcctgccgattcgatatcagacaaccgcgacgaaatccgaacatactggtcgggagatcgtggacttgatgtgccacgcaacatttaccatgcgcctactgagccccgttagagtcccaaattacaacctcatcattatggatgaagcccatttcaccgaccctgcttctatcgccgcaagggggtacataagcactcgggtgggaatgggcgaggccgctgcgatttttatgacagccacaccaccaggcacagcagatgctttccctcagtccaatgcccccatccaggacgaggaacgagacattccagagagatcatggaacagtgggaatgaatggatcactgattttgcaggaaagacggtgtggttcgtcccgagcataaaagccggtaacgacattgctaactgtttacgcaagaatggcaaaaaggtaatccaactgtctaggaagacctttgatacagagtatcagaaaactaaacttaacgactgggatttcgtggttaccacagacatctccgagatgggggccaattttaaagcggatcgtgtgattgaccctcggagatgcctgaagcccgtcatcctcaccgatggaccagaaagggtgattttggcaggccccatgcctgttactgccgcttcagccgctcagcgccgaggtagagtggggcggaacccacagaaagagaatgaccaatacatattcacgggccagcccctgaacaatgatgaagaccacgcacattggaccgaggccaagatgctcctggacaacatcaatacacctgaaggaattatcccggctcttttcgagccagagagggaaaagagtgccgcaatcgatggcgagtatcgcctaaaaggggaaagccgtaagacttttgtcgagctgatgagacggggagacttgcccgtgtggttagcgcacaaagtagcctccgaaggtattaagtacaccgataggaaatggtgcttcgacggccagcgcaacaatcagatactggaggagaacatggatgtggaaatctggacaaaggagggggagaaaaagaagctccgacctagatggctggacgctcggacctattctgatccccttgccctgaaagagtttaaggacttcgcagctggaaggaaatcgattgccctcgatttggttactgaaatcggccgcgtcccaacacacctggcacatagaacgaggaatgccctagacaacctggtgatgctccacaccagcgagcatggtgggaaggcttaccggcacgcggtggaggaacttcctgagactatggaaacactgttattgctgggcctcatgattctgcttaccggaggcgccatgctgtttctcatctcagggaaaggaataggtaagacctccatcggcttgatttgtgtcatcgcaagttctgggatgctgtggatggctgagattcccttacaatggatcgccagcgccatagttctagagttctttatgatggtgctgctcattccagaacctgagaagcagcgtacaccgcaggataatcaacttgcatatgtagtgatcggcattctgactttggctgccacgatcgcggctaacgaaatgggcctgctcgagaccacaaaacgcgacctgggtatgtccaaggaacccggggtcgtgtcaccaacttcttaccttgatgttgacctccaccctgccagcgcatggaccctgtacgccgtggctacaaccgtcataactcccatgttgcgacatacgatcgagaatagtacagcaaacgtatccctggccgcgattgctaaccaggccgtggttttaatgggcctagacaaaggatggccaatcagcaagatggatctgggcgtgcctctccttgcactggggtgctattctcaggtcaatcccttgaccctgactgccgctgtgctcctgcttattacccactacgccatcataggaccgggcttacaggcaaaagctacaagagaggcccaaaagaggactgcggccggtattatgaagaacccaaccgtcgacgggatcatgacaatcgatctggaccctgtgatttatgattcaaaattcgaaaagcagctcggacaggttatgttgctggtgctatgtgcagtacagctgctccttatgcggacgtcctgggctctgtgcgaggccttgaccctggcaactggccccatcacaaccctctgggaaggtagtccaggcaaattttggaatactacaatagctgtgagcatggccaacattttccgcgggtcgtacctggccggagcgggcttagctttttctatcatgaagtccgtcgggaccggaaaaagaggcacgggtagccaaggggagacccttggagaaaagtggaagaaaaagctgaatcagctctcaaggaaagagttcgacctatataagaaaagtggcattacagaggttgatcggactgaagcaaaggagggtctgaaacgaggcgaaatcacccatcacgccgtgtctagagggtccgctaagttgcagtggtttgtcgagcgcaacatggtgatacccgaaggaagggtaatcgacctgggctgtgggcggggaggctggagctactattgcgccggtctcaagaaagtgacagaggttcgtgggtacactaagggaggccctggccatgaggaaccggtgcccatgtcaacctacgggtggaatattgtcaaacttatgagtggaaaggatgtgttctatctgccacctgagaaatgtgacacattgctgtgcgatatcggtgaaagctccccctctcctaccgtcgaggagagcagaactattagggtgctcaagatggttgaaccatggttaaagaacaatcagttctgtatcaaagtactgaacccctacatgcctacggtgattgagcaccttgaacgcctgcaacggaagcacggcgggatgctagtccgaaatccactctccagaaactcaacacatgagatgtattggatctctaatggaaccggcaacatagtggcaagtgttaatatggtgtcgaggctgttgctgaaccgctttactatgacccaccggagacccacaattgaaaaagacgtcgatctcggtgccgggacgcgtcatgtgaacgctgagccggagacccctaatatggacgtaatcggagaaaggatcaagcggattaaagaggaacacaacagcacttggcactacgacgatgagaatccatataagacatgggcgtaccatggctcctatgaagtgaaggccaccggctctgcatcaagcatgataaacggggttgtcaaacttctgactaagccctgggacgtggtgcctatggtcacacagatggctatgaccgatacaactccattcggacagcaacgcgtttttaaagagaaggtggacacccgaacgcccagatccatgccgggtaccaggcgggtaatgggcatcacagccgagtggttatggcgcactctggggagaaataaaaagcctaggttgtgcacccgagaagagttcacaaagaaagtgcggactaacgcagccatgggagctgtctttaccgaagagaatcagtgggatagtgccaaggcggcagtggaagacgaggatttctggaaactcgttgaccgtgagagagaactgcacaagctaggcaaatgtggttcttgcgtgtacaacatgatggggaagcgcgagaagaaacttggagaatttggcaaagccaaaggcagcagggctatttggtacatgtggctgggggcccggtatctcgagttcgaggcactgggatttttgaatgaagatcattggttctcaagagagaactcctacagtggtgtcgaaggcgaggggctgcacaagctcggatatatccttcgcgacattagcaaaatccccggcggtgctatgtacgccgatgacacggctgggtgggacacaaggataaccgaagatgacctgcataatgaggagaagatcactcagcagatggatccagaacaccgacaattagccaacgcaatttttaaactgacatatcagaataaggtggtaaaggttcagcggcctacccccactggaaccgtgatggacatcatttctagaaaagatcagaggggctccggccaagtcgggacatacggattgaacacgttcaccaatatggaggcgcagctcatccgccagatggaaggtgagggcgtgctgtcaaaggccgacctagaaaacccacaccttcccgagaaaaagataactcagtggctggagacaaaaggggtggaacgtctcaagcggatggctattagcggagatgactgcgtcgttaagcctatcgatgacagatttgccaacgcactgttggctttaaatgatatgggcaaagtgaggaaggacatcccacaatggcagccgtcgaaaggttggcatgattggcagcaggtacccttctgttctcaccatttccacgagctgattatgaaggacgggcgcaaactcgtggtcccttgccgaccacaagacgaacttataggacgggccagaatcagtcagggcgcaggctggtccctgagggagaccgcctgtctagggaaggcgtatgctcagatgtggagcctgatgtactttcaccgcagagatctccggttggcctcaaacgcaatttgctccgccgtgcccgttcattgggtgcctacttctaggacaacctggagcatccacgctcatcaccaatggatgacgacagaagacatgctgaccgtctggaatcgtgtgtggattgaggataacccatggatggaggacaagactcccgtaaccacatgggaaaatgttccttaccttggaaaacgagaggatcagtggtgtggtagtctgatcggcctcacttcccgcgccacctgggcacagaacataccgacagctatccagcaagtgaggagcttaattgggaatgaagagttcctggactatatgccatctatgaagcggtttaggaaagaggaagagtcagaaggagccatctggtga

SEQ ID NO: 15517 - RNA, 9873 nt, synthetic construct
  misc_feature 1..9873: note = derived and/or modified CDS sequence (opt3) from DENV-3__FJ639786__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttgggccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgttccctgtaaaatccctttctccaccgaggacggccaaggtaaggcgcataacgggcgtcttataacagcaaatccagtggtaactaaaaaggaggaacccgtcaacattgaggccgaaccgcctttcggcgagtcaaatatcgtgatcggaattggcgataacgctttgaaaatcaattggtataagaaggggagcagtattggaaaaatgtttgaagccaccgcacgcggtgccagaaggatggctatactgggcgacacagcctgggatttcgggtctgttggaggcgtgctcaactccctgggtaagatggtccaccagatctttgggagcgcatacactgcgcttttctcgggcgtgtcttgggtaatgaaaattggaatcggcgtgctgttgacctggatcgggctcaattccaagaacacgtcaatgagttttagctgcattgctataggaatcattacactgtatttaggcgccgttgtccaggcagacatgggttgtgtgatcaattggaaagggaaggagctgaagtgcggatccggcattttcgtgaccaacgaggtccatacttggacagaacagtacaaatttcaagccgattctcccaagcggctagctaccgccatcgcaggtgcttgggagaatggcgtttgtgggatacgaagcactacccgcatggaaaacctcctgtggaaacagatcgccaatgagcttaactatattttgtgggaaaataacatcaagctgacagtggtggtaggagacattatcggcgtcctcgagcaggggaaaagaacgctgaccccacagcctatggagttaaagtactcatggaaaacttggggaaaggcgaagatagtgacagccgaaacccaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggagctggactttaattattgcgaggggactaccgtggtgattacagaaaactgtggaacgcgtggcccaagtttacggaccactacagtctctggtaaactcatccacgagtggtgctgtcgaagctgcaccctgccccctcttagatacatgggggaagatggatgttggtatggcatggagataaggccaatttccgaaaaggaggagaatatggttaaatcactggtgagcgccggttctggcgaagtagacaacttcactatgggggtgttgtgcctcgcaatcctgtttgaggaagtcatgcgcggaaagttcggcaagaaacatatgatcgctggggtgttctttacattcgttctactgctctccggacagattacctggcgggatatggcccacacgctgatcatgattggcagtaatgcaagcgacagaatgggtatgggggtgacttaccttgccttgatagctacctttaagatccagcccttcctggcgttaggatttttcctcaggaaactgacatctcgcgagaaccttctgctaggcgtcggcctcgccatggcaaccactctgcaattgccggaagatattgagcagatggctaatgggatcgccctgggattaatggccctcaagctgattacacagtttgagacctatcagctttggacagctctgatctccttgacttgttcaaacaccatattcacgctcacagtggcatggcgaaccgccactctgatcctagcgggtgttagtctgcttcctgtgtgccaaagctcgtccatgcggaaaaccgactggctcccaatgacagtcgctgccatgggcgtaccccctctgcccttgtttattttctctctgaaggatactttaaagcgtagaagctggccactcaatgaaggggtgatggcagttggactggtgtcaatccttgccagttccctgttgaggaacgacgtccctatggctggccccctcgtggcaggtgggctgctaattgcctgttacgtaatcaccggaacgtctgcggatctgacagtggagaaagctgccgacgtcacctgggaagaggaagcagagcagactggcgttagccataaccttatgataacagtggacgatgacggcaccatgcgcattaaggatgacgagactgaaaatatcctcacagtgctgttgaaaaccgccttactgatcgtctccgggatttttccatactcaataccggctacgctcctggtgtggcacacttggcagaagcagacccaacggagcggagttctttgggatgtacctagtcccccagagacacagaaagccgaactggaggagggtgtgtatagaatcaagcagcagggcattttcgggaaaacccaagtcggagtgggcgttcagaaggaaggtgtgtttcatacaatgtggcacgtcactaggggggcagtgttgacctacaacggaaagcgactagagcccaattgggcttctgtaaaaaaggacctgatctcctatggcggcgggtggcgcctcagcgcccagtggcaaaaaggagaagaggtccaggtgattgcggttgaacctggtaagaacccaaaaaatttccagacgatgcccggcacattccagactaccacaggggagatcggagccatagcactggattttaagcctggcacctcgggttcaccgatcattaaccgggaggggaaggtggtcggactttacggcaatggcgtggttactaaaaacgggggatatgtgtctggtatcgctcaaaccaatgccgaaccagacggccccacacctgagttagaagaggaaatgttcaagaaaagaaacctgacgattatggatctccacccagggagtggaaagactaggaaatacttgcccgctatcgtccgtgaggcaataaagcgccggctgagaaccctcattctggcccctacaagggtggtagccgctgagatggaagaggcgcttaagggcctgccgatccgatatcagaccactgcaacaaaatccgaacataccggtcgggagatcgtggacttgatgtgccacgccacgtttactatgcgcctactgagccccgttagagtcccaaattacaacctcattatcatggatgaagctcatttcacagaccctgcctctatagcagccagggggtacattagcacccgggtgggaatgggcgaggctgcggccatctttatgaccgcaactcccccaggcacagctgatgccttccctcagtccaatgcacccattcaggacgaggaacgagacatcccagagagatcatggaacagtgggaatgaatggataaccgattttgccggaaagacagtgtggttcgtcccgagcattaaagctggtaacgacatcgccaactgtttacgcaagaatggcaaaaaggtaatccaactgtctaggaagacttttgatacggagtatcagaaaaccaagcttaacgactgggatttcgtggttacaactgacatttccgagatgggggcgaattttaaaaccgatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggaaaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtacctggccggagcgggcttagctttttctatcatgaagtccgtcgggactggaaaaagaggcacaggtagccaaggggagacccttggagaaaagtggaagaaaaagctgaatcagctctcaaggcgggagttcgacctatataaaaagagtggcataacggaggttgatcgaaccgaagcaaaagagggtctgaagagaggcgaaatcacacatcacgccgtgtctcgcgggtccgctaaattgcagtggtttgtcgagaggaacatggtgattcccgaaggacgggtaatcgacctgggctgtgggcgtggaggctggagctactattgcgccggtctcaagaaggtgactgaggttagagggtacaccaaaggaggccctggccatgaggaaccggtgcccatgtcaacatacgggtggaatattgtcaagcttatgagtggaaaagatgtgttctatctgccacctgagaagtgtgacactttgctgtgcgatatcggtgaaagctccccctctcctaccgtcgaggagagcaggacaattcgcgtgctcaaaatggttgaaccatggttaaagaacaatcagttctgtatcaaggtactgaacccctacatgcctaccgtgatagagcaccttgaacggctgcaacgaaaacacggcgggatgctagtcagaaatccactctccaggaactcaactcatgagatgtattggatttctaatggaacgggcaacatcgtggcaagtgttaatatggtgtcgcgcctgttgctgaaccggtttacaatgacccacagacgtcccactatcgaaaaggacgtcgatctcggtgccgggaccaggcatgtgaacgctgagccggagacacctaatatggacgtaattggagaacggataaaacgcatcaaggaggaacacaacagcacgtggcactacgacgatgagaatccatataaaacctgggcgtaccatggctcctatgaagtgaaggccactggctctgcatcaagcatgattaacggggttgtcaagcttctgacaaaaccctgggacgtggtgcctatggtcacccagatggctatgactgatacaaccccattcggacagcaacgagtttttaaggagaaagtggacacaagaactcccaggccgatgcctggtacccggcgcgtaatgggcatcacggccgagtggttatggagaaccctggggaggaataagaaaccccgattgtgcacacgggaagagttcactaagaaggtgcgtaccaacgcagccatgggagctgtctttacagaagagaatcagtgggattccgccaaagcggcagtggaagacgaggatttctggaagctcgttgacagagagcgcgaactgcacaaactaggcaagtgtggtagttgcgtgtacaacatgatggggaaaagggagaagaaacttggagaatttggcaaggccaagggctctcgggctatttggtacatgtggctgggggccagatatctcgagttcgaggcactgggatttttgaatgaagatcattggttcagccgcgagaactcatactccggtgtcgaaggcgaggggctgcacaaactcggatatatccttagggacataagtaagatcccaggcggtgctatgtacgccgatgacactgctgggtgggacacccgaattacggaagatgacctgcataatgaggagaaaatcacacagcagatggatcctgaacaccggcaattagccaacgcaatttttaagctgacctatcagaataaagtggtaaaggttcagagacccactccaacaggaaccgtgatggacatcataagcaggaaggatcagcgcggctctggccaagtcgggacttacggattgaacaccttcacaaatatggaggcgcagctcattcgtcagatggaaggtgagggcgtgctgtccaaagccgacctagaaaacccccaccttcctgagaagaaaatcacgcagtggctggagaccaagggggtggaacggctcaaaagaatggctatctcaggagatgactgcgtcgttaagccaattgatgacaggtttgccaacgcactgttggctttaaatgatatgggcaaggtgcgcaaagacataccgcaatggcagcccagcaagggttggcatgattggcagcaggtacctttctgttcgcaccatttccacgagctgatcatgaaagacgggcgaaagctcgtggtcccatgccggccccaagacgaacttattggaagagccaggatctctcagggcgcaggctggagtctgcgcgagactgcctgtctagggaaagcgtatgctcagatgtggtccctgatgtactttcacagacgggatctcaggttggccagcaacgcaatttgctcagccgtgcctgttcattgggtgccaacatcccgtaccacttggtctatccacgctcatcaccaatggatgacaaccgaagacatgctgacggtctggaatcgagtgtggatagaggataacccctggatggaggacaagacacctgtaaccacttgggaaaatgttccgtaccttggaaagcgcgaggatcagtggtgtggtagcctgatcggcctcaccagtagagccacatgggcacagaacatttccactgctatccagcaagtgcggagcttaattgggaatgaagagttcctggactatatgccatctatgaaaaggtttcgcaaggaggaagagtcagaaggagccatctggtga

SEQ ID NO: 15518 - RNA, 9873 nt, synthetic construct
  misc_feature 1..9873: note = derived and/or modified CDS sequence (opt3) from DENV-3__FJ639787__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggttgtccgccgagggggcttggaggcaggtcgaaaaagtggagacttgggcactccggcaccctggattcaccattctggccctgtttctcgctcattacatcggcacatctttaactcagaaggttgtgatattcatcctgcttatgttggtcaccccatcgatgacaatgcgctgtgtgggcgtagggaacagagactttgttgaaggactgtcaggtgccacctgggtggatgtcgtgctagagcacggcgggtgcgtgacgactatggcgaagaataaacccacactcgacattgagctgcagaagaccgaagcaactcaacttgccacactgaggaaattgtgtatcgagggaaagattaccaacatcacgaccgatagccggtgccctacacagggcgaagctgtcctcccagaggaacaggaccagaattatgtttgtaaacacacttacgtggatcgcggttgggggaacggatgcggcctgttcggcaaggggagtttagtaacctgcgccaagtttcaatgtctggagcccatagagggaaaagtggtccagtatgaaaatctcaagtacacagtgattatcactgttcataccggtgaccagcaccaggtgggcaacgagacacaaggggtcaccgcagaaattactcctcaggcttccacgacagaggccatccttccagaatatggaaccctgggcttggagtgctctccgcgaactggtctagacttcaatgagatgatcctgctcaccatgaaaaacaaggcgtggatggtgcatagacagtggtttttcgatctgccccttccttggacaagcggggccaccactgaaacaccaacgtggaataggaaagagctgttggtaacctttaagaacgcacacgctaaaaagcaagaagttgtggtcctcggctcccaggagggagccatgcacactgctctgacaggcgccaccgaaattcagaattcagggggaacaagtatattcgcaggtcatttaaagtgtcggctgaaaatggacaagctagagctcaaaggcatgagctacgccatgtgcactaacacctttgtgctgaagaaagaggtctctgaaacgcagcacgggaccatccttattaaggtggagtacaagggagaagatgttccctgtaaaatccctttctccacagaggacggccaaggtaaggctcataacgggcgtttgataactgcgaatccagtggtaaccaaaaaggaggaacccgtcaacattgaggcagaaccgcctttcggcgagtcaaatatcgtgatcggaattggcgataacgccctgaaaatcaattggtataagaaggggagcagtattggaaaaatgtttgaagctacagcccgcggtgcaagaaggatggccatactcggcgacactgcttgggatttcgggtctgttggaggcgtgctgaactcccttggtaagatggtccaccagatctttgggagcgcctacaccgcactgttctcgggcgtgtcttgggtaatgaaaattggaatcggcgtgttgctcacgtggatcgggctgaattccaagaacacatcaatgagttttagctgcattgcgataggaatcattaccttatatctgggcgctgttgtccaggccgacatgggttgtgtgatcaattggaaagggaaggagctaaagtgcggatccggcattttcgtgactaacgaggtccatacatggaccgaacagtacaaatttcaagcagattctcccaagcggctcgccactgctatcgccggtgcatgggagaatggcgtttgtgggatacgaagcaccacacgcatggaaaacctgctttggaaacagatcgctaatgagttgaactatattctgtgggaaaataacatcaagctcacggtggtggtaggagacaccattggcgtcctggagcaggggaaaagaactttaacaccacagcctatggagctgaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggcttaaattgcgggaagtgtacacccagctctgtgaccaccgcctgatgtcagcagccgttaaggatgagagagctgtgcacgccgacatgggatactggattgagagtcagaaaaacggcagctggaagctagaaaaagcatccctgatcgaggtaaagacttgcacctggcctaagtctcatacactctggtcgaatggtgtcctggaaagcgatatgataatcccaaaatcccttgcgggcccgatttcacagcacaactataggcccgggtaccatactcaaaccgccggaccttggcacttgggcaagctggagttagactttaattattgcgaggggacaacggtggtgatcaccgaaaactgtggaactcgtggcccaagtctccggacaaccactgtctctggtaaactgattcacgagtggtgctgtcgaagctgcacacttccccctctgagatacatgggggaagatggatgttggtatggcatggagatcaggccaatatccgaaaaggaggagaatatggttaaatcattggtgagcgctggttctggcgaagtagacaacttcaccatgggggtgctctgcctggccattctatttgaggaagtcatgcgcggaaagttcggcaagaaacatatgatcgcaggggtgttctttacgttcgttctgctcctgtccggacagatcacttggcgggatatggctcacacccttattatgatcggcagtaatgccagcgacagaatgggtatgggggtgacatacttggcactgattgccacctttaagatacagcccttcttagctctcggatttttcctgaggaaacttacttctcgcgagaacctgctactcggcgtcggcctggcgatggccacaaccttgcaactgccggaagatatcgagcagatggcaaatgggattgctttaggactcatggccctgaagcttatcacacagtttgagacttatcagctgtggaccgccttgatttccctcacgtgttcaaacacaatcttcaccctgactgtggcttggcgaaccgcaacactaatactggccggtgttagtcttctccctgtgtgccaaagctcgtccatgcggaaaactgactggctgccaatgaccgtcgcggctatgggcgtaccccctttgcccctgtttatcttctctttaaaggatacgctcaagcgtagaagctggccactgaatgaaggggtgatggccgttggacttgtgtcaattctggcaagttccttgctcaggaacgacgtccctatggccggccccctggtggctggtgggctactgatcgcatgttacgtaattacaggaacctctgccgatcttactgtggagaaagcggctgacgtcacatgggaagaggaagccgagcagaccggcgttagccataacctcatgatcactgtggacgatgacggcacaatgcgcataaaggatgacgagaccgaaaatattctgacggtgttgttaaaaactgcactgctcatcgtctccgggatctttccatactcaattccggccaccctgcttgtgtggcacacatggcagaagcagacccaacggagcggagttctgtgggatgtacctagtcccccagagacacagaaagctgaattggaggagggtgtgtatagaataaagcagcagggcatcttcgggaaaactcaagtcggagtgggcgttcagaaggaaggtgtgtttcataccatgtggcacgtcacgaggggggccgtgctaacatacaacggaaagcgactggagcccaattgggcatctgtaaaaaaggacctcatttcctatggcggcgggtggcgcctgagcgctcagtggcaaaaaggagaagaggtccaggtgatcgccgttgaacctggtaagaacccaaaaaatttccagactatgcccggcaccttccagacaaccactggggagattggagcgatcgcccttgattttaagcctggcacctcgggttcaccgataatcaaccgggaggggaaggtggtcggattatacggcaatggcgtggttacaaaaaacgggggatatgtgtctggtattgcacaaacgaatgctgaaccagacggccccactcctgagctggaagaggaaatgttcaagaaaagaaacctcaccatcatggatttgcacccagggagtggaaagacaaggaaatacctgcccgccattgtccgtgaggctatcaagcgccggctcagaaccctgatacttgcacctactagggtggtagccgccgagatggaagaggctctgaagggcttgccgattcgatatcagacaaccgcgacgaaatccgaacatactggtcgggagatcgtggacctaatgtgccacgcaacatttaccatgcgcctgctcagccccgttagagtcccaaattacaacttaatcattatggatgaagcccatttcaccgaccctgcttctatcgccgcaagggggtacataagcactcgggtgggaatgggcgaggccgctgcgatttttatgacagccacccccccaggcacagcagatgctttccctcagtccaatgcccccatccaggacgaggaacgagacattccagagagatcatggaacagtgggaatgaatggatcactgattttgcaggaaagacggtgtggttcgtcccgagcataaaagccggtaacgacattgctaactgtctgcgcaagaatggcaaaaaggtaatccaactttctaggaagacctttgatacagagtatcagaaaactaagctgaacgactgggatttcgtggttaccacagacatctccgagatgggggccaattttaaagcggatcgtgtgattgaccctcggagatgcctcaagcccgtcatcttgaccgatggaccagaaagggtgattctggcaggccccatgcctgttactgccgcttcagccgctcagcgccgaggtagagtggggcggaacccacagaaagagaatgaccaatacatattcacgggccagcccctcaacaatgatgaagaccacgcacattggaccgaggccaagatgctgcttgacaacatcaatacacctgaaggaattatcccggctctattcgagccagagagggaaaagagtgccgcaatcgatggcgagtatcgcctgaaaggggaaagccgtaagacttttgtcgagttgatgagacggggagacttacccgtgtggctggcgcacaaagtagcctccgaaggtattaagtacaccgataggaaatggtgcttcgacggccagcgcaacaatcagatactcgaggagaacatggatgtggaaatctggacaaaggagggggaaaaaaagaagctgcgacctagatggcttgacgctcggacctattctgatcccctggccctcaaagagtttaaggacttcgcagctggaaggaaatcgattgccttggatctggttactgaaatcggccgcgtcccaacacacctagcacatagaacgaggaatgccctggacaacctcgtgatgcttcacaccagcgagcatggtgggaaggcttaccggcacgcggtggaggaactgcctgagactatggaaacattattgctgctcggcctgatgattcttctgaccggaggcgccatgctctttttgatctcagggaaaggaataggtaagacctccatcggcctgatttgtgtcatcgcaagttctgggatgttatggatggctgagattcccctacaatggatcgccagcgccatagttctggagttctttatgatggtgctccttattccagaacctgagaagcagcgtacaccgcaggataatcaactggcatatgtagtgatcggaattttgactctggctgccacgatcgcggctaacgaaatgggcctcctggagaccacaaaacgcgaccttggtatgtccaaggaacccggggtcgtgtcaccaacttcttacctcgatgttgacctgcaccctgccagcgcatggaccttgtacgccgtggctacaaccgtcataactcccatgctgcgacatacgatcgagaatagtacagcaaacgtatccttagccgcgattgctaaccaggccgtggttctaatgggcctggacaaaggatggccaatcagcaagatggatctcggcgtgcctcttctggcattggggtgctattctcaggtcaatcccctgaccctcactgccgctgtgctgcttttaattacccactacgccatcataggaccgggcctgcaggcaaaagctacaagagaggcccaaaagaggactgcggccggtattatgaagaacccaaccgtcgacgggatcatgacaatcgatctcgaccctgtgatttatgattcaaaattcgaaaagcagttgggacaggttatgctgctagtgctgtgtgcagtacagctccttctgatgcggacgtcctgggctttgtgcgaggccctgaccctcgcaactggccccatcacaaccctgtgggaaggtagtccaggcaaattttggaatactacaatagctgtgagcatggccaacattttccgcgggtcgtacttagccggagcgggccttgctttttctatcatgaagtccgtcgggaccggaaaaagaggcacgggtagccaaggggagaccctgggagaaaagtggaagaaaaagctcaatcagctatcaaggaaagagttcgacctgtataagaaaagtggcattacagaggttgatcggactgaagcaaaggagggtttgaaacgaggcgaaatcacccatcacgccgtgtctagagggtccgctaagctgcagtggtttgtcgagcgcaacatggtgatacccgaaggaagggtaatcgacctcggctgtgggcggggaggctggagctactattgcgccggtcttaagaaagtgacagaggttcgtgggtacactaagggaggccctggccatgaggaaccggtgcccatgtcaacctacgggtggaatattgtcaaactgatgagtggaaaggatgtgttctatttgccacctgagaaatgtgacacactgctctgcgatatcggtgaaagctccccctctcctaccgtcgaggagagcagaactattagggtgttaaagatggttgaaccatggctgaagaacaatcagttctgtatcaaagtacttaacccctacatgcctacggtgattgagcacctggaacgcctacaacggaagcacggcgggatgctcgtccgaaatccactgtccagaaactcaacacatgagatgtattggatctctaatggaaccggcaacatagtggcaagtgttaatatggtgtcgaggttgctgctcaaccgctttactatgacccaccggagacccacaattgaaaaagacgtcgatcttggtgccgggacgcgtcatgtgaacgctgagccggagacccctaatatggacgtaatcggagaaaggatcaagcggattaaagaggaacacaacagcacttggcactacgacgatgagaatccatataagacatgggcgtaccatggctcctatgaagtgaaggccaccggctctgcatcaagcatgataaacggggttgtcaaactgttaactaagccctgggacgtggtgcctatggtcacacagatggctatgaccgatacaactccattcggacagcaacgcgtttttaaagagaaggtggacacccgaacgcccagatccatgccgggtaccaggcgggtaatgggcatcacagccgagtggctgtggcgcactttggggagaaataaaaagcctaggctctgcacccgagaagagttcacaaagaaagtgcggactaacgcagccatgggagctgtctttaccgaagagaatcagtgggatagtgccaaggcggcagtggaagacgaggatttctggaaactggttgaccgtgagagagaactacacaagcttggcaaatgtggttcttgcgtgtacaacatgatggggaagcgcgagaaaaagctgggagaatttggcaaggccaaaggcagcagggctatttggtacatgtggctcggggcccggtatctggagttcgaggcattgggatttctgaatgaagatcattggttctcaagagagaactcctacagtggtgtcgaaggcgaggggctccacaagcttggatatatcctgcgcgacattagcaaaatccccggcggtgctatgtacgccgatgacacggctgggtgggacacaaggataaccgaagatgacttacataatgaggagaagatcactcagcagatggatccagaacaccgacaactggccaacgcaatttttaaattgacatatcagaataaggtggtaaaggttcagcggcctacccccactggaaccgtgatggacatcatttctagaaaagatcagaggggctccggccaagtcgggacatacggactcaacacgttcaccaatatggaggcgcagctgatccgccagatggaaggtgagggcgtgctatcaaaggccgaccttgaaaacccacacctgcccgagaaaaagataactcagtggctcgagacaaaaggggtggaacgtctgaagcggatggctattagcggagatgactgcgtcgttaagcctatcgatgacagatttgccaacgcattgttagctctgaatgatatgggcaaagtgaggaaggacatcccacaatggcagccgtcgaaaggttggcatgattggcagcaggtacccttctgttctcaccatttccacgagctcattatgaaggacgggcgcaaacttgtggtcccttgccgaccacaagacgaactgataggacgggccagaatcagtcagggcgcaggctggtccctaagggagaccgcctgtctggggaaggcgtatgctcagatgtggagcctcatgtactttcaccgcagagatttgcggctggcctcaaacgcaatttgctccgccgtgcccgttcattgggtgcctacttctaggacaacctggagcatccacgctcatcaccaatggatgacgacagaagacatgcttaccgtctggaatcgtgtgtggattgaggataacccatggatggaggacaagactcccgtaaccacatgggaaaatgttccttacctgggaaaacgagaggatcagtggtgtggtagtctcatcggcttaacttcccgcgccacctgggcacagaacataccgacagctatccagcaagtgagaagcctgattgggaatgaagagttcttggactatatgccatctatgaagcggtttaggaaagaggaagagtcagaaggagccatctggtga

SEQ ID NO: 15519 - RNA, 9873 nt, synthetic construct
  misc_feature 1..9873: note = derived and/or modified CDS sequence (opt3) from DENV-3__FJ639790__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttcctaacctttgttctgctcctgtccggacagattacgtggcgggatatggctcacactcttatcatgattggcagtaatgccagcgacagaatgggtatgggggtgacctacttggcactgatagccacattcaagatccagccctttttagctctcggattctttctgaggaaacttacctctcgcgagaacctgctactcggcgtcggcctggcgatggccactacattgcaactgccggaagatattgagcagatggcaaatgggatcgctttaggactcatggccctgaagcttattacccagttcgagacatatcagctgtggactgccttgatctccctcacctgttcaaacacgatatttacactgaccgtggcttggcgaactgcaaccctaatcctggccggtgttagtcttctccctgtgtgccaaagctcgtccatgcggaaaacagactggctgccaatgactgtcgcggctatgggcgtaccccctttgcccctgttcatttttaatttaaaggataccctcaagcgtagatcttggccactgaacgaaggggtgatggccgttggacttgtgagcatcctggcatcaagtttgctcaggaacgacgtccctatggccggccccctggtggctggtgggctactgattgcatgttacgtaatcacgggaacatccgccgatcttaccgtggagaaagcggctgacgtcacttgggaagaggaagccgagcagacaggcgtttctcataatctcatgataaccgtggacgatgacggcactatgcgcattaaggatgacgagacagaaaacatcctgaccgtgttgttaaaaacggcactgctcatcgtcagcgggattttcccatactccataccggccactctgcttgtgtggcacacctggcagaagcagacacaacggtcaggagttctgtgggatgtacctagccccccagagacccagaaagctgaattggaggagggtgtgtatagaatcaagcagcagggcatttttgggaaaacacaagtcggagtgggcgttcagaaggaaggtgtgttccatactatgtggcacgtcaccaggggggccgtgctaacgtacaatggaaagcgactggagcccaactgggcaagtgtaaaaaaggacctcatctcttatggcggcgggtggcgcctgtccgctcagtggcaaaaaggagaagaggtccaggtgattgccgttgaacctggtaagaatccaaaaaactttcagacaatgcccggcactttccagaccacaaccggggagatcggagcgatagcccttgatttcaagcctggcactagcggttcgccgatcattaatcgggaggggaaggtggtcggattatacggcaacggcgtggttaccaaaaatgggggatatgtgtcaggtatcgcacaaacaaacgctgaaccagacggccccacgcctgagctggaagaggaaatgtttaagaaaagaaatctcactattatggatttgcacccagggtctggaaagaccaggaaatacctgcccgccatcgtccgtgaggctataaagcgccggctcagaacactgattcttgcacctaccagggtggtagccgccgagatggaagaggctctgaagggcttgccgatccgatatcagactacagcgaccaaaagtgaacatacgggtcgggagatcgtggacctaatgtgccacgcaactttcacaatgcgcctgctctcccccgttagagtcccaaactacaatttaattatcatggatgaagcccattttaccgaccctgctagcatagccgcaagggggtacatttctacccgggtgggaatgggcgaggccgctgcgatcttcatgactgccacacccccaggcaccgcagatgcttttcctcagagcaacgcccccattcaggacgaggaacgagacatcccagagagatcctggaattcagggaacgaatggataacagatttcgcaggaaagactgtgtggtttgtcccgagtattaaagccggtaacgacatcgctaattgtctgcgcaagaacggcaaaaaggtaatccaacttagcaggaagacgttcgataccgagtatcagaaaacaaagctgaatgactgggattttgtggttactaccgacatttctgagatgggggccaacttcaaagcggatcgtgtgatcgaccctcggagatgcctcaagcccgtcattttgacagatggaccagaaagggtgatactggcaggccccatgcctgttaccgccgcttccgccgctcagcgccgaggtagagtggggcggaatccacagaaagagaacgaccaatacatctttactggccagcccctcaataacgatgaagaccacgcacattggacggaggccaagatgctgcttgacaatattaacacccctgaaggaatcatcccggctctattcgagccagagagggaaaagtcagccgcaattgatggcgagtatcgcctgaaaggggaaagtcgtaagacattcgtcgagttgatgagacggggagacttacccgtgtggctggcgcacaaagtagccagcgaaggtataaagtacactgataggaaatggtgctttgacggccagcgcaataaccagatcctcgaggagaatatggatgtggaaatttggaccaaggagggggaaaaaaagaagctgcgacctagatggcttgacgctcggacatattccgatcccctggccctcaaagagttcaaggactttgcagctggaaggaaatctatcgccttggatctggttaccgaaattggccgcgtcccaactcacctagcacatagaacaaggaacgccctggacaatctcgtgatgcttcacacgtcggagcatggtgggaaggcttaccggcacgcggtggaggaactgcctgagaccatggaaactttattgctgctcggcctgatgatccttctgacaggaggcgccatgctcttcttgataagcgggaaaggaatcggtaagacctcaattggcctgatctgtgtcattgcatccagtgggatgttatggatggctgagatccccctacaatggatagcctctgccattgttctggagtttttcatgatggtgctccttatcccagaacctgagaagcagcgtaccccgcaggataaccaactggcatatgtagtgattggaatcttgacactggctgccataatcgcggctaatgaaatgggcctcctggagactacgaaacgcgaccttggtatgagcaaggaacccggggtcgtgtccccaacctcatacctcgatgttgacctgcaccctgcctctgcatggacattgtacgccgtggctactaccgtcattacacccatgctgcgacataccatcgagaacagcactgcaaacgtaagtttagccgcgattgctaatcaggccgtggttctaatgggcctggacaaaggatggccaatctccaagatggatctcggcgtgcctcttctggcattggggtgctatagccaggtcaaccccctgacgctcacagccgctgtgctgcttttaataacccactacgccattatcggaccgggcctgcaggcaaaagctactagagaggcccaaaagaggaccgcggccggtatcatgaagaatccaacagtcgacgggattatgactatcgatctcgaccctgtgatatatgattctaaatttgaaaagcagttgggacaggttatgctgctagtgctgtgtgcagtacagctccttctgatgcggacctcatgggctttgtgcgaggccctgacactcgcaacgggccccattaccactctgtgggaaggttccccaggcaaattctggaacacaaccatcgctgtgagtatggccaatatttttcgcgggagctacttagccggagcgggccttgctttctcgatcatgaagtctgtcgggactggaaaaagaggcacaggttcccaaggggagaccctgggagaaaagtggaagaaaaagctcaaccagctaagcaggaaagagtttgacctgtataagaaatcaggcataacggaggttgatcggaccgaagcaaaggagggtttgaaacgaggcgaaatcacacatcacgccgtgagtagagggtctgctaagctgcagtggttcgtcgagcgcaatatggtgattcccgaaggaagggtaatcgacctcggctgtgggcggggaggctggtcctactattgcgccggtcttaagaaagtgactgaggttcgtgggtacaccaagggaggccctggccatgaggaaccggtgcccatgagcacatacgggtggaacattgtcaaactgatgtcaggaaaggatgtgttttatttgccacctgagaaatgtgacactctgctctgcgatatcggtgaaagtagcccctcccctaccgtcgaggagtctagaacaattagggtgttaaagatggttgaaccatggctgaagaataaccagttctgtatcaaagtacttaatccctacatgcctaccgtgatagagcacctggaacgcctacaacggaagcacggcgggatgctcgtccgaaacccactgagcagaaattccactcatgagatgtattggatttcaaacggaacgggcaatatcgtggcatctgttaacatggtgagtaggttgctgctcaaccgcttcacaatgacccaccggagacccactatcgaaaaagacgtcgatcttggtgccgggacccgtcatgtgaatgctgagccggagacacctaacatggacgtaattggagaaaggataaagcggatcaaagaggaacacaattcgacgtggcactacgacgatgagaacccatataagacctgggcgtaccatggcagctatgaagtgaaggccactggctccgcatcttcaatgattaatggggttgtcaaactgttaacaaagccctgggacgtggtgcctatggtcacccagatggctatgactgatacaaccccatttggacagcaacgcgttttcaaagagaaggtggacacacgaactcccagaagcatgccgggtaccaggcgggtaatgggcatcacggccgagtggctgtggcgcaccttggggagaaacaaaaagcctaggctctgcacacgagaagagtttactaagaaagtgcggaccaatgcagccatgggagctgtcttcacagaagagaaccagtgggattccgccaaggcggcagtggaagacgaggatttttggaaactggttgaccgtgagagagaactacacaagcttggcaaatgtggtagttgcgtgtacaatatgatggggaagcgcgagaaaaagctgggagaattcggcaaggccaaaggctctagggctatttggtacatgtggctcggggcccggtatctggagtttgaggcattgggattcctgaacgaagatcattggtttagcagagagaattcatactccggtgtcgaaggcgaggggctccacaagcttggatatatcctgcgcgacataagtaaaatccccggcggtgctatgtacgccgatgacactgctgggtgggacaccaggattacggaagatgacttacataacgaggagaagatcacacagcagatggatccagaacaccgacaactggccaatgcaattttcaaattgacctatcagaacaaggtggtaaaggttcagcggcctactcccgcgggaacagtgatggacatcataagcagaaaagatcagaggggctctggccaagtcgggacctacggactcaatacttttaccaacatggaggcccagctgattcgccagatggaaggtgagggcgtgctatccaaggctgaccttgaaaacccacacctgcccgagaaaaagatcacacagtggctcgagacgaaaggggtggaacgtctgaagcggatggccatctcaggagatgactgcgtcgttaagcctattgatgacagattcgcaaatgctttgttagccctgaacgatatgggcaaagtgaggaaggacataccacaatggcagccgagcaaaggttggcatgattggcagcaggtacccttttgttcgcaccatttccacgagctcatcatgaaggacgggcgcaaacttgtggtcccttgccgaccacaagacgaactgattggacgggcaagaatctctcagggcgccggctggagtctaagggagaccgcgtgtctggggaaggcttatgcccagatgtggtccctcatgtacttccaccgcagagatttgcggctggcaagcaatgccatttgctcagctgtgcccgttcattgggtgcctacttccaggacaacctggtctatccacgcccatcaccaatggatgactacagaagacatgcttaccgtctggaaccgtgtgtggatagaggataatccatggatggaggacaagacgcccgtaacaacctgggaaaacgttccttacctgggaaaacgagaggatcagtggtgtggtagcctcatcggcttaactagtcgcgcaacctgggctcagaatattccgacagccatccagcaagtgagatccctgattgggaacgaagagtttttggactatatgccaagcatgaagcggttcaggaaagaggaagagtctgaaggagcgatctggtga

SEQ ID NO: 15520 - RNA, 9873 nt, synthetic construct
  misc_feature 1..9873: note = derived and/or modified CDS sequence (opt3) from DENV-3__FJ639791__SS-prME
  source 1..9873: mol_type = other RNA
accagcctgtgcctcatgatgatccttcccgccgctctggcattccacttgacatccagagacggcgaacctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccgtggagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccaaaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaaattcctttctccacagaggacggccaaggtaaggctcataacgggcgtcttatcactgcgaatccagtagtcaccaaaaaggaggaacccgtgaacatagaggcagaaccgcctttcggcgagtcaaatattgttatcggaatcggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattccaagaacacatcaatgagttttagctgcatcgcgattggaataatcaccctgtatttaggcgctgtcgtgcaggccgacatgggttgtgtgattaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcgaagtggacaacttcacaatgggggtcttgtgcctcgccattctgtttgaggaagtgatgcgcggaaagttcggcaagaaacatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaagatacagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagatttatcagctttggacagccctgatctccttgacttgttcaaacaccatattcacgctcacagttgcttggcgaaccgcaactctgatcctagccggtgtgagtctgcttcctgtctgccaaagctcgtccatgcggaaaaccgactggctcccaatgacagtagcggctatgggcgtgccccctctgcccttgtttattttcaatctgaaggatactttaaagcgtagatcttggccactcaacgaaggggttatggccgtgggactggtcagcatccttgcatcaagtctgttgaggaacgacgtgcctatggccggccccctcgtagctggtgggctgctaattgcatgttacgtgatcaccggaacgtccgccgatctgacagtcgagaaagcggctgacgttacctgggaagaggaagccgagcagactggcgtgtctcataatcttatgataacagtggacgatgacggcaccatgcgcattaaggatgacgagactgaaaacatcctcacagtcctgttgaaaaccgcattactgatcgtgagcgggatttttccatactccataccggccacgctcctggtttggcacacttggcagaagcagacccaacggtcaggagtactttgggatgtgcctagcccaccagagacacagaaagctgaactggaggagggtgtctatagaatcaagcagcagggcattttcgggaaaacccaagtgggagttggcgtgcagaaggaaggtgtctttcatacaatgtggcacgtgactagaggggccgtattgacctacaatggaaagcgactagagcccaactgggcaagtgtcaaaaaggacctgatctcttatggcggcgggtggcgcctctccgctcagtggcaaaaaggagaagaggtgcaggttattgccgtggaacctggtaagaatcccaagaatttccagacgatgcccggcacattccagactaccacaggggagatcggagcgatagccctggattttaagcctggcaccagcggttcgccgatcattaatcgggaggggaaggtcgtgggactttacggcaacggcgttgtgactaaaaatgggggatatgtctcaggtatcgcacaaaccaacgctgaaccagacggccccacacctgagttagaagaggaaatgttcaagaaaagaaatctgacgattatggatctccacccagggtctggaaagactaggaaatacttgcccgccatcgtgcgtgaggctataaagcgccggctgagaaccctcattctggcacctacaagggtagtggccgccgagatggaagaggctcttaagggcctgccgatccgatatcagaccactgcgacaaaaagtgaacataccggtcgggagatcgttgacttgatgtgccacgcaacgtttactatgcgcctactgtcccccgtcagagtgccaaactacaatctcattatcatggatgaagcccatttcacagaccctgctagcatagccgcaagggggtacatttctacccgggtgggaatgggcgaggccgctgcgatctttatgaccgccactcccccaggcacagcagatgctttccctcagagcaacgcccccattcaggacgaggaacgagacatcccagagagatcctggaactcagggaacgaatggataaccgattttgcaggaaagacagtctggttcgtaccgagtattaaagccggtaacgacatcgctaattgtttacgcaagaacggcaaaaaggtgatccaactgagcaggaagacttttgatacggagtatcagaaaaccaaacttaatgactgggatttcgttgtgacaactgacatttctgagatgggggccaactttaaagcggatcgtgtcatcgaccctcggagatgcctgaagcccgtgattctcaccgatggaccagaaagggttatattggcaggccccatgcctgtgacagccgcttccgccgctcagcgccgaggtagagtcgggcggaatccacagaaagagaacgaccaatacatcttcaccggccagcccctgaataacgatgaagaccacgcacattggactgaggccaagatgctcctggacaatattaacacgcctgaaggaatcatcccggctcttttcgagccagagagggaaaagtcagccgcaattgatggcgagtatcgcctaaaaggggaaagtcgtaagacctttgtggagctgatgagacggggagacttgcccgtatggttagcgcacaaagtggccagcgaaggtataaagtacacagataggaaatggtgcttcgacggccagcgcaataaccagatcctggaggagaatatggatgttgaaatttggactaaggagggggagaagaagaagctccgacctagatggctggacgctcggacctattccgatccccttgccctgaaagagtttaaggacttcgcagctggaaggaaatctatcgccctcgatttggtcacagaaattggccgcgtgccaacccacctggcacatagaactaggaacgccctagacaatctggtgatgctccacacatcggagcatggtgggaaggcttaccggcacgcggtcgaggaacttcctgagacgatggaaaccctgttattgctgggcctcatgatcctgcttactggaggcgccatgctgtttctcataagcgggaaaggaatcggtaagacatcaattggcttgatctgtgttattgcatccagtgggatgctgtggatggctgagatccccttacaatggatagcctctgccattgtgctagagttctttatgatggtactgctcatcccagaacctgagaagcagcgtaccccgcaggataaccaacttgcatatgtggtcattggaatcctgaccttggctgccataatcgcggctaatgaaatgggcctgctcgagacaactaaacgcgacctgggtatgagcaaggaacccggggtggtttccccaacgtcataccttgatgtggacctccaccctgcctctgcatggaccctgtacgccgtcgctacaactgtaattacccccatgttgcgacatacaatcgagaacagcaccgcaaacgtgagtctggccgcgattgctaatcaggccgttgtgttaatgggcctagacaaaggatggccaatctccaagatggatctgggcgtccctctccttgcactggggtgctatagccaggtgaaccccttgactctgacggccgctgtcctcctgcttataacacactacgccattatcggaccgggcttacaggcaaaagctaccagagaggcccaaaagaggactgcggccggtatcatgaagaatccaaccgtggacgggattatgacaatcgatctggaccctgttatatatgattctaaattcgaaaagcagctcggacaggtgatgttgctggtactatgtgcagtgcagctgctccttatgcggacttcatgggctctgtgcgaggccttgaccctggcaacaggccccattacgaccctctgggaaggttccccaggcaaattttggaacactacaatcgctgtcagtatggccaatattttccgcgggagctacctggccggagcgggcttagctttttcgatcatgaagtctgttgggaccggaaaaagaggcactggttcccaaggggagacacttggagaaaagtggaagaaaaagctgaaccagctcagcaggaaagagttcgacctatataagaaatcaggcataaccgaggtggatcggacggaagcaaaggagggtctgaaacgaggcgaaatcacccatcacgccgtcagtagagggtctgctaagttgcagtggtttgtggagcgcaatatggtaattcccgaaggaagggtgatcgacctgggctgtgggcggggaggctggtcctactattgcgccggtctcaagaaagttacagaggtgcgtgggtacactaagggaggccctggccatgaggaaccggtccccatgagcacctacgggtggaacattgtgaaacttatctcaggaaaggatgtcttctatctgccacctgagaaatgtgacacattgctgtgcgatattggtgaaagtagcccctcccctactgtggaggagtctagaaccatcagggttctcaagatggtagaaccatggttaaagaataaccagttctgtataaaagtgctgaatccctacatgcctacagtcattgagcaccttgaacgcctgcaacggaagcacggcgggatgctagtgcgaaacccactcagcagaaattccacccatgagatgtattggatctcaaacggatctggcaatatcgttgcaagtgtgaacatggtctcgaggctgttgctgaaccgctttactatgacgcaccggagacccacaattgaaaaagacgtggatctcggtgccgggacccgtcatgtaaatgctgagccggagactcctaacatggacgtgataggagaaaggatcaagcggattaaagaggaacacaatagcacctggcactacgacgatgagaacccatataagacatgggcgtaccatggctcctatgaagttaaggccacgggctctgcatcaagcatgatcaatggggtcgtgaaacttctgaccaagccctgggacgtggtccctatggttactcagatggctatgacagataccactccattcggacagcaacgcgtgtttaaagagaaggtagacacacgaacccccagatccatgccgggtacaaggcgggtgatgggcattactgccgagtggttatggcgcaccctggggagaaacaaaaagcctaggttgtgcacgcgagaagagttcaccaagaaagtccggacaaatgcagccatgggagctgtgtttactgaagagaaccagtgggatagtgccaaggcggcagttgaagacgaggatttctggaaactcgtggaccgtgagagagaactgcacaagctaggcaaatgtggttcttgcgtctacaatatgatggggaagcgcgagaagaaacttggagaatttggcaaagccaaaggcagcagggctatctggtacatgtggctgggggcccggtatctcgagttcgaggcactgggatttttgaacgaagatcattggttctcaagagaaaattcctacagtggtgtggagggcgaggggctgcacaagctcggatatatacttcgcgacatcagcaaaattcccggcggtgctatgtacgccgatgacaccgctgggtgggacacaaggatcactgaagatgacctgcataacgaggagaagattacccagcagatggatccagaacaccgacaattagccaatgcaatctttaaactgacgtatcagaacaaggtagttaaggtgcagcggcctacacccaccggaactgtcatggacataatttctagaaaagatcagaggggctccggccaagtggggacatacggattgaataccttcactaacatggaggcgcagctcatccgccagatggaaggtgagggcgtgctgtcaaaggccgacctagaaaacccacaccttcccgagaaaaagatcacccagtggctggagacaaaaggggtcgaacgtctcaagcggatggctattagcggagatgactgcgttgtgaagcctatagatgacagatttgccaatgcactgttggctttaaacgatatgggcaaagtaaggaaggacatcccacaatggcagccgtcgaaaggttggcatgattggcaacaggtgcccttctgttctcaccatttccacgagctgattatgaaggacgggcgcaaactcgtcgtgccttgccgaccacaagacgaacttatcggacgggccagaattagtcagggcgcaggctggtccctgagggagacggcctgtctagggaaggcgtatgctcagatgtggagcctgatgtactttcaccgcagagatctccggttggcctcaaatgcaatctgctccgccgttcccgtgcattgggtccctacctctaggactacatggagcatacacgctcatcaccaatggatgaccactgaagacatgctgacagtgtggaaccgtgtatggatcgaggataatccatggatggaggacaagacccccgttacgacatgggaaaacgtgccttaccttggaaaacgagaggatcagtggtgtggtagtctgattggcctcacctcccgcgccacttgggcacagaatatcccgaccgctattcagcaagtcaggagcttaatcgggaacgaagagttcctggactatatgccatctatgaagcggtttaggaaagaggaagagtcagaaggagccatttggtga

SEQ ID NO: 15521 - RNA, 9873 nt, synthetic construct
  misc_feature 1..9873: note = derived and/or modified CDS sequence (opt3) from DENV-3__FJ639792__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccaggggggccgtgttgacgcacaacggaaagcgactagagcccaattgggcatctgtaaaacgcgacctgatctcctacggcggcgggtggcggctcagcgctcagtggcaaaagggagaagaggtccaggtgattgccgttgaacctggtaaaaacccaaagaatttccagacaatgcccggcactttccagaccacaaccggggagatcggagcgatagccctggattttaaacctggcacttcgggttcaccgatcattaacagagaggggaaggtggtcggactttatggcaatggcgtggttaccaagaacgggggatacgtgtctggtatcgcacaaacaaatgctgaaccagacggccccacgcctgagttagaagaggaaatgttcaaaaagaggaacctgactattatggatctccatccagggagtggaaaaacccgtaagtatttgcccgccatcgtccgcgaggctataaaacggagactgaggacactcattctggcacctacccgagtggtagccgccgagatggaagaggctcttaagggcctgccgatccggtaccagactacagcgaccaagtccgaacacacgggtcgcgagatcgtggacttgatgtgccatgcaacttttacaatgagactactgagccccgttagggtcccaaattataacctcattatcatggatgaagcccacttcaccgaccctgcttctatagccgcacgggggtacattagcacccgagtgggaatgggcgaggccgctgcgatctttatgactgccacacccccaggcaccgcagatgctttccctcagtccaatgcccccattcaggacgaggaaagagacatcccagagcgctcatggaacagtgggaatgaatggataacagattttgcaggaaaaactgtgtggttcgtcccgagcattaaggccggtaacgacatcgctaactgtttaaggaaaaatggcaagaaagtaatccaactgtctcgtaagacgtttgataccgagtaccagaagacaaaacttaacgactgggatttcgtggttactaccgacatttccgagatgggggccaattttaaggcggatcgggtgatcgaccctagaaggtgcctgaaacccgtcattctcacagatggaccagaacgcgtgatattggcaggccccatgcctgttaccgccgcttcagccgctcagcgaagaggtcgggtggggaggaacccacagaaggagaatgaccaatatatcttcactggccagcccctgaacaatgatgaagaccatgcacactggacggaggccaaaatgctcctggacaacattaatacccctgaaggaatcatcccggctcttttcgagccagagcgcgaaaagagtgccgcaattgatggcgagtaccgtctaaagggggaaagcagaaaaacatttgtcgagctgatgcggaggggagacttgcccgtgtggttagcgtataaggtagcctccgaaggtataaaatacactgatcgcaagtggtgcttcgacggccagcgaaacaatcagatcctggaggagaacatggatgtggaaatttggaccaaagagggggaaaagaaaaagctcagacctcggtggctggacgctaggacatattctgatccccttgccctgaaggagtttaaagacttcgcagctggacgcaagtcgatcgccctcgatttggttaccgaaattggcagagtcccaactcacctggcacataggacacggaatgccctagacaacctggtgatgctccacacgagcgagcatggtgggaaagcttaccgtcacgcggtggaggaacttcctgagaccatggaaactctgttattgctgggcctcatgatcctgcttacaggaggcgccatgctgtttctcatatcagggaagggaatcggtaaaacctccattggcttgatctgtgtcattgcaagttctgggatgctgtggatggctgagatccccttacaatggatagccagcgccattgttctagagttctttatgatggtgctgctcatcccagaacctgagaagcagcgcaccccgcaggataatcaacttgcatatgtagtgattggaatcctgacattggctgccataatcgcggctaacgaaatgggcctgctcgagactacgaagcgagacctgggtatgtccaaagaacccggggtcgtgtcaccaacctcttaccttgatgttgacctccaccctgccagcgcatggacactgtacgccgtggctactaccgtcattacacccatgttgagacataccatcgagaatagtactgcaaacgtatccctggccgcgattgctaaccaggccgtggttttaatgggcctagacaagggatggccaatcagcaaaatggatctgggcgtgcctctccttgcactggggtgctattctcaggtcaatcccttgacgctgacagccgctgtgctcctgcttataacccactacgccattatcggaccgggcttacaggcaaaggctactagggaggcccaaaaacggaccgcggccggtatcatgaagaacccaacagtcgacgggattatgactatcgatctggaccctgtgatatatgattcaaagttcgaaaaacagctcggacaggttatgttgctggtgctatgtgcagtacagctgctccttatgcgcacctcctgggctctgtgcgaggccttgacactggcaacgggccccattaccactctctgggaaggtagtccaggcaagttttggaatacaaccatcgctgtgagcatggccaacattttcagagggtcgtacctggccggagcgggcttagctttttctatcatgaaatccgtcgggactggaaagaggggcacaggtagccaaggggagacccttggagaaaaatggaagaagaaactgaatcagctctcacggaaggagttcgacctatataaaaagagtggcataacggaggttgatcgaaccgaagcaaaagagggtctgaagagaggcgaaatcacacatcacgccgtgtctcgcgggtccgctaaattgcagtggtttgtcgagaggaacatggtgattcccgaaggacgggtaatcgacctgggctgtgggcgtggaggctggagctactattgcgccggtctcaagaaggtgactgaggttagagggtacaccaaaggaggccctggccatgaggaaccggtgcccatgtcaacatacgggtggaatattgtcaagcttatgagtggaaaagatgtgttctatctgccacctgagaagtgtgacactttgctgtgcgatatcggtgaaagctccccctctcctaccgtcgaggagagcaggacaattcgcgtgctcaaaatggttgaaccatggttaaagaacaatcagttctgtatcaaggtactgaacccctacatgcctaccgtgatagagcaccttgaacggctgcaacgaaaacacggcgggatgctagtcagaaatccactctccaggaactcaactcatgagatgtattggatttctaatggaacgggcaacatcgtggcaagtgttaatatggtgtcgcgcctgttgctgaaccggtttacaatgacccacagacgtcccactatcgaaaaggacgtcgatctcggtgccgggaccaggcatgtgaacgctgagccggagacacctaatatggacgtaattggagaacggataaaacgcatcaaggaggaacacaacagcacgtggcactacgacgatgagaatccatataaaacctgggcgtaccatggctcctatgaagtgaaggccactggctctgcatcaagcatgattaacggggttgtcaagcttctgacaaaaccctgggacgtggtgcctatggtcacccagatggctatgactgatacaaccccattcggacagcaacgagtttttaaggagaaagtggacacaagaactcccaggtccatgccgggtacccggcgcgtaatgggcatcacggccgagtggttatggagaaccctggggaggaataagaaacctcgattgtgcacacgggaagagttcactaagaaggtgcgtaccaacgcagccatgggagctgtctttacagaagagaatcagtgggatagtgccaaagcggcagtggaagacgaggatttctggaagctcgttgacagagagcgcgaactgcacaaactaggcaagtgtggttcttgcgtgtacaacatgatggggaaaagggagaagaaacttggagaatttggcaaggccaagggcagccgggctatttggtacatgtggctgggggccagatatctcgagttcgaggcactgggatttttgaatgaagatcattggttctcacgcgagaactcctacagtggtgtcgaaggcgaggggctgcacaaactcggatatatccttagggacataagcaagatccccggcggtgctatgtacgccgatgacactgctgggtgggacacccgaattacggaagatgacctgcataatgaggagaaaatcacacagcagatggatccagaacaccggcaattagccaacgcaatttttaagctgacctatcagaataaagtggtaaaggttcagagacctactcccacaggaaccgtgatggacatcatatctaggaaggatcagcgcggctccggccaagtcgggacttacggattgaacaccttcacaaatatggaggcgcagctcattcgtcagatggaaggtgagggcgtgctgtcaaaagccgacctagaaaacccacaccttcccgagaagaaaatcacgcagtggctggagaccaagggggtggaacggctcaaaagaatggctatcagcggagatgactgcgtcgttaagcctattgatgacaggtttgccaacgcactgttggctttaaatgatatgggcaaggtgcgcaaagacataccacaatggcagccgtcgaagggttggcatgattggcagcaggtacccttctgttctcaccatttccacgagctgatcatgaaagacgggcgaaagctcgtggtcccttgccggccacaagacgaacttattggaagagccaggatcagtcagggcgcaggctggtccctgcgcgagactgcctgtctagggaaagcgtatgctcagatgtggagcctgatgtactttcacagacgggatctcaggttggcctcaaacgcaatttgctccgccgtgcccgttcattgggtgcctacatctcgtaccacttggagcatccacgctcatcaccaatggatgacaaccgaagacatgctgacggtctggaatcgagtgtggatagaggataacccatggatggaggacaagacacccgtaaccacttgggaaaatgttccttaccttggaaagcgcgaggatcagtggtgtggtagtctgatcggcctcacctccagagccacatgggcacagaacattccgactgctatccagcaagtgcggagcttaattgggaatgaagagttcctggactatatgccatctatgaaaaggtttcgcaaggaggaagagtcagaaggagccatctggtga

SEQ ID NO: 15522 - RNA, 9873 nt, synthetic construct
  misc_feature 1..9873: note = derived and/or modified CDS sequence (opt3) from DENV-3__FJ639793__SS-prME
  source 1..9873: mol_type = other RNA
accagcctgtgcctcatgatgatccttcccgcaacactggctttccacttgacttccagagacggcgagcctaggatgattgtggggaagaacgaacggggaaaatctttactgtttaagacggcatcaggtataaatatgtgtaccctaatcgccatggatctcggcgaaatgtgcgacgatacagtaacttacaaatgtccacatattaccgaagttgagccggaagacatcgattgctggtgtaacctgacaagtacctgggtgacttatgggacatgcaatcaggcgggagagcaccgccgagacaagcgtagcgtagctcttgcaccacatgtgggcatgggtctggataccagaacgcagacttggatgtccgcagagggggcctggaggcaggtcgaaaaagtggagacctgggctttgcggcaccctggattcacaattctcgcactgtttctggcccattacatcggcacttctctcacccagaaggttgtgatattcatcttactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacattgagctccagaagactgaagcgacacaactggcaacccttaggaaactgtgtatcgagggaaagattacgaacatcaccacagatagccggtgccctactcagggcgaagccgtcttgccagaggaacaggaccagaattatgtttgtaaacacacctacgtggatcgcggttgggggaacggatgcggcctcttcggcaaggggagtctggtaacatgcgctaagtttcaatgtttagagcccatagagggaaaagtggtccagtatgaaaatctgaagtacactgtgattatcaccgttcatacaggtgaccagcaccaggtgggcaacgagacccaaggggtcactgccgaaattacgcctcaggcatccacaaccgaggctatcctcccagaatatggaactcttggcctggagtgctctccgcgaaccggtttggacttcaatgagatgatcctactgacaatgaaaaacaaggcctggatggtgcatagacagtggtttttcgatctccccctgccttggaccagcggggcgactacagaaacgccaacctggaataggaaagagcttctggtaacttttaagaacgcccacgccaagaagcaagaagttgtggtcttgggctcccaggagggagctatgcacacagccctcaccggcgctacagaaattcaaaattcagggggaacaagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgttccctgtaaaatccctttctccactgaggacggccaaggtaaggcccataacgggcgtcttataaccgctaatccagtggtaactaagaaggaggaacccgtcaacattgaggcggaaccgcctttcggcgagtcaaatatcgtgatcggaattggcgataacgcattgaaaatcaattggtataagaaggggagcagtattggaaaaatgtttgaagccactgctcgcggtgccagaaggatggcaatactgggcgacaccgcctgggatttcgggtctgttggaggcgtgctcaactccctgggtaagatggtccaccagatctttgggagcgcttacacggcccttttctcgggcgtgtcttgggtaatgaaaattggaatcggcgtgctgttgacatggatcgggctcaattccaagaacacctcaatgagttttagctgcattgcaataggaatcattactctgtatttaggcgcggttgtccaggctgacatgggttgtgtgatcaattggaaagggaaggagctgaagtgcggatccggcattttcgtgacaaacgaggtccatacctggactgaacagtacaaatttcaagccgattctcccaagcggctagcaaccgccatcgctggtgcctgggagaatggcgtttgtgggatacgaagcacaacgcgcatggaaaacctcctgtggaaacagatcgcaaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggctaagatagtgacagccgaaactcaaaacagttccttcattatcgatggccccaataccccagagtgccccagcgcgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaactataggcccgggtaccatactcaaaccgcgggaccttggcaccttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaacctccgaaaaggaggagaatatggttaaatcactggtgagcgccggttctggcgaagtagacaacttcacgatgggggtgttgtgcctcgctattctgtttgaggaagtcatgcgcggaaagttcggcaagaaacatatgatcgccggggtgttctttactttcgttctactgctctccggacagatcacctggcgggatatggcacacacactgattatgatcggcagtaatgctagcgacagaatgggtatgggggtgacctaccttgccttgattgcaacttttaagatacagcccttcctggccttaggatttttcctcaggaaactgacatctcgcgagaaccttctgctaggcgtcggcctcgctatggcgaccacactgcaattgccggaagatatcgagcagatggccaatgggattgcactgggattaatggctctcaagctgatcactcagtttgagacctatcagctttggacggccctgatttccttgacatgttcaaacaccatcttcactctcaccgtggcctggcgaacagctactctgatactagccggtgttagtctgcttcctgtgtgccaaagctcgtccatgcggaaaaccgactggctcccaatgacggtcgccgcgatgggcgtaccccctctgcccttgtttatcttctctctgaaggatacattaaagcgtagaagctggccactcaatgaaggggtgatggctgttggactggtgtcaattcttgccagttccctgttgaggaacgacgtccctatggcaggccccctcgtggccggtgggctgctaatcgcttgttacgtaattaccggaacttctgcagatctgacagtggagaaagccgcggacgtcacctgggaagaggaagctgagcagactggcgttagccataaccttatgatcacagtggacgatgacggcaccatgcgcataaaggatgacgagacggaaaatattctcactgtgctgttgaaaaccgccttactgatcgtctccgggatctttccatactcaattccggcaacactcctggtgtggcacacctggcagaagcagacacaacggagcggagttctttgggatgtacctagtcccccagagactcagaaagccgaactggaggagggtgtgtatagaataaagcagcagggcatcttcgggaaaacccaagtcggagtgggcgttcagaaggaaggtgtgtttcatacgatgtggcacgtcacaagaggggctgtgttgacttacaacggaaagcgactagagcccaattgggcctctgtcaaaaaggacctgatttcctatggcggcgggtggcgcctcagcgcacagtggcaaaaaggagaagaggtccaggtgatcgctgttgaacctggtaagaaccccaaaaatttccagaccatgcccggcacattccagaccactaccggggagattggagccatcgcgctggattttaagcctggcacatcgggttcaccgataatcaaccgggaggggaagattgtgggactttacggcaatggcgtcgtgacgaaaaacgggggatatgtttctggtatcgcccaaactaatgcagaaccagacggccccacccctgagttagaagaggaaatgttcaagaaaagaaacctgacaattatggatctccacccagggagtggaaagaccaggaaatacttgcccgctatcgtgcgtgaggccataaagcgccggctgagaactctcattctggctcctacaagggtcgtggcagccgagatggaagaggcccttaagggcctgccgatccgatatcagaccacggctactaaatccgaacatacaggtcgggagatcgtagacttgatgtgccacgcgacctttaccatgcgcctactgagccccgtgagagttccaaattacaacctcattatcatggatgaagcacatttcactgaccctgcctctatagctgccagggggtacattagcacacgggtcggaatgggcgaggcagccgctatctttatgaccgcgacacccccaggcactgccgatgcattccctcagtccaatgctcccattcaggacgaggaacgagacatcccagagagatcatggaacagtgggaatgaatggataacggattttgccggaaagaccgtgtggttcgtgccgagcattaaagcaggtaacgacatcgccaactgtttacgcaagaatggcaaaaaggtcatccaactgtctaggaagacatttgatactgagtatcagaaaaccaaacttaacgactgggatttcgtagtgacaaccgacatttccgagatgggggctaattttaaagccgatcgtgttatcgaccctcggagatgcctgaagcccgtgattctcactgatggaccagaaagggtcatattggcgggccccatgcctgtgacggcagcctcagctgcccagcgccgaggtagagttgggcggaacccacagaaagagaatgaccaatacatcttcaccggccagcccctgaacaatgatgaagaccacgctcattggacagaggcaaagatgctcctggacaacattaatactcctgaaggaatcatcccggcccttttcgagccagagagggaaaagagtgctgccattgatggcgagtatcgcctaaaaggggaaagccgtaagacctttgtggagctgatgagacggggagacttgcccgtctggttagcacacaaagtggcgtccgaaggtataaagtacacagataggaaatggtgcttcgacggccagcgcaacaatcagatcctggaggagaacatggatgtagaaatttggaccaaggagggggagaaaaagaagctccgacctagatggctggacgcccggacttattctgatccccttgctctgaaagagtttaaggacttcgccgcaggaaggaaatcgatcgctctcgatttggtgacagaaattggccgcgttccaacgcacctggcccatagaaccaggaatgcactagacaacctggtcatgctccacactagcgagcatggtgggaaggcctaccggcacgctgtggaggaacttcctgagacaatggaaaccctgttattgctgggcctcatgatcctgcttaccggaggcgcgatgctgtttctcatatcagggaaaggaatcggtaagacatccattggcttgatctgtgtgattgccagttctgggatgctgtggatggcagagatccccttacaatggatagctagcgccattgtcctagagttctttatgatggttctgctcatcccagaacctgagaagcagcgtactccgcaggataatcaacttgcctatgtggtaattggaatcctgacgttggcagctataatcgccgcgaacgaaatgggcctgctcgagaccacaaaacgcgacctgggtatgtccaaggaacccggggtggtctcaccaacttcttaccttgatgtggacctccaccctgctagcgcctggaccctgtacgcagttgccacaaccgtgattactcccatgttgcgacatacgatcgagaatagtacagctaacgtctccctggcagccattgcgaaccaggctgtagtgttaatgggcctagacaaaggatggccaatcagcaagatggatctgggcgttcctctccttgccctggggtgctattctcaggtgaatcccttgaccctgactgcagccgtcctcctgcttataacccactacgctattatcggaccgggcttacaggccaaagcaacaagagaggctcaaaagaggactgccgcgggtatcatgaagaacccaaccgtggacgggattatgacaatcgatctggaccctgtcatatatgattcaaaattcgaaaagcagctcggacaggtgatgttgctggttctatgtgccgtgcagctgctccttatgcggacgtcctgggcactgtgcgaggctttgaccctggccactggccccattacaaccctctgggaaggtagtccaggcaaattttggaatactacaatcgcagtaagcatggctaacattttccgcgggtcgtacctggccggagccggcttagcgttttctgtgatgaagtccgtcgggaccggaaaaagaggcacgggtagccaaggggagacccttggagaaaagtggaagaaaaagctgaatcagctctcaaggaaagagttcgacctatataagaaaagtggcatcacagaggttgatcggactgaagctaaggagggtctgaaacgaggcgaaataacccatcacgcagtgtctagagggtccgccaagttgcagtggtttgtcgagcgcaacatggtgatccccgaaggaagggtaattgacctgggctgtgggcggggaggctggagctactattgcgctggtctcaagaaagtgacagaggttcgtgggtacactaagggaggccctggccatgaggaaccggtgcccatgtcaacctacgggtggaatatcgtcaaacttatgagtggaaaggatgtgttctatctgccacctgagaaatgtgacacattgctgtgcgatattggtgaaagctccccctctcctaccgtcgaggagagcagaactatcagggtgctcaagatggttgaaccatggttaaagaacaatcagttctgtattaaagtactgaacccctacatgcctacggtgatcgagcaccttgaacgcctgcaacggaagcacggcgggatgctagtccgaaatccactctccagaaactcaacacatgagatgtattggatatctaatggaaccggcaacattgtggccagtgttaatatggtgtcgaggctgttgctgaaccgctttactatgacccaccggagacccacaatcgaaaaagacgtcgatctcggtgcagggacgcgtcatgtgaacgccgagccggagacccctaatatggacgtaatcggagaaaggattaagcggataaaagaggaacacaacagcacttggcactacgacgatgagaatccatataagacatgggcttaccatggctcctatgaagtgaaggcgaccggctctgcctcaagcatgatcaacggggttgtcaaacttctgactaagccctgggacgtggtgcctatggtcacacagatggcaatgaccgatacaactccattcggacagcaacgcgtttttaaagagaaggtggacacccgaacgcccagatccatgccgggtaccaggcgggtaatgggcattacagctgagtggttatggcgcactctggggagaaataaaaagcctaggttgtgcacccgagaagagttcacaaagaaagtgcggactaacgccgcaatgggagccgtctttaccgaagagaatcagtgggatagtgctaaggccgcggtggaagacgaggatttctggaaactcgttgaccgtgagagagaactgcacaagctaggcaaatgtggttcttgcgtgtacaacatgatggggaagcgcgagaagaaacttggagaatttggcaaagcaaaaggcagcagggccatctggtacatgtggctgggggctcggtatctcgagttcgaggccctgggatttttgaatgaagatcattggttctcaagagagaactcctacagtggtgtcgaaggcgaggggctgcacaagctcggatatattcttcgcgacatcagcaaaatacccggcggtgcaatgtacgctgatgacacggccgggtgggacacaaggatcaccgaagatgacctgcataatgaggagaagattactcagcagatggatccagaacaccgacaattagctaacgccatctttaaactgacatatcagaataaggtggtaaaggttcagcggcctacccccactggaaccgtgatggacattatctctagaaaagatcagaggggctccggccaagtcgggacatacggattgaacacgttcaccaatatggaggcacagctcatacgccagatggaaggtgagggcgtgctgtcaaaggcggacctagaaaacccacaccttcccgagaaaaagattactcagtggctggagacaaaaggggtggaacgtctcaagcggatggccatcagcggagatgactgcgtcgttaagcctatcgatgacagatttgctaacgccctgttggcattaaatgatatgggcaaagtgaggaaggacattccacaatggcagccgtcgaaaggttggcatgattggcagcaggtacccttctgttctcaccatttccacgagctgataatgaaggacgggcgcaaactcgtggtcccttgccgaccacaagacgaacttatcggacgggctagaattagtcagggcgccggctggtccctgagggagaccgcatgtctagggaaggcctatgcgcagatgtggagcctgatgtactttcaccgcagagatctccggttggcttcaaacgccatctgctccgcagtgcccgttcattgggtgcctacttctaggacaacctggagcattcacgcccatcaccaatggatgacgacagaagacatgctgaccgtctggaatcgtgtgtggatcgaggataacccatggatggaggacaagactcccgtaaccacatgggaaaatgttccttaccttggaaaacgagaggatcagtggtgtggtagtctgataggcctcacttcccgcgctacctgggcccagaacatcccgacagcaattcagcaagtgaggagcttaatcgggaatgaagagttcctggactatatgccatctatgaagcggtttaggaaagaggaagagtcagaaggagctatttggtga

SEQ ID NO: 15523 - RNA, 9873 nt, synthetic construct
  misc_feature 1..9873: note = derived and/or modified CDS sequence (opt3) from DENV-3__FJ639795__SS-prME
  source 1..9873: mol_type = other RNA
accagcctgtgcctcatgatgatccttcccgccgctctggcattccacttgacatccagggacggcgagcctaggatgattgtggggaagaacgaacggggaaaatctttactgtttaagactgcctcaggtataaatatgtgtacgctaatcgcgatggatctcggcgaaatgtgcgacgataccgtcacctacaaatgtccacacattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatggggattacataccttgcattgatagccacctttaagatccagcccttcctggctttaggatttttcctcaggaaactgacttctcgcgagaaccttctgctaggcgtgggcctcgcgatggccacaaccctgcaattgccggaagatattgagcagatggcaaatgggatcgctctgggattaatggccctcaagctgattacacagtttgagacttatcagctttggaccgccctgatctccttgacgtgttcaaacacaatattcaccctcactgtcgcttggcgaaccgcaacactgatcctagccggtgtgagtctgcttcctgtttgccaaagctcgtccatgcggaaaactgactggctcccaatgaccgtggcggctatgggcgtcccacctctgcccttgtttattttctctctgaaggatacgttaaagcgtagaagctggccactcaatgaaggggtaatggccgtgggactggtttcaatccttgcaagttccctgttgaggaacgacgtgcctatggccggccccctcgtcgctggtgggctgctaattgcatgttacgtgatcacaggaacctctgccgatctgactgtagagaaagcggctgacgtgacatgggaagaggaagccgagcagaccggcgtcagccataaccttatgataactgttgacgatgacggcacaatgcgcattaaggatgacgagaccgaaaatatcctcacggtgctgttgaaaactgcattactgatcgtgtccgggatttttccatactcaataccggccaccctcctggtctggcacacatggcagaagcagacccaacggagcggagtgctttgggatgttcctagtcccccagagacacagaaagctgaactggaggagggtgtatatagaatcaagcagcagggcattttcgggaaaactcaagtgggagtcggcgtgcagaaggaaggtgtttttcataccatgtggcacgtgacgagaggggccgtcttgacatacaacggaaagcgactagagcccaattgggcatctgtgaaaaaggacctgatctcctatggcggcgggtggcgcctcagcgctcagtggcaaaaaggagaagaggtacaggtcattgccgtggaacctggtaagaaccccaagaatttccagactatgcccggcaccttccagacaaccactggggagatcggagcgatagccctggattttaagcctggcacctcgggttcaccgatcattaaccgggaggggaaggttgtgggactttacggcaatggcgtcgtgactaagaacgggggatatgtttctggtatcgcacaaacgaatgctgaaccagacggccccactcctgagttagaagaggaaatgttcaagaaaagaaacctgaccattatggatctccacccagggagtggaaagacaaggaaatacttgcccgccatcgtgcgtgaggctataaagcgccggctgagaaccctcattctggcacctactagggtcgtggccgccgagatggaagaggctcttaagggcctgccgatccgatatcagacaaccgcgacgaaatccgaacatactggtcgggagatcgtagacttgatgtgccacgcaacatttaccatgcgcctactgagccccgtgagagttccaaattacaacctcattatcatggatgaagcccatttcaccgaccctgcttctatagccgcaagggggtacattagcactcgggtcggaatgggcgaggccgctgcgatctttatgacagccacacccccaggcacagcagatgctttccctcagtccaatgcccccattcaggacgaggaacgagacatcccagagagatcatggaacagtgggaatgaatggataactgattttgcaggaaagacggtgtggttcgtgccgagcattaaagccggtaacgacatcgctaactgtttacgcaagaatggcaaaaaggtcatccaactgtctaggaagacctttgatacagagtatcagaaaactaaacttaacgactgggatttcgtagtgaccacagacatttccgagatgggggccaattttaaagcggatcgtgttatcgaccctcggagatgcctgaagcccgtgattctcaccgatggaccagaaagggtcatattggcaggccccatgcctgtgactgccgcttcagccgctcagcgccgaggtagagttgggcggaacccacagaaagagaatgaccaatacatcttcacgggccagcccctgaacaatgatgaagaccacgcacattggaccgaggccaagatgctcctggacaacattaatacacctgaaggaatcatcccggctcttttcgagccagagagggaaaagagtgccgcaattgatggcgagtatcgcctaaaaggggaaagccgtaagacttttgtggagctgatgagacggggagacttgcccgtctggttagcgcacaaagtggcctccgaaggtataaagtacaccgataggaaatggtgcttcgacggccagcgcaacaatcagatcctggaggagaacatggatgtagaaatttggacaaaggagggggagaaaaagaagctccgacctagatggctggacgctcggacctattctgatccccttgccctgaaagagtttaaggacttcgcagctggaaggaaatcgatcgccctcgatttggtgactgaaattggccgcgttccaacacacctggcacatagaacgaggaatgccctagacaacctggtcatgctccacaccagcgagcatggtgggaaggcttaccggcacgcggtggaggaacttcctgagactatggaaacactgttattgctgggcctcatgatcctgcttaccggaggcgccatgctgtttctcatatcagggaaaggaatcggtaagacctccattggcttgatctgtgtgattgcaagttctgggatgctgtggatggctgagatccccttacaatggatagccagcgccattgtcctagagttctttatgatggttctgctcatcccagaacctgagaagcagcgtacaccgcaggataatcaacttgcatatgtggtaattggaatcctgactttggctgccacgatagcggctaacgaaatgggcctgctcgagaccacaaaacgcgacctgggtatgtccaaggaacccggggtggtctcaccaacttcttaccttgatgtggacctccaccctgccagcgcatggaccctgtacgccgttgctacaaccgtgatcactcccatgttgcgacatacgattgagaatagtacagcaaacgtctccctggccgcgatcgctaaccaggccgtagtgttaatgggcctagacaaaggatggccaattagcaagatggatctgggcgttcctctccttgcactggggtgctattctcaggtgaatcccttgaccctgactgccgctgtcctcctgcttatcacccactacgccataattggaccgggcttacaggcaaaagctacaagagaggcccaaaagaggactgcggccggtatcatgaagaacccaaccgtggacgggatcatgacaattgatctggaccctgtcatctatgattcaaaattcgaaaagcagctcggacaggtgatgttgctggttctatgtgcagtgcagctgctccttatgcggacgtcctgggctctgtgcgaggccttgaccctggcaactggccccataacaaccctctgggaaggtagtccaggcaaattttggaatactacaattgctgtaagcatggccaacatcttccgcgggtcgtacctggccggagcgggcttagctttttctattatgaagtccgtggggaccggaaaaagaggcacgggtagccaaggggagacccttggagaaaagtggaagaaaaagctgaatcagctctcaaggaaagagttcgacctatataagaaaagtggcatcacagaggtcgatcggactgaagcaaaggagggtctgaaacgaggcgaaataacccatcacgccgtttctagagggtccgctaagttgcagtggtttgtggagcgcaacatggtcatccccgaaggaagggtgattgacctgggctgtgggcggggaggctggagctactattgcgccggtctcaagaaagtaacagaggtgcgtgggtacactaagggaggccctggccatgaggaaccggttcccatgtcaacctacgggtggaatatcgtgaaacttatgagtggaaaggatgtcttctatctgccacctgagaaatgtgacacattgctgtgcgatattggtgaaagctccccctctcctaccgtggaggagagcagaactatcagggtcctcaagatggtggaaccatggttaaagaacaatcagttctgtattaaagttctgaacccctacatgcctacggtaatcgagcaccttgaacgcctgcaacggaagcacggcgggatgctagtgcgaaatccactctccagaaactcaacacatgagatgtattggatatctaatggaaccggcaacattgtcgcaagtgtgaatatggtttcgaggctgttgctgaaccgctttactatgacccaccggagacccacaatcgaaaaagacgtggatctcggtgccgggacgcgtcatgtcaacgctgagccggagacccctaatatggacgtgatcggagaaaggattaagcggataaaagaggaacacaacagcacttggcactacgacgatgagaatccatataagacatgggcgtaccatggctcctatgaagtaaaggccaccggctctgcatcaagcatgatcaacggggtggttaaacttctgactaagccctgggacgtcgtgcctatggtgacacagatggctatgaccgatacaactccattcggacagcaacgcgtctttaaagagaaggttgacacccgaacgcccagatccatgccgggtaccaggcgggtgatgggcattacagccgagtggttatggcgcactctggggagaaataaaaagcctaggttgtgcacccgagaagagttcacaaagaaagtacggactaacgcagccatgggagctgtgtttaccgaagagaatcagtgggatagtgccaaggcggcagtcgaagacgaggatttctggaaactcgtggaccgtgagagagaactgcacaagctaggcaaatgtggttcttgcgtttacaacatgatggggaagcgcgagaagaaacttggagaatttggcaaagccaaaggcagcagggctatctggtacatgtggctgggggcccggtatctcgagttcgaggcactgggatttttgaatgaagatcattggttctcaagagagaactcctacagtggtgtggaaggcgaggggctgcacaagctcggatatattcttcgcgacatcagcaaaatacccggcggtgctatgtacgccgatgacacggctgggtgggacacaaggatcaccgaagatgacctgcataatgaggagaagattactcagcagatggatccagaacaccgacaattagccaacgcaatctttaaactgacatatcagaataaggtcgtgaaggtacagcggcctacccccactggaaccgttatggacattatctctagaaaagatcagaggggctccggccaagtggggacatacggattgaacacgttcaccaatatggaggcgcagctcatacgccagatggaaggtgagggcgtcctgctaaaggccgaccttgaaaacccacatctgcccgagaaaaagattactcagtggctcgagacaaaaggggtggaacgtctgaagcggatggctatctcaggagatgactgcgtggtcaagcctatcgatgacagatttgccaacgcattgttagctctgaatgatatgggcaaagttaggaaggacattccacaatggcagccgagcaaaggttggcatgattggcaacaggtgcccttctgttcgcaccatttccacgagctcataatgaaggacgggcgcaaacttgtagtgccttgccgaccacaagacgaactgatcggacgggccagaatttctcagggcgcaggctggagtctaagggagaccgcctgtctggggaaggcgtatgctcagatgtggtccctcatgtactttcaccgcagagatttgcggctggccagcaacgcaatctgctcagccgtccccgtgcattgggttcctacttccaggacaacctggtctattcacgctcatcaccaatggatgacgacagaagacatgcttaccgtgtggaatcgtgtctggatcgaggataacccatggatggaggacaagactcccgtgaccacatgggaaaatgtaccttacctgggaaaacgagaggatcagtggtgtggtagcctcataggcttaacaagtcgcgccacctgggcacagaacatcccgacagctattcagcaagttagatccctgatcgggaatgaagagttcttggactatatgccaagcatgaagcggtttaggaaagaggaagagtctgaaggagccatttggtga

SEQ ID NO: 15524 - RNA, 9873 nt, synthetic construct
  misc_feature 1..9873: note = derived and/or modified CDS sequence (opt3) from DENV-3__FJ639798__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccgtggagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaaattcctttctccacagaggacggccaaggtaaggctcataacgggcgtcttatcactgcgaatccagtagtcaccaaaaaggaggaacccgtgaacatagaggcagaaccgcctttcggcgagtcaaatattgttatcggaatcggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattccaagaacacatcaatgagttttagctgcatcgcgattggaataatcaccctgtatttaggcgctgtcgtgcaggccgacatgggttgtgtgattaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcgaagtggacaacttcacaatgggggtcttgtgcctcgccattctgtttgaggaagtgatgcgcggaaagttcggcaagaaacatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaagatacagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaaaacagactggctcccaatgactgtagcggctatgggcgtgccccctctgcccttgtttatcttctctctgaaggataccttaaagcgtagaagctggccactcaatgaaggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgagaaagcggctgacgttacttgggaagaggaagccgagcagacaggcgtgagccataaccttatgatcaccgtggacgatgacggcactatgcgcataaaggatgacgagacagaaaatattctcaccgtcctgttgaaaacggcattactgatcgtgtccgggatctttccatactcaattccggccactctcctggtttggcacacctggcagaagcagacacaacggagcggagtactttgggatgtgcctagtcccccagagacccagaaagctgaactggaggagggtgtctatagaataaagcagcagggcatcttcgggaaaacacaagtgggagttggcgtgcagaaggaaggtgtctttcatactatgtggcacgtgaccaggggggccgtattgacgtacaacggaaagcgactagagcccaattgggcatctgtcaaaaaggacctgatttcctatggcggcgggtggcgcctcagcgctcagtggcaaaaaggagaagaggtgcaggttatcgccgtggaacctggtaagaacccaaaaaatttccagacaatgcccggcactttccagaccacaaccggggagattggagcgatcgccctggattttaagcctggcacttcgggttcaccgataatcaaccgggaggggaaggtcgtgggactttacggcaatggcgttgtgaccaaaaacgggggatatgtctctggtattgcacaaacaaatgctgaaccagacggccccacgcctgagttagaagaggaaatgttcaagaaaagaaacctgactatcatggatctccacccagggagtggaaagaccaggaaatacttgcccgccattgtgcgtgaggctatcaagcgccggctgagaacactcatactggcacctaccagggtagtggccgccgagatggaagaggctcttaagggcctgccgattcgatatcagactacagcgaccaaatccgaacatacgggtcgggagatcgttgacttgatgtgccacgcaacttttacaatgcgcctactgagccccgtcagagtgccaaattacaacctcatcattatggatgaagcccatttcaccgaccctgcttctatcgccgcaagggggtacataagcacccgggtgggaatgggcgaggccgctgcgatttttatgactgccacacccccaggcaccgcagatgctttccctcagtccaatgcccccatccaggacgaggaacgagacattccagagagatcatggaacagtgggaatgaatggatcacagattttgcaggaaagactgtctggttcgtaccgagcataaaagccggtaacgacattgctaactgtttacgcaagaatggcaaaaaggtgatccaactgtctaggaagacgtttgataccgagtatcagaaaacaaagcttaacgactgggatttcgttgtgactaccgacatctccgagatgggggccaattttaaagcggatcgtgtcattgaccctcggagatgcctgaagcccgtgatcctcacagatggaccagaaagggttattttggcaggccccatgcctgtgaccgccgcttcagccgctcagcgccgaggtagagtcgggcggaacccacagaaagagaatgaccaatacatattcactggccagcccctgaacaatgatgaagaccacgcacattggacggaggccaagatgctcctggacaacatcaatacccctgaaggaattatcccggctcttttcgagccagagagggaaaagagtgccgcaatcgatggcgagtatcgcctaaaaggggaaagccgtaagacatttgtggagctgatgagacggggagacttgcccgtatggttagcgcacaaagtggcctccgaaggtattaagtacactgataggaaatggtgcttcgacggccagcgcaacaatcagatactggaggagaacatggatgttgaaatctggaccaaggagggggaaaaaaagaagctccgacctagatggctggacgctcggacatattctgatccccttgccctgaaagagtttaaggacttcgcagctggaaggaaatcgattgccctcgatttggtcaccgaaatcggccgcgtgccaactcacctggcacatagaacaaggaatgccctagacaacctggtgatgctccacacgagcgagcatggtgggaaggcttaccggcacgcggtcgaggaacttcctgagaccatggaaactctgttattgctgggcctcatgattctgcttacaggaggcgccatgctgtttctcatctcagggaaaggaataggtaagacctccatcggcttgatttgtgttatcgcaagttctgggatgctgtggatggctgagattcccttacaatggatcgccagcgccatagtgctagagttctttatgatggtactgctcattccagaacctgagaagcagcgtaccccgcaggataatcaacttgcatatgtggtcatcggaattctgacattggctgccactatcgcggctaacgaaatgggcctgctcgagacgaccaaacgcgacctgggtatgtccaaggaacccggggtggtttcaccaacatcttaccttgatgtggacctccaccctgccagcgcatggactctgtacgccgtcgctaccacagtaataacccccatgttgcgacatactatcgagaatagtacggcaaacgtgtccctggccgcgattgctaaccaggccgttgtgttaatgggcctagacaaaggatggccaatcagcaagatggatctgggcgtccctctccttgcactggggtgctattctcaggtgaatcccttgacactgaccgccgctgtcctcctgcttattactcactacgccatcataggaccgggcttacaggcaaaagctaccagagaggcccaaaagaggacagcggccggtattatgaagaacccaactgtggacgggatcatgaccatcgatctggaccctgttatttatgattcaaaattcgaaaagcagctcggacaggtgatgttgctggtactatgtgcagtgcagctgctccttatgcggacatcctgggctctgtgcgaggccttgacgctggcaaccggccccatcactacactctgggaaggtagtccaggcaaattttggaataccactatagctgtcagcatggccaacattttccgcgggtcgtacctggccggagcgggcttagctttttctatcatgaagtccgttgggacaggaaaaagaggcaccggtagccaaggggagacgcttggagaaaagtggaagaaaaagctgaatcagctctcaaggcgggagttcgacctatataaaaagagtggcattaccgaggtggatcgaacagaagcaaaagagggtctgaagagaggcgaaatcactcatcacgccgtctctcgcgggtccgctaaattgcagtggtttgtggagaggaacatggtaatacccgaaggacgggtgatcgacctgggctgtgggcgtggaggctggagctactattgcgccggtctcaagaaggttaccgaggtgagagggtacacaaaaggaggccctggccatgaggaaccggtccccatgtcaacttacgggtggaatattgtgaagcttatgagtggaaaagatgtcttctatctgccacctgagaagtgtgacaccttgctgtgcgatatcggtgaaagctccccctctcctacagtggaggagagcaggaccattcgcgttctcaaaatggtagaaccatggttaaagaacaatcagttctgtatcaaggtgctgaacccctacatgcctactgtcattgagcaccttgaacggctgcaacgaaaacacggcgggatgctagtgagaaatccactctccaggaactcaacgcatgagatgtattggatctctaatggaacaggcaacatagttgcaagtgtgaatatggtctcgcgcctgttgctgaaccggtttaccatgactcacagacgtcccaccattgaaaaggacgtggatctcggtgccgggacaaggcatatcaacgctgagccggagacgcctaatatggacgtaatcggagaacggattaaacgcataaaggaggaacacaacagcacctggcactacgacgaggaaaatccatataaaacttgggcgtaccatggctcctatgaggtgaaggccacaggctctgcatcaagcatgatcaacggggttgtcaagcttctgaccaaaccctgggatgtggtgcctatggtcactcagatggctatgacagacaccacaccattcggacagcaacgagtttttaaggagaaagtggatactagaacccccaggccgatgcctggtacgcggcgcgtaatgggcattaccgccgaatggttatggagaacactggggaggaataagaaaccccgattgtgcactcgggaggaattcaccaagaaggtgcgtacaaacgcagccatgggagctgtctttactgaggaaaatcagtgggactccgccaaagcggcagtggaggatgaggacttctggaagctcgttgatagagaacgcgagctgcacaaactaggcaagtgtggtagttgcgtgtacaacatgatggggaaaagggaaaagaaacttggagagtttggcaaggccaagggctctcgggctatctggtacatgtggctgggggccagatatctcgagttcgaagcactgggatttttgaatgaggaccattggttcagccgcgaaaactcatactccggtgtcgagggcgaagggctgcacaaactcggatatattcttagggatatcagtaagataccaggcggtgctatgtacgccgacgataccgctgggtgggacacgcgaatcacagaggacgatctgcataatgaggaaaaaattacccagcagatggaccctgagcaccggcaattagccaacgcaatctttaagctgacttatcagaataaagtggtaaaggttcagagacccacaccaaccggaactgtgatggatattatcagcaggaaggaccagcgcggctctggccaagtcgggacctacggattgaacacattcacgaatatggaagcgcagctcatacgtcagatggagggtgaaggcgtgctgtccaaagccgatctagagaacccccaccttcctgagaagaaaattacccagtggctggaaactaagggggtggagcggctcaaaagaatggctatctcaggagacgattgcgtcgttaagccaatcgacgataggtttgccaacgcactgttggctttaaatgacatgggcaaggtgcgcaaagatattccgcaatggcagcccagcaagggttggcatgactggcagcaggtacctttctgttcgcaccatttccacgaactgataatgaaagatgggcgaaagctcgtggtcccatgccggccccaagacgagcttatcggaagagccaggatttctcagggcgcaggctggagtctgcgcgaaacagcctgtctagggaaagcgtatgctcagatgtggtccctgatgtactttcacagacgggacctcaggttggccagcaacgcaatctgctcagccgtgcctgttcattgggtgccaacctcccgtactacatggtctattcacgctcatcaccaatggatgaccacggaggatatgctgacagtctggaatcgagtgtggatcgaggacaacccctggatggaagataagacccctgtaactacctgggagaatgttccgtaccttggaaagcgcgaagaccagtggtgtggtagcctgataggcctcacaagtagagccacttgggcacagaacatcccaaccgctattcagcaagtgcggtccttaatcgggaatgaggagttcctggattatatgcccagcatgaaaaggtttcgcaaggaagaggaatctgagggagccatttggtga

SEQ ID NO: 15525 - RNA, 9873 nt, synthetic construct
  misc_feature 1..9873: note = derived and/or modified CDS sequence (opt3) from DENV-3__FJ639799__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacgtcacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaaattcctttctccacagaggacggccaaggtaaggctcataacgggcgtcttatcactgcgaatccagtagtcaccaaaaaggaggaacccgtgaacatagaggcagaaccgcctttcggcgagtcaaatattgttatcggaatcggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattccaagaacacatcaatgagttttagctgcatcgcgattggaataatcaccctgtatttaggcgctgtcgtgcaggccgacatgggttgtgtgattaattggaaagggaaggagctgaagtgcggatccggcatcttcgtcactaacgaggttcatacatggaccgaacagtacaaatttcaagcagattctcccaagcggctagccactgctattgccggtgcatgggagaatggcgtgtgtgggatccgaagcaccacacgcatggaaaacctcctgtggaaacagatagctaatgagcttaactatatcttgtgggaaaataacattaagctgacggtggtagtcggagacatcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcgaagtggacaacttcacaatgggggtcttgtgcctcgccattctgtttgaggaagtgatgcgcggaaagttcggcaagaaacatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaagatacagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaaaacagactggctcccaatgactgtagcggctatgggcgtgccccctctgcccttgtttatcttctctctgaaggataccttaaagcgtagaagctggccactcaatgaaggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgagaaagcggctgacgttacttgggaagaggaagccgagcagacaggcgtgagccataaccttatgatcaccgtggacgatgacggcactatgcgcataaaggatgacgagacagaaaatattctcaccgtcctgttgaaaacggcattactgatcgtgtccgggatctttccatactcaattccggccactctcctggtttggcacacctggcagaagcagacacaacggagcggagtactttgggatgtgcctagtcccccagagacccagaaagctgaactggaggagggtgtctatagaataaagcagcagggcatcttcgggaaaacacaagtgggagttggcgtgcagaaggaaggtgtctttcatactatgtggcacgtgaccaggggggccgtattgacgtacaacggaaagcgactagagcccaattgggcatctgtcaaaaaggacctgatttcctatggcggcgggtggcgcctcagcgctcagtggcaaaaaggagaagaggtgcaggttatcgccgtggaacctggtaagaacccaaaaaatttccagacaatgcccggcactttccagaccacaaccggggagattggagcgatcgccctggattttaagcctggcacttcgggttcaccgataatcaaccgggaggggaaggtcgtgggactttacggcaatggcgttgtgaccaaaaacgggggatatgtctctggtattgcacaaacaaatgctgaaccagacggccccacgcctgagttagaagaggaaatgttcaagaaaagaaacctgactatcatggatctccacccagggagtggaaagaccaggaaatacttgcccgccattgtgcgtgaggctatcaagcgccggctgagaacactcatactggcacctaccagggtagtggccgccgagatggaagaggctcttaagggcctgccgattcgatatcagactacagcgaccaaatccgaacatacgggtcgggagatcgttgacttgatgtgccacgcaacttttacaatgcgcctactgagccccgtcagagtgccaaattacaacctcatcattatggatgaagcccatttcaccgaccctgcttctatcgccgcaagggggtacataagcacccgggtgggaatgggcgaggccgctgcgatttttatgactgccacacccccaggcaccgcagatgctttccctcagtccaatgcccccatccaggacgaggaacgagacattccagagagatcatggaacagtgggaatgaatggatcacagattttgcaggaaagactgtctggttcgtaccgagcataaaagccggtaacgacattgctaactgtttacgcaagaatggcaaaaaggtgatccaactgtctaggaagacgtttgataccgagtatcagaaaacaaagcttaacgactgggatttcgttgtgactaccgacatctccgagatgggggccaattttaaagcggatcgtgtcattgaccctcggagatgcctgaagcccgtgatcctcacagatggaccagaaagggttattttggcaggccccatgcctgtgaccgccgcttcagccgctcagcgccgaggtagagtcgggcggaacccacagaaagagaatgaccaatacatattcactggccagcccctgaacaatgatgaagaccacgcacattggacggaggccaagatgctcctggacaacatcaatacccctgaaggaattatcccggctcttttcgagccagagagggaaaagagtgccgcaatcgatggcgagtatcgcctaaaaggggaaagccgtaagacatttgtggagctgatgagacggggagacttgcccgtatggttagcgcacaaagtggcctccgaaggtattaagtacactgataggaaatggtgcttcgacggccagcgcaacaatcagatactggaggagaacatggatgttgaaatctggaccaaggagggggaaaaaaagaagctccgacctagatggctggacgctcggacatattctgatccccttgccctgaaagagtttaaggacttcgcagctggaaggaaatcgattgccctcgatttggtcaccgaaatcggccgcgtgccaactcacctggcacatagaacaaggaatgccctagacaacctggtgatgctccacacgagcgagcatggtgggaaggcttaccggcacgcggtcgaggaacttcctgagaccatggaaactctgttattgctgggcctcatgattctgcttacaggaggcgccatgctgtttctcatctcagggaaaggaataggtaagacctccatcggcttgatttgtgttatcgcaagttctgggatgctgtggatggctgagattcccttacaatggatcgccagcgccatagtgctagagttctttatgatggtactgctcattccagaacctgagaagcagcgtaccccgcaggataatcaacttgcatatgtggtcatcggaattctgacattggctgccatcatagcggctaacgaaatgggcctgctcgagactacgaaacgcgacctgggtatgtcccgagaacccggggtggtttcaccaacctcttaccttgatgtggacctccaccctgccagcgcatggacactgtacgccgtcgctactaccgtaatcacacccatgttgagacataccattgagaatagtactgcaaacgtgtccctggccgcgatcgctaaccaggccgttgtgttaatgggcctagacaagggatggccaattagcaaaatggatctgggcgtccctctccttgcactggggtgctattctcaggtgaatcccttgacgctgacagccgctgtcctcctgcttatcacccactacgccataattggaccgggcttacaggcaaaggctactagggaggcccaaaaacggaccgcggccggtatcatgaagaacccaacagtggacgggatcatgactattgatctggaccctgttatctatgattcaaagttcgaaaaacagctcggacaggtgatgttgctggtactatgtgcagtgcagctgctccttatgcgcacctcctgggctctgtgcgaggccttgacactggcaacgggccccataaccactctctgggaaggtagtccaggcaagttttggaatacaaccattgctgtcagcatggccaacatcttcagagggtcgtacctggccggagcgggcttagctttttctattatgaaatccgttgggactggaaagaggggcacaggtagccaaggggagacccttggagaaaaatggaagaagaaactgaatcagctctcacggaaggagttcgacctatataaaaagagtggcatcacggaggtggatcgaaccgaagcaaaagagggtctgaagagaggcgaaataacacatcacgccgtctctcgcgggtccgctaaattgcagtggtttgtggagaggaacatggtaatccccgaaggacgggtgattgacctgggctgtgggcgtggaggctggagctactattgcgccggtctcaagaaggttactgaggtgagagggtacaccaaaggaggccctggccatgaggaaccggtccccatgtcaacatacgggtggaatatcgtgaagcttatgagtggaaaagatgtcttctatctgccacctgagaagtgtgacactttgctgtgcgatattggtgaaagctccccctctcctaccgtggaggagagcaggacaatccgcgttctcaaaatggtagaaccatggttaaagaacaatcagttctgtattaaggtgctgaacccctacatgcctgcagtcatcgagcaccttgaacggctgcaacgaaaacacggcgggatgctagtgagaaatccactctccaggaactcaacccatgagatgtattggatatctaatggaactggcaacattgttgccagtgtgaatatggtctcgcgcctgttgctgaaccggtttacgatgacacacagacgtcccaccatcgaaaaggacgtggatctcggtgctgggactaggcatgtaaacgcggagccggagacccctaatatggacgtgatcggagaacggattaaacgcataaaggaggaacacaacagcacatggcactacgacgatgagaatccatataaaacgtgggcctaccatggctcctatgaagttaaggcaaccggctctgcttcaagcatgatcaacggggtcgtgaagcttctgactaaaccctgggacgtggtccctatggttacacagatggccatgaccgatactacaccattcggacagcaacgagtgtttaaggagaaagtagacaccagaacacccaggtccatgccgggtactcggcgcgtgatgggcattaccgcagagtggttatggagaacgctggggaggaataagaaacctcgattgtgcacccgggaagagttcacaaagaaggtccgtactaacgccgctatgggagccgtgtttaccgaagagaatcagtgggatagtgcgaaagcagccgttgaagacgaggatttctggaagctcgtggacagagagcgcgaactgcacaaactaggcaagtgtggttcttgcgtctacaacatgatggggaaaagggagaagaaacttggagaatttggcaaggctaagggcagccgggccatctggtacatgtggctgggggcaagatatctcgagttcgaggctctgggatttttgaatgaagatcattggttctcacgcgagaactcctacagtggtgtggaaggcgaggggctgcacaaactcggatatattcttagggacatcagcaagatacccggcggtgccatgtacgctgatgacacagccgggtgggacactcgaatcaccgaagatgacctgcataatgaggagaaaattacgcagcagatggatccagaacaccggcaattagcaaacgcgatctttaagctgacatatcagaataaagtagttaaggtgcagagacctacccccactggaacagtcatggacattatctctaggaaggatcagcgcggctccggccaagtggggacctacggattgaacactttcaccaatatggaggcccagctcatacgtcagatggaaggtgagggcgtgctgtcaaaagctgacctagaaaacccacaccttcccgagaagaaaattacacagtggctggagacgaagggggtcgaacggctcaaaagaatggccatcagcggagatgactgcgttgtgaagcctatcgatgacaggtttgcaaacgctctgttggccttaaatgatatgggcaaggtacgcaaagacattccacaatggcagccgtcgaagggttggcatgattggcagcaggtgcccttctgttctcaccatttccacgagctgataatgaaagacgggcgaaagctcgtcgtgccttgccggccacaagacgaacttatcggaagagcaaggattagtcagggcgccggctggtccctgcgcgagaccgcgtgtctagggaaagcttatgcccagatgtggagcctgatgtactttcacagacgggatctcaggttggcatcaaacgccatctgctccgctgttcccgtgcattgggtccctacttctcgtacaacctggagcattcacgcccatcaccaatggatgactacagaagacatgctgaccgtgtggaatcgagtatggatcgaggataacccatggatggaggacaagacgcccgttacaacctgggaaaatgtgccttaccttggaaagcgcgaggatcagtggtgtggtagtctgataggcctcacttccagagcaacctgggctcagaacatcccgacagccattcagcaagtccggagcttaatcgggaatgaagagttcctggactatatgccatctatgaaaaggtttcgcaaggaggaagagtcagaaggagcgatttggtga

SEQ ID NO: 15526 - RNA, 9873 nt, synthetic construct
  misc_feature 1..9873: note = derived and/or modified CDS sequence (opt3) from DENV-3__FJ639800__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaagtgcagaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaaattcctttctccacagaggacggccaaggtaaggctcataacgggcgtcttatcactgcgaatccagtagtcaccaaaaaggaggaacccgtgaacatagaggcagaaccgcctttcggcgagtcaaatattgttatcggaatcggcgataacgccttgcgcattaattggtataaaaaggggagcagtatcggaaagatgtttgaagctacagccagaggtgcaaggcggatggccattctgggcgacactgcttgggatttcgggtctgtgggaggcgtcctcaactccctgggtaaaatggtgcaccagatatttgggagcgcctacaccgcacttttctcgggcgtatcttgggtgatgaagatcggaattggcgttctgttgacgtggatcgggctcaattccaaaaacacatcaatgagttttagctgcatcgcgattggaataatcaccctgtatttaggcgctgtcgtgcaggccgacatgggttgtgtgattaattggaaggggaaagagctgaagtgcggatccggcatcttcgtcactaacgaggttcatacatggaccgaacagtacaagtttcaagcagattctcccaaacgactagccactgctattgccggtgcatgggagaatggcgtgtgtgggatccgcagcaccacaagaatggaaaacctcctgtggaagcagatagctaatgagcttaactatatcttgtgggaaaataacattaaactgacggtggtagtcggagacaccatcggcgtgctcgagcaggggaagaggactctgacaccacagcctatggagttaaaatactcatggaagacctggggaaaagccaagattgttacagcggaaactcaaaacagttccttcatcatagatggccccaataccccagagtgccccagcgcctctcgggcttggaacgtgtgggaagtcgaggactatggttttggggtgttcacgacaaatatttggctgaagcttcgcgaagtttacacccagttgtgtgaccacagactcatgtcagcagccgtgaaagatgagagggctgtacacgccgacatgggatactggatcgagagtcagaagaacggcagctggaaactggaaaaggcatccctaattgaggtcaaaacttgcacctggcctaagtctcatacactgtggtcgaatggtgtgctcgaaagcgatatgatcataccaaagtccctggcgggcccgatctcacagcacaactatcgtcccgggtaccatactcaaaccgccggaccttggcaccttggcaaattggagctggactttaattattgcgaggggacaacggtggtcattaccgaaaactgtggaactcggggcccaagtttacgaacaaccactgtttctggtaagctcatccacgagtggtgctgtagaagctgcacactgccccctcttaggtacatgggggaagatggatgttggtatggcatggagattcgcccaatctccgaaaaagaggagaatatggtgaagtcactggtaagcgctggttctggcgaagtggacaacttcaccatgggggtcttgtgcctcgccatactgtttgaggaagtgatgcggggaaaattcggcaagaagcatatgattgcaggggttttctttacgttcgtgctactgctctccggacagatcacttggagagatatggctcacaccctgatcatgattggcagtaatgccagcgacaggatgggtatgggggtcacataccttgcattgatcgccacctttaaaattcagcccttcctggctttaggatttttcctccgcaagctgacttctcgagagaaccttctgctaggcgtgggcctcgcgatggccacaaccctgcaattgccggaagatatagagcagatggcaaatgggatcgctctgggattaatggccctcaaactgattacacagtttgagacttatcagctttggaccgccctgatctccttgacgtgttcaaacacaattttcaccctcactgttgcttggcggaccgcaacactgatcctagccggtgtgagtctgcttcctgtctgccaaagctcgtccatgcgtaagactgactggctcccaatgaccgtagcggctatgggcgtgccccctctgcccttgtttatattcaatctgaaagatacgttaaagagaaggtcttggccactcaacgaaggggttatggccgtgggactggtcagcatccttgcatcaagtctgttgcgcaacgacgtgcctatggccggccccctcgtagctggtgggctgctaattgcatgttacgtgatcacaggaacctccgccgatctgactgtcgagaaggcggctgacgttacatgggaagaggaagccgagcagaccggcgtgtctcataatcttatgattactgtggacgatgacggcacaatgcggatcaaagatgacgagaccgaaaacatactcacggtcctgttgaagactgcattactgattgtgagcgggatctttccatactccatcccggccaccctcctggtttggcacacatggcagaaacagacccaaagatcaggagtactttgggatgtgcctagccccccagagacacagaaggctgaactggaggagggtgtctataggattaaacagcagggcatattcgggaagactcaagtgggagttggcgtgcagaaagaaggtgtctttcataccatgtggcacgtgacgcgaggggccgtattgacatacaatggaaagcgcctagagcccaactgggcaagtgtcaagaaagacctgatctcttatggcggcgggtggcggctctccgctcagtggcaaaagggagaagaggtgcaggttattgccgtggaacctggtaaaaatccaaagaacttccagactatgcccggcaccttccagacaaccactggggagatcggagcgattgccctggattttaaacctggcaccagcggttcgccgatcataaatagagaggggaaggtcgtgggactttacggcaacggcgttgtgacaaagaatgggggatatgtctcaggtatcgcacaaacgaacgctgaaccagacggccccactcctgagttagaagaggaaatgttcaaaaagaggaatctgaccattatggatctccacccagggtctggaaaaacacgtaagtacttgcccgccatcgtgcgcgaggctattaaacggagactgaggaccctcatcctggcacctactcgagtagtggccgccgagatggaagaggctcttaagggcctgccgatacggtatcagacaaccgcgacgaagagtgaacatactggtcgcgagattgttgacttgatgtgccacgcaacatttaccatgagactactgtcccccgtcagggtgccaaactacaatctcatcatcatggatgaagcccatttcaccgaccctgctagcattgccgcacgggggtacatctctactcgagtgggaatgggcgaggccgctgcgatatttatgacagccacccccccaggcacagcagatgctttccctcagagcaacgcccccattcaggacgaggaaagagacatcccagagcgctcctggaattcagggaacgaatggattactgattttgcaggaaaaacggtctggttcgtaccgagtatcaaggccggtaacgacatagctaattgtttaaggaaaaacggcaagaaagtgattcaactgagccgtaagacctttgatacagagtatcagaagactaaacttaatgactgggatttcgttgtgaccacagacatctctgagatgggggccaactttaaggcggatcgggtcatcgaccctagaaggtgcctgaaacccgtgattctcaccgatggaccagaacgcgttatcttggcaggccccatgcctgtgactgccgcttccgccgctcagcgaagaggtcgggtcgggaggaatccacagaaggagaacgaccaatacattttcacgggccagcccctgaataacgatgaagaccacgcacattggaccgaggccaaaatgctcctggacaatataaacacacctgaaggaatcattccggctcttttcgagccagagcgcgaaaagtcagccgcaatcgatggcgagtatcgtctaaagggggaaagtagaaaaacttttgtggagctgatgcggaggggagacttgcccgtatggttagcgcacaaggtggccagcgaaggtatcaaatacaccgatcgcaagtggtgcttcgacggccagcgaaataaccagattctggaggagaatatggatgttgaaatatggacaaaagagggggaaaagaaaaagctcagacctcggtggctggacgctaggacctattccgatccccttgccctgaaggagtttaaagacttcgcagctggacgcaagtctatcgccctcgatttggtcactgaaattggcagagtgccaacacacctggcacataggacgcggaacgccctagacaatctggtgatgctccacacctcggagcatggtgggaaagcttaccgtcacgcggtcgaggaacttcctgagactatggaaacactgttattgctgggcctcatgatcctgcttaccggaggcgccatgctgtttctcattagcgggaagggaatcggtaaaacctcaataggcttgatctgtgttattgcatccagtgggatgctgtggatggctgagatccccttacaatggattgcctctgccatcgtgctagagttctttatgatggtactgctcataccagaacctgagaagcagcgcacaccgcaggataaccaacttgcatatgtggtcattggaatcctgactttggctgccattatcgcggctaatgaaatgggcctgctcgagacgaccaagcgagacctgggtatgagcaaagaacccggggtggtttccccaacatcataccttgatgtggacctccaccctgcctctgcatggactctgtacgccgtcgctaccacagtaataacccccatgttgagacatactatcgagaacagcacggcaaacgtgagtctggccgcgattgctaatcaggccgttgtgttaatgggcctagacaagggatggccaatctccaaaatggatctgggcgtccctctccttgcactggggtgctatagccaggtgaaccccttgacactgaccgccgctgtcctcctgcttattactcactacgccatcataggaccgggcttacaggcaaaggctaccagggaggcccaaaaacggacagcggccggtattatgaagaatccaactgtggacgggatcatgaccatcgatctggaccctgttatttatgattctaagttcgaaaaacagctcggacaggtgatgttgctggtactatgtgcagtgcagctgctccttatgcgcacatcatgggctctgtgcgaggccttgacgctggcaaccggccccatcactacactctgggaaggttccccaggcaagttttggaacaccactatagctgtcagtatggccaatattttcagagggagctacctggccggagcgggcttagctttttcgatcatgaaatctgttgggacaggaaagaggggcaccggttcccaaggggagacgcttggagaaaaatggaagaagaaactgaaccagctcagccggaaggagttcgacctatataaaaagtcaggcattaccgaggtggatcgaacagaagcaaaagagggtctgaagagaggcgaaatcactcatcacgccgtcagtcgcgggtctgctaaattgcagtggtttgtggagaggaatatggtaatacccgaaggacgggtgatcgacctgggctgtgggcgtggaggctggtcctactattgcgccggtctcaagaaggttaccgaggtgagagggtacacaaaaggaggccctggccatgaggaaccggtccccatgagcacttacgggtggaacattgtgaagcttatgtcaggaaaagatgtcttctatctgccacctgagaagtgtgacaccttgctgtgcgatatcggtgaaagtagcccctcccctacagtggaggagtctaggaccattcgcgttctcaaaatggtagaaccatggttaaagaataaccagttctgtatcaaggtgctgaatccctacatgcctactgtcattgagcaccttgaacggctgcaacgaaaacacggcgggatgctagtgagaaacccactcagcaggaattccacgcatgagatgtattggatctcaaacggatctggcaatatagttgcaagtgtgaacatggtctcgcgcctgttgctgaaccggtttacaatgacccacagacgtcccactattgaaaaggacgtggatctcggtgccgggaccaggcatgtaaatgctgagccggagacacctaacatggacgtgatcggagaacggatcaaacgcattaaggaggaacacaatagcacgtggcactacgacgatgagaacccatataaaacctgggcgtaccatggctcctatgaagttaaggccactggctctgcatcaagcatgataaatggggtcgtgaagcttctgacaaaaccctgggacgtggtccctatggttacccagatggctatgactgatacaaccccattcggacagcaacgagtgtttaaggagaaagtagacacaagaactcccaggtccatgccgggtacccggcgcgtgatgggcatcacggccgagtggttatggagaaccctggggaggaacaagaaacctcgattgtgcacacgggaagagttcactaagaaggtccgtaccaatgcagccatgggagctgtgtttacagaagagaaccagtgggatagtgccaaagcggcagttgaagacgaggatttctggaagctcgtggacagagagcgcgaactgcacaaactaggcaagtgtggttcttgcgtctacaatatgatggggaaaagggagaagaaacttggagaatttggcaaggccaagggcagccgggctatttggtacatgtggctgggggccagatatctcgagttcgaggcactgggatttttgaacgaagatcattggttctcacgcgagaattcctacagtggtgtggaaggcgaggggctgcacaaactcggatatatccttagggacattagcaagatccccggcggtgctatgtacgccgatgacactgctgggtgggacacccgaataacggaagatgacctgcataacgaggagaaaatcacacagcagatggatccagaacaccggcaattagccaatgcaatttttaagctgacctatcagaacaaagtagttaaggtgcagagacctactcccacaggaaccgtcatggacatcatttctaggaaggatcagcgcggctccggccaagtggggacttacggattgaataccttcacaaacatggaggcgcagctcatccgtcagatggaaggtgagggcgtgctgtcaaaagccgacctagaaaacccacaccttcccgagaagaaaataacgcagtggctggagaccaagggggtcgaacggctcaaaagaatggctattagcggagatgactgcgttgtgaagcctatcgatgacaggtttgccaatgcactgttggctttaaacgatatgggcaaggtacgcaaagacatcccacaatggcagccgtcgaagggttggcatgattggcagcaggtgcccttctgttctcaccatttccacgagctgattatgaaagacgggcgaaagctcgtcgtgccttgccggccacaagacgaacttataggaagagccaggatcagtcagggcgcaggctggtccctgcgcgagactgcctgtctagggaaagcgtatgctcagatgtggagcctgatgtactttcacagacgggatctcaggttggcctcaaatgcaatttgctccgccgttcccgtgcattgggtccctacatctcgtaccacttggagcatccacgctcatcaccaatggatgacaaccgaagacatgctgacggtgtggaaccgagtatggattgaggataatccatggatggaggacaagacacccgttaccacttgggaaaacgtgccttaccttggaaagcgcgaggatcagtggtgtggtagtctgatcggcctcacctccagagccacatgggcacagaatataccgactgctatccagcaagtccggagcttaattgggaacgaagagttcctggactatatgccatctatgaaaaggtttcgcaaggaggaagagtcagaaggagccatctggtga

SEQ ID NO: 15527 - RNA, 9873 nt, synthetic construct
  misc_feature 1..9873: note = derived and/or modified CDS sequence (opt3) from DENV-3__FJ639801__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaagatacagcccttcctggctttaggatttttcctcaggaaactgacttctcgcgagaaccttctgctaggcgtcggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaaaactgactggctcccaatgaccgtcgcggctatgggcgtaccccctctgcccttgtttatcttctctctgaaggatacgttaaagcgtagaagctggccactcaatgaaggggtgatggccgttggactggtgtcaattcttgcaagttccctgttgaggaacgacgtccctatggccggccccctcgtggctggtgggctgctaatcgcatgttacgtaattacaggaacctctgccgatctgactgtggagaaagcggctgacgtcacatgggaagaggaagccgagcagaccggcgttagccataaccttatgatcactgtggacgatgacggcacaatgcgcataaaggatgacgagaccgaaaatattctcacggtgctgttgaaaactgcattactgatcgtctccgggatctttccatactcaattccggccaccctcctggtgtggcacacatggcagaagcagacccaacggagcggagttctttgggatgtacctagtcccccagagacacagaaagctgaactggaggagggtgtgtatagaataaagcagcagggcatcttcgggaaaactcaagtcggagtgggcgttcagaaggaaggtgtgtttcataccatgtggcacgtcacgaggggggccgtgttgacatgcaacggaaagcgactagagcccaattgggcatctgtaaaaaaggacctgatttcctacggcggcgggtggcgcctcagcgctcagtggcaaaaaggagaagaggtccaggtgatcgccgttgaacctggtaagaacccaaaaaatttccagactatgcccggcaccttccagacaaccactggggagattggagcgatcgccctggattttaagcctggcacctcgggttcaccgataatcaaccgggaggggaaggtggtcggactttatggcaatggcgtggttacaaaaaacgggggatacgtgtctggtattgcacaaacgaatgctgaaccagacggccccactcctgagttagaagaggaaatgttcaagaaaagaaacctgaccatcatggatctccacccagggagtggaaagacaaggaaatatttgcccgccattgtccgtgaggctatcaagcgccggctgagaaccctcatactggcacctactagggtggtagccgccgagatggaagaggctcttaagggcctgccgattcgataccagacaaccgcgacgaaatccgaacatactggtcgggagatcgtggacttgatgtgtcacgcaacatttaccatgcgcctactgagccccgttagagtcccaaattataacctcatcattatggatgaagcccatttcaccgaccctgcttctatcgccgcaagggggtacataagcactcgggtgggaatgggcgaggccgctgcgatttttatgacagccacccccccaggcacagcagatgctttccctcagtccaatgcccccatccaggacgaggaacgagacattccagagagatcatggaacagtgggaatgaatggatcactgattttgcaggaaagacggtgtggttcgtcccgagcataaaagccggtaacgacattgctaactgcttacgcaagaatggcaaaaaggtaatccaactgtctaggaagacctttgatacagagtaccagaaaactaagcttaacgactgggatttcgtggttaccacagacatctccgagatgggggccaattttaaagcggatcgtgtgattgaccctcggagatgcctgaagcccgtcatcctcaccgatggaccagaaagggtgattttggcaggccccatgcctgttactgccgcttcagccgctcagcgccgaggtagagtggggcggaacccacagaaagagaatgaccaatatatattcacgggccagcccctgaacaatgatgaagaccacgcacattggaccgaggccaagatgctcctggacaacatcaatacacctgaaggaattatcccggctcttttcgagccagagagggaaaagagtgccgcaatcgatggcgagtaccgcctaaaaggggaaagccgtaagacttttgtcgagctgatgagacggggagacttgcccgtgtggttagcgcacaaagtagcctccgaaggtattaagtataccgataggaaatggtgtttcgacggccagcgcaacaatcagatactggaggagaacatggatgtggaaatctggacaaaggagggggaaaaaaagaagctccgacctagatggctggacgctcggacctactctgatccccttgccctgaaagagtttaaggacttcgcagctggaaggaaatcgattgccctcgatttggttactgaaatcggccgcgtcccaacacacctggcacatagaacgaggaatgccctagacaacctggtgatgctccacaccagcgagcatggtgggaaggcttatcggcacgcggtggaggaacttcctgagactatggaaacactgttattgctgggcctcatgattctgcttaccggaggcgccatgctgtttctcatctcagggaaaggaataggtaagacctccatcggcttgatttgcgtcatcgcaagttctgggatgctgtggatggctgagattcccttacaatggatcgccagcgccatagttctagagttctttatgatggtgctgctcattccagaacctgagaagcagcgtacaccgcaggataatcaacttgcatacgtagtgatcggaattctgactttggctgccacgatcgcggctaacgaaatgggcctgctcgagaccacaaaacgcgacctgggtatgtccaaggaacccggggtcgtgtcaccaacttcttatcttgatgttgacctccaccctgccagcgcatggaccctgtacgccgtggctacaaccgtcataactcccatgttgcgacatacgatcgagaatagtacagcaaacgtatccctggccgcgattgctaaccaggccgtggttttaatgggcctagacaaaggatggccaatcagcaagatggatctgggcgtgcctctccttgcactggggtgttactctcaggtcaatcccttgaccctgactgccgctgtgctcctgcttattacccactatgccatcataggaccgggcttacaggcaaaagctacaagagaggcccaaaagaggactgcggccggtattatgaagaacccaaccgtcgacgggatcatgacaatcgatctggaccctgtgatttacgattcaaaattcgaaaagcagctcggacaggttatgttgctggtgctatgcgcagtacagctgctccttatgcggacgtcctgggctctgtgtgaggccttgaccctggcaactggccccatcacaaccctctgggaaggtagtccaggcaaattttggaatactacaatagctgtgagcatggccaacattttccgcgggtcgtatctggccggagcgggcttagctttttctatcatgaagtccgtcgggaccggaaaaagaggcacgggtagccaaggggagacccttggagaaaagtggaagaaaaggctgaatcagctctcacggaaggagttcgacctatacaaaaagagtggcattacagaggttgatcgaactgaagcaaaagagggtctgaagagaggcgaaatcacccatcacgccgtgtctcgcgggtccgctaaattgcagtggtttgtcgagaggaacatggtgatacccgaaggacgggtaatcgacctgggctgcgggcgtggaggctggagctattactgtgccggtctcaagaaggtgacagaggttagagggtatactaaaggaggccctggccatgaggaaccggtgcccatgtcaacctacgggtggaatattgtcaagcttatgagtggaaaagatgtgttctacctgccacctgagaagtgcgacacattgctgtgtgatatcggtgaaagctccccctctcctaccgtcgaggagagcaggactattcgcgtgctcaaaatggttgaaccatggttaaagaacaatcagttctgcatcaaggtactgaacccctatatgcctacggtgattgagcaccttgaacggctgcaacgaaaacacggcgggatgctagtcagaaatccactctccaggaactcaacacatgagatgtactggatctctaatggaaccggcaacatagtggcaagtgttaatatggtgtcgcgcctgttgctgaaccggtttactatgacccacagacgtcccacaattgaaaaggacgtcgatctcggtgccgggacgaggcatgtgaacgctgagccggagacccctaatatggacgtaatcggagaacggatcaaacgcattaaggaggaacacaacagcacttggcactatgacgatgagaatccatacaaaacatgggcgtatcatggctcctacgaagtgaaggccaccggctctgcatcaagcatgataaacggggttgtcaagcttctgactaaaccctgggacgtggtgcctatggtcacacagatggctatgaccgatacaactccattcggacagcaacgagtttttaaggagaaagtggacaccagaacgcccaggtccatgccgggtacccggcgcgtaatgggcatcacagccgagtggttatggagaactctggggaggaataagaaacctcgattgtgtacccgggaagagttcacaaagaaggtgcgtactaacgcagccatgggagctgtctttaccgaagagaatcagtgggatagtgccaaagcggcagtggaagacgaggatttctggaagctcgttgacagagagcgcgaactgcacaaactaggcaagtgcggttcttgcgtgtataacatgatggggaaaagggagaagaaacttggagaatttggcaaggccaagggcagccgggctatttggtacatgtggctgggggccagatacctcgagttcgaggcactgggatttttgaatgaagatcattggttctcacgcgagaactcctatagtggtgtcgaaggcgaggggctgcacaaactcggatacatccttagggacattagcaagatccccggcggtgctatgtatgccgatgacacggctgggtgggacacacgaataaccgaagatgacctgcataatgaggagaaaatcactcagcagatggatccagaacaccggcaattagccaacgcaatttttaagctgacataccagaataaagtggtaaaggttcagagacctacccccactggaaccgtgatggacatcatttctaggaaggatcagcgcggctccggccaagtcgggacatatggattgaacacgttcaccaatatggaggcgcagctcatccgtcagatggaaggtgagggcgtgctgtcaaaagccgacctagaaaacccacaccttcccgagaagaaaataactcagtggctggagacaaagggggtggaacggctcaaaagaatggctattagcggagatgactgtgtcgttaagcctatcgatgacaggtttgccaacgcactgttggctttaaatgatatgggcaaggtgcgcaaagacatcccacaatggcagccgtcgaagggttggcatgattggcagcaggtacccttctgctctcaccatttccacgagctgattatgaaagacgggcgaaagctcgtggtcccttgtcggccacaagacgaacttataggaagagccaggatcagtcagggcgcaggctggtccctgcgcgagaccgcctgcctagggaaagcgtacgctcagatgtggagcctgatgtattttcacagacgggatctcaggttggcctcaaacgcaatttgttccgccgtgcccgttcattgggtgcctacttctcgtacaacctggagcatccacgctcatcaccaatggatgacgacagaagacatgctgaccgtctggaatcgagtgtggattgaggataacccatggatggaggacaagactcccgtaaccacatgggaaaatgttccttaccttggaaagcgcgaggatcagtggtgcggtagtctgatcggcctcacttccagagccacctgggcacagaacataccgacagctatccagcaagtgcggagcttaattgggaatgaagagttcctggactacatgccatctatgaaaaggtttcgcaaggaggaagagtcagaaggagccatctggtga

SEQ ID NO: 15528 - RNA, 9873 nt, synthetic construct
  misc_feature 1..9873: note = derived and/or modified CDS sequence (opt3) from DENV-3__KF955471__SS-prME
  source 1..9873: mol_type = other RNA
accagcctgtgcctcatgatgatccttcccgccgctctggcattccacttgacatccagagacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttcaatctgaaggataccttaaagcgtagatcttggccactcaacgaaggggtgatggccgttggactggtgagcatccttgcatcaagtctgttgaggaacgacgtccctatggccggccccctcgtggctggtgggctgctaattgcatgttacgtaatcacgggaacatccgccgatctgaccgtggagaaagcggctgacgtcacttgggaagaggaagccgagcagacaggcgtttctcataatcttatgataaccgtggacgatgacggcactatgcgcattaaggatgacgagacagaaaacatcctcaccgtgctgttgaaaacggcattactgatcgtcagcgggatttttccatactccataccggccactctcctggtgtggcacacctggcagaagcagacacaacggtcaggagttctttgggatgtacctagcccaccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaatggaaagcgactagagcccaactgggcaagtgtcaagaaggacctgatctcttatggcggcgggtggcgcctctccgctcagtggcaaaaaggagaagaggtccaggtgattgccgttgaacctggtaagaatcccaagaatttccagacaatgcccggcactttccagaccacaaccggggagatcggagcgatagccctggattttaagcctggcactagcggttcgccgatcattaatcgggaggggaaggtggtcggactttacggcaacggcgtggttaccaaaaatgggggatatgtgtcaggtatcgcacaaacaaacgctgaaccagacggccccacgcctgagttagaagaggaaatgttcaagaaaagaaatctgactattatggatctccacccagggtctggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaaagtgaacatacgggtcgggagatcgtggacttgatgtgccacgcaacttttacaatgcgcctactgtcccccgttagagtcccaaactacaatctcattatcatggatgaagcccatttcaccgaccctgctagcatagccgcaagggggtacatttctacccgggtgggaatgggcgaggccgctgcgatctttatgactgccacacccccaggcaccgcagatgctttccctcagagcaacgcccccattcaggacgaggaacgagacatcccagagagatcctggaactcagggaacgaatggataacagattttgcaggaaagactgtgtggttcgtcccgagtattaaagccggtaacgacatcgctaattgtttacgcaagaacggcaaaaaggtaatccaactgagcaggaagacgtttgataccgagtatcagaaaacaaaacttaatgactgggatttcgtggttactaccgacatttctgagatgggggccaactttaaagcggatcgtgtgatcgaccctcggagatgcctgaagcccgtcattctcacagatggaccagaaagggtgatattggcaggccccatgcctgttaccgccgcttccgccgctcagcgccgaggtagagtggggcggaatccacagaaagagaacgaccaatacatcttcactggccagcccctgaataacgatgaagaccacgcacattggacggaggccaagatgctcctggacaatattaacacccctgaaggaatcatcccggctcttttcgagccagagagggaaaagtcagccgcaattgatggcgagtatcgcctaaaaggggaaagtcgtaagacatttgtcgagctgatgagacggggagacttgcccgtgtggttagcgcacaaagtagccagcgaaggtataaagtacactgataggaaatggtgcttcgacggccagcgcaataaccagatcctggaggagaatatggatgtggaaatttggaccaaggagggggagaaaaagaagctccgacctagatggctggacgctcggacatattccgatccccttgccctgaaagagtttaaggacttcgcagctggaaggaaatctatcgccctcgatttggttaccgaaattggccgcgtcccaactcacctggcacatagaacaaggaacgccctagacaatctggtgatgctccacacgtcggagcatggtgggaaggcttaccggcacgcggtggaggaacttcctgagaccatggaaactctgttattgctgggcctcatgatcctgcttacaggaggcgccatgctgtttctcataagcgggaaaggaatcggtaagacctcaattggcttgatctgtgtcattgcatccagtgggatgctgtggatggctgagatccccttacaatggatagcctctgccattgttctagagttctttatgatggtgctgctcatcccagaacctgagaagcagcgtaccccgcaggataaccaacttgcatatgtagtgattggaatcctgacattggctgccataatcgcggctaatgaaatgggcctgctcgagactacgaaacgcgacctgggtatgagcaaggaacccggggtcgtgtccccaacctcataccttgatgttgacctccaccctgcctctgcatggacactgtacgccgtggctactaccgtcattacacccatgttgcgacataccatcgagaacagcactgcaaacgtaagtctggccgcgattgctaatcaggccgtggttttaatgggcctagacaaaggatggccaatctccaagatggatctgggcgtgcctctccttgcactggggtgctatagccaggtcaaccccttgacgctgacagccgctgtgctcctgcttataacccactacgccattatcggaccgggcttacaggcaaaagctactagagaggcccaaaagaggaccgcggccggtatcatgaagaatccaacagtcgacgggattatgactatcgatctggaccctgtgatatatgattctaaattcgaaaagcagctcggacaggttatgttgctggtgctatgtgcagtacagctgctccttatgcggacctcatgggctctgtgcgaggccttgacactggcaacgggccccattaccactctctgggaaggttccccaggcaaattttggaacacaaccatcgctgtgagtatggccaatattttccgcgggagctacctggccggagcgggcttagctttttcgatcatgaagtctgtcgggactggaaaaagaggcacaggttcccaaggggagacccttggagaaaagtggaagaaaaagctgaaccagctcagcaggaaagagttcgacctatataagaaatcaggcataacggaggttgatcggaccgaagcaaaggagggtctgaaacgaggcgaaatcacacatcacgccgtgagtagagggtctgctaagttgcagtggtttgtcgagcgcaatatggtgattcccgaaggaagggtaatcgacctgggctgtgggcggggaggctggtcctactattgcgccggtctcaagaaagtgactgaggttcgtgggtacaccaagggaggccctggccatgaggaaccggtgcccatgagcacatacgggtggaacattgtcaaacttatgtcaggaaaggatgtgttctatctgccacctgagaaatgtgacactttgctgtgcgatatcggtgaaagtagcccctcccctaccgtcgaggagtctagaacaattagggtgctcaagatggttgaaccatggttaaagaataaccagttctgtatcaaagtactgaatccctacatgcctaccgtgatagagcaccttgaacgcctgcaacggaagcacggcgggatgctagtccgaaacccactcagcagaaattccactcatgagatgtattggatttcaaacggatctggcaatatcgtggcaagtgttaacatggtgtcgaggctgttgctgaaccgctttacgatgacacaccggagacccaccatcgaaaaagacgtcgatctcggtgccgggactcgtcatgtgaatgctgagccggagacccctaacatggacgtaattggagaaaggataaagcggatcaaagaggaacacaatagcacatggcactacgacgatgagaacccatataagacgtgggcgtaccatggctcctatgaagtgaaggccaccggctctgcatcaagcatgattaatggggttgtcaaacttctgactaagccctgggacgtggtgcctatggtcacacagatggctatgaccgatactacaccattcggacagcaacgcgtttttaaagagaaggtggacacccgaacacccagatccatgccgggtactaggcgggtaatgggcatcaccgccgagtggttatggcgcacgctggggagaaacaaaaagcctaggttgtgcacccgagaagagttcacaaagaaagtgcggactaatgcagccatgggagctgtctttaccgaagagaaccagtgggatagtgccaaggcggcagtggaagacgaggatttctggaaactcgttgaccgtgagagagaactgcacaagctaggcaaatgtggttcttgcgtgtacaatatgatggggaagcgcgagaagaaacttggagaatttggcaaagccaaaggcagcagggctatttggtacatgtggctgggggcccggtatctcgagttcgaggcactgggatttttgaacgaagatcattggttctcaagagaaaattcctacagtggtgtcgagggcgaggggctgcacaagctcggatatatccttcgcgacataagcaaaatccccggcggtgctatgtacgccgatgacacagctgggtgggacactaggattaccgaagatgacctgcataacgaggagaagatcacgcagcagatggatccagaacaccgacaattagccaatgcaatttttaaactgacatatcagaacaaggtggtaaaggttcagcggcctacccccactggaacagtgatggacatcatatctagaaaagatcagaggggctccggccaagtcgggacctacggattgaatactttcaccaacatggaggcgcagctcattcgccagatggaaggtgagggcgtgctgtcaaaggccgacctagaaaacccacaccttcccgagaaaaagatcacacagtggctggagacgaaaggggtggaacgtctcaagcggatggctatcagcggagatgactgcgtcgttaagcctattgatgacagatttgccaatgcactgttggctttaaacgatatgggcaaagtgaggaaggacataccacaatggcagccgtcgaaaggttggcatgattggcagcaggtacccttctgttctcaccatttccacgagctgatcatgaaggacgggcgcaaactcgtggtcccttgccgaccacaagacgaacttattggacgggccagaatcagtcagggcgcaggctggtccctgagggagaccgcctgtctagggaaggcgtatgctcagatgtggagcctgatgtactttcaccgcagagatctccggttggcctcaaatgcaatttgctccgccgtgcccgttcattgggtgcctacttctaggacaacctggagcatccacgctcatcaccaatggatgactacagaagacatgctgaccgtctggaaccgtgtgtggatagaggataatccatggatggaggacaagacgcccgtaacaacctgggaaaacgttccttaccttggaaaacgagaggatcagtggtgtggtagtctgatcggcctcacttcccgcgccacctgggcacagaatattccgacagctatccagcaagtgaggagcttaattgggaacgaagagttcctggactatatgccatctatgaagcggtttaggaaagaggaagagtcagaaggagccatctggtga

SEQ ID NO: 15529 - RNA, 9873 nt, synthetic construct
  misc_feature 1..9873: note = derived and/or modified CDS sequence (opt3) from DENV-3__FJ639803__SS-prME
  source 1..9873: mol_type = other RNA
accagcctgtgcctcatgatgatccttcccgccgctctggcattccacttgacatccagagacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttcaatctgaaggataccttaaagcgtagatcttggccactcaacgaaggggtgatggccgttggactggtgagcatccttgcatcaagtctgttgaggaacgacgtccctatggccggccccctcgtggctggtgggctgctaattgcatgttacgtaatcacgggaacatccgccgatctgaccgtggagaaagcggctgacgtcacttgggaagaggaagccgagcagacaggcgtttctcataatcttatgataaccgtggacgatgacggcactatgcgcattaaggatgacgagacagaaaacatcctcaccgtgctgttgaaaacggcattactgatcgtcagcgggatttttccatactccataccggccactctcctggtgtggcacacctggcagaagcagacacaacggtcaggagttctttgggatgtacctagcccaccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaatggaaagcgactagagcccaactgggcaagtgtcaagaaggacctgatctcttatggcggcgggtggcgcctctccgctcagtggcaaaaaggagaagaggtccaggtgattgccgttgaacctggtaagaatcccaagaatttccagacaatgcccggcactttccagaccacaaccggggagatcggagcgatagccctggattttaagcctggcactagcggttcgccgatcattaatcgggaggggaaggtggtcggactttacggcaacggcgtggttaccaaaaatgggggatatgtgtcaggtatcgcacaaacaaacgctgaaccagacggccccacgcctgagttagaagaggaaatgttcaagaaaagaaatctgactattatggatctccacccagggtctggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaaagtgaacatacgggtcgggagatcgtggacttgatgtgccacgcaacttttacaatgcgcctactgtcccccgttagagtcccaaactacaatctcattatcatggatgaagcccatttcaccgaccctgctagcatagccgcaagggggtacatttctacccgggtgggaatgggcgaggccgctgcgatctttatgactgccacacccccaggcaccgcagatgctttccctcagagcaacgcccccattcaggacgaggaacgagacatcccagagagatcctggaactcagggaacgaatggataacagattttgcaggaaagactgtgtggttcgtcccgagtattaaagccggtaacgacatcgctaattgtttacgcaagaacggcaaaaaggtaatccaactgagcaggaagacgtttgataccgagtatcagaaaacaaaacttaatgactgggatttcgtggttactaccgacatttctgagatgggggccaactttaaagcggatcgtgtgatcgaccctcggagatgcctgaagcccgtcattctcacagatggaccagaaagggtgatattggcaggccccatgcctgttaccgccgcttccgccgctcagcgccgaggtagagtggggcggaatccacagaaagagaacgaccaatacatcttcactggccagcccctgaataacgatgaagaccacgcacattggacggaggccaagatgctcctggacaatattaacacccctgaaggaatcatcccggctcttttcgagccagagagggaaaagtcagccgcaattgatggcgagtatcgcctaaaaggggaaagtcgtaagacatttgtcgagctgatgagacggggagacttgcccgtgtggttagcgcacaaagtagccagcgaaggtataaagtacactgataggaaatggtgcttcgacggccagcgcaataaccagatcctggaggagaatatggatgtggaaatttggaccaaggagggggagaaaaagaagctccgacctagatggctggacgctcggacatattccgatccccttgccctgaaagagtttaaggacttcgcagctggaaggaaatctatcgccctcgatttggttaccgaaattggccgcgtcccaactcacctggcacatagaacaaggaacgccctagacaatctggtgatgctccacacgtcggagcatggtgggaaggcttaccggcacgcggtggaggaacttcctgagaccatggaaactctgttattgctgggcctcatgatcctgcttacaggaggcgccatgctgtttctcataagcgggaaaggaatcggtaagacctcaattggcttgatctgtgtcattgtttccagtgggatgctgtggatggcagagatccccttacaatggatagcttctgccattgtgctagagttctttatgatggtactgctcatcccagaacctgagaagcagcgtaccccgcaggataaccaacttgcctatgtggtcattggaatcctgacattggcagctataatcgccgcgaatgaaatgggcctgctcgagactacgaaacgcgacctgggtatgagcaaggaacccggggtggtttccccaacctcataccttgatgtggacctccaccctgcttctgcctggacactgtacgcagtcgccactaccgtaattacacccatgttgcgacataccatcgagaacagcactgctaacgtgagtctggcagccattgcgaatcaggctgttgtgttaatgggcctagacaaaggatggccaatctccaagatggatctgggcgtccctctccttgccctggggtgctatagccaggtgaaccccttgacgctgacagcagccgtcctcctgcttataacccactacgctattatcggaccgggcttacaggccaaagcaactagagaggctcaaaagaggaccgccgcgggtatcatgaagaatccaacagtggacgggattatgactatcgatctggaccctgttatatatgattctaaattcgaaaagcagctcggacaggtgatgttgctggtactatgtgccgtgcagctgctccttatgcggacctcatgggcactgtgcgaggctttgacactggccacgggccccattaccactctctgggaaggttccccaggcaaattttggaacacaaccatcgcagtcagtatggctaatattttccgcgggagctacctggccggagccggcttagcgttttcgatcatgaagtctgttgggactggaaaaagaggcacaggttcccaaggggagacccttggagaaaagtggaagaaaaagctgaaccagctcagcaggaaagagttcgacctatataagaaatcaggcataacggaggtggatcggaccgaagctaaggagggtctgaaacgaggcgaaatcacacatcacgcagtcagtagagggtctgccaagttgcagtggtttgtggagcgcaatatggtaattcccgaaggaagggtgatcgacctgggctgtgggcggggaggctggtcctactattgcgctggtctcaagaaagttactgaggtgcgtgggtacaccaagggaggccctggccatgaggaaccggtccccatgagcacatacgggtggaacattgtgaaacttatgtcaggaaaggatgtcttctatctgccacctgagaaatgtgacactttgctgtgcgatatcggtgaaagtagcccctcccctaccgtggaggagtctagaacaattagggttctcaagatggtagaaccatggttaaagaataaccagttctgtatcaaagtgctgaatccctacatgcctaccgtcatagagcaccttgaacgcctgcaacggaagcacggcgggatgctagtgcgaaacccactcagcagaaattccactcatgagatgtattggatttcaaacggatctggcaatatcgttgccagtgtgaacatggtctcgaggctgttgctgaaccgctttacgatgacacaccggagacccaccatcgaaaaagacgtggatctcggtgcagggactcgtcatgtaaatgccgagccggagacccctaacatggacgtgattggagaaaggataaagcggatcaaagaggaacacaatagcacatggcactacgacgatgagaacccatataagacgtgggcttaccatggctcctatgaagttaaggcgaccggctctgcctcaagcatgattaatggggtcgtgaaacttctgactaagccctgggacgtggtccctatggttacacagatggcaatgaccgatactacaccattcggacagcaacgcgtgtttaaagagaaggtagacacccgaacacccagatccatgccgggtactaggcgggtgatgggcatcaccgctgagtggttatggcgcacgctggggagaaacaaaaagcctaggttgtgcacccgagaagagttcacaaagaaagtccggactaatgccgcaatgggagccgtgtttaccgaagagaaccagtgggatagtgctaaggccgcggttgaagacgaggatttctggaaactcgtggaccgtgagagagaactgcacaagctaggcaaatgtggttcttgcgtctacaatatgatggggaagcgcgagaagaaacttggagaatttggcaaagcaaaaggcagcagggccatttggtacatgtggctgggggctcggtatctcgagttcgaggccctgggatttttgaacgaagatcattggttctcaagagaaaattcctacagtggtgtggagggcgaggggctgcacaagctcggatatatccttcgcgacataagcaaaatccccggcggtgcaatgtacgctgatgacacagccgggtgggacactaggattaccgaagatgacctgcataacgaggagaagatcacgcagcagatggatccagaacaccgacaattagctaatgccatttttaaactgacatatcagaacaaggtagttaaggtgcagcggcctacccccactggaacagtcatggacatcatatctagaaaagatcagaggggctccggccaagtggggacctacggattgaatactttcaccaacatggaggcacagctcattcgccagatggaaggtgagggcgtgctgtcaaaggcggacctagaaaacccacaccttcccgagaaaaagatcacacagtggctggagacgaaaggggtcgaacgtctcaagcggatggccatcagcggagatgactgcgttgtgaagcctattgatgacagatttgctaatgccctgttggcattaaacgatatgggcaaagtaaggaaggacataccacaatggcagccgtcgaaaggttggcatgattggcaacaggtgcccttctgttctcaccatttccacgagctgatcatgaaggacgggcgcaaactcgtcgtgccttgccgaccacaagacgaacttattggacgggctagaatcagtcagggcgccggctggtccctgagggagaccgcatgtctagggaaggcctatgcgcagatgtggagcctgatgtactttcaccgcagagatctccggttggcttcaaatgccatttgctccgcagttcccgtgcattgggtccctacttctaggacaacctggagcatccacgcccatcaccaatggatgactacagaagacatgctgaccgtgtggaaccgtgtatggatagaggataatccatggatggaggacaagacgcccgttacaacctgggaaaacgtgccttaccttggaaaacgagaggatcagtggtgtggtagtctgatcggcctcacttcccgcgctacctgggcccagaatattccgacagcaatccagcaagtcaggagcttaattgggaacgaagagttcctggactatatgccatctatgaagcggtttaggaaagaggaagagtcagaaggagctatctggtga

SEQ ID NO: 15530 - RNA, 9873 nt, synthetic construct
  misc_feature 1..9873: note = derived and/or modified CDS sequence (opt3) from DENV-3__FJ639804__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaatctcaagtcggagtgggcgttcagaaggaaggtgtgtttcatacaatgtggcacgtcactaggggggccgtgttgacctacaacggaaagcgactagagcccaattgggcatccgtaaaaaaggacctgatcagctatggcggcgggtggcgcctctcggctcagtggcaaaaaggagaagaggtccaggtgattgccgttgaacctggtaagaacccaaaaaatttccagacgatgcccggcacattccagactaccacaggggagatcggagcgatagccctggattttaagcctggcacctcaggttctccgatcattaaccgggaggggaagatcgtgggactttacggcaatggcgtcgtgactaaaaacgggggatatgttagtggtattgcacaaaccaatgctgaaccagacggccccacacctgagttagaagaggaaatgttcaagaaaagaaacctgacgatcatggatctccacccagggtccggaaagactaggaaatacttgcccgccatagtgcgtgaggctattaagcgccggctgagaaccctcatcctggcacctacaagggtcgtggccgccgagatggaagaggctcttaagggcctgccgatccgatatcagaccactgcgacaaaaagcgaacataccggtcgggagattgtagacttgatgtgccacgcaacgtttactatgcgcctactgtctcccgtgagagttccaaattacaacctcatcataatggatgaagcccatttcacagaccctgctagcattgccgcaagggggtacatctccacccgggtcggaatgggcgaggccgctgcgatttttatgaccgccactcccccaggcacagcagatgctttccctcagtcaaatgcccccatccaggacgaggaacgagacataccagagagaagttggaacagcgggaatgaatggattaccgattttgcaggaaagacagtgtggttcgtgccgtctatcaaagccggtaacgacatcgctaactgtttacgcaagaatggcaaaaaggtcattcaactgtccaggaagacttttgatacggagtatcagaaaaccaagcttaacgactgggatttcgtagtgacaactgacatctcagagatgggggccaattttaaagcggatcgtgttattgaccctcggagatgcctgaagcccgtgatactcaccgatggaccagaaagggtcatcttggcaggccccatgcctgtgacagccgctagtgccgctcagcgccgaggtagagttgggcggaacccacagaaagagaatgaccaatacattttcaccggccagcccctgaacaatgatgaagaccacgcacattggactgaggccaagatgctcctggacaacatcaatacgcctgaaggaatcattccggctcttttcgagccagagagggaaaagagcgccgcaatagatggcgagtatcgcctaaaaggggaatcccgtaagacctttgtggagctgatgagacggggagacttgcccgtctggttagcgcacaaagtggcctctgaaggtatcaagtacacagataggaaatggtgcttcgacggccagcgcaacaatcagattctggaggagaacatggatgtagaaatctggactaaggagggggaaaaaaagaagctccgacctagatggctggacgctcggacctattcggatccccttgccctgaaagagtttaaggacttcgcagctggaaggaaaagcattgccctcgatttggtgacagaaatcggccgcgttccaacccacctggcacatagaactaggaatgccctagacaacctggtcatgctccacacatcagagcatggtgggaaggcttaccggcacgcggtggaggaacttcctgagacgatggaaaccctgttattgctgggcctcatgatactgcttactggaggcgccatgctgtttctcatctccgggaaaggaattggtaagacaagtatcggcttgatttgtgtgatcgcatctagcgggatgctgtggatggctgagatacccttacaatggattgcctccgccatcgtcctagagttctttatgatggttctgctcattccagaacctgagaagcagcgtaccccgcaggataatcaacttgcatatgtggtaatcggaatactgaccttggctgccacaatcgcggctaacgaaatgggcctgctcgagactacgaaacgcgacctgggtatgtcaaaggaacccggggtggtctctccaaccagctaccttgatgtggacctccaccctgccagtgcatggacactgtacgccgttgctactaccgtgattacacccatgttgcgacataccatcgagaattccactgcaaacgtcagcctggccgcgattgctaaccaggccgtagtgttaatgggcctagacaaaggatggccaatctctaagatggatctgggcgttcctctccttgcactggggtgctattcacaggtgaatcccttgacgctgacagccgctgtcctcctgcttataacccactacgccattatcggaccgggcttacaggcaaaagctactagagaggcccaaaagaggaccgcggccggtatcatgaagaacccaacagtggacgggattatgactatcgatctggaccctgtcatatatgattccaaattcgaaaagcagctcggacaggtgatgttgctggttctatgtgcagtgcagctgctccttatgcggaccagttgggctctgtgcgaggccttgacactggcaacgggccccattaccactctctgggaaggtagcccaggcaaattttggaatacaaccatcgctgtatcgatggccaacattttccgcgggtcttacctggccggagcgggcttagctttttccatcatgaagagcgtggggactggaaaaagaggcacaggttcacaaggggagacccttggagaaaagtggaagaaaaagctgaatcagctcagtaggaaagagttcgacctatataagaaatctggcataacggaggtcgatcggaccgaagcaaaggagggtctgaaacgaggcgaaatcacacatcacgccgtttccagagggagcgctaagttgcagtggtttgtggagcgcaacatggtcattcccgaaggaagggtgatcgacctgggctgtgggcggggaggctggtcatactattgcgccggtctcaagaaagtaactgaggtgcgtgggtacaccaagggaggccctggccatgaggaaccggttcccatgagtacatacgggtggaatattgtgaaacttatgagcggaaaggatgtcttctatctgccacctgagaaatgtgacactttgctgtgcgatatcggtgaatcctctcccagccctaccgtggaggagtccagaacaattagggtcctcaagatggtggaaccatggttaaagaacaatcagttctgtatcaaagttctgaacccctacatgcctaccgtaatagagcaccttgaacgcctgcaacggaagcacggcgggatgctagtgcgaaatccactctcaagaaactctactcatgagatgtattggattagtaatggaacgggcaacatcgtcgcatcggtgaatatggttagcaggctgttgctgaaccgctttacaatgacctaccggagacccactatcgaaaaagacgtggatctcggtgccgggacccgtcacgtcaacgctgagccggagacacctaatatggacgtgattggagaaaggatagagcggatcaaggaagagcataactccacgtggcactatgacgatgaaaatccatacaaaacctgggcgtatcacggctcttacgaggtaaaggccactggctcagcaagctccatgattaacggggtggttaagcttctgacaaaaccctgggacgtcgtgcctatggtgacccagatggctatgactgatacaaccccattcggacagcaacgcgtctttaaggagaaagttgacacacgaatccccagaagtatgccgggtactaggcgggtgatgggcattaccgccgaatggttatggcgcacgctggggagaaataagaaacctaggttgtgcacccgagaggaattcacaaagaaggtacggactaacgcagccatgggagctgtgtttaccgaggaaaatcagtgggattctgccaaagcggcagtcgaggacgaggatttctggaagctcgtggaccgtgaaagagagctgcataaactaggcaagtgtggtagctgcgtttacaacatgatggggaaacgcgaaaagaaacttggagagtttggcaaggccaagggctcaagggctatctggtatatgtggctgggggcccggtacctcgagttcgaagcactgggatttttgaatgaggatcactggttctccagagaaaacagttatagcggtgtggagggcgaagggctgcataaactcggatacatacttcgcgacatctctaagattcccggcggtgctatgtatgccgatgacacagctgggtgggacactaggatcaccgaggatgacctgcacaatgaggaaaaaattacgcagcagatggatccagagcatcgacaattagccaacgcaatctttaagctgacataccagaataaagtcgtgaaggtacagcggcctacccccactggaacagttatggacataatttccagaaaggatcagaggggctcaggccaagtggggacctatggattgaacactttcaccaatatggaagcgcagctcatccgccagatggagggtgaaggcgtcctgagcaaagccgacctagagaacccacaccttcccgagaagaaaatcacacagtggctggaaacgaagggggtggagcgtctccggagaatggctatttcgggagatgactgcgtggtcaaacctatagatgacaggtttgccaacgcactgttggctttaaatgatatgggcaaggttcgcaaggacatcccacaatggcagccgtctaaaggttggcacgattggcagcaggtgcccttctgtagtcatcacttccatgaactgattatgaaggacgggcgaaaactcgtagtgccttgccggccacaagacgagcttatcggaagagccaggatttcccagggcgcaggctggagcctgcgcgaaaccgcctgtctagggaaggcgtacgctcagatgtggtcactgatgtactttcacagacgggatctcaggttggcctccaacgcaatctgctctgccgtccccgtgcactgggttcctactagccgtacaacctggagtatacatgctcaccatcaatggatgactacagaggacatgctgaccgtgtggaatcgagtctggatcgaggataacccatggatggaagacaaaacgcccgtgacaacctgggagaatgtaccttatcttggaaagcgcgaagatcagtggtgtggttccctgattggcctcactagcagagccacctgggcacagaacatcccgacagctattcagcaagttcggtctttaatcgggaatgaggagttcctggactacatgccatcaatgaagaggtttcgcaaagaagaggaaagtgagggagccatttggtga

SEQ ID NO: 15531 - RNA, 9873 nt, synthetic construct
  misc_feature 1..9873: note = derived and/or modified CDS sequence (opt3) from DENV-3__FJ639805__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttcctaacctttgttctgctcctgtccggacagattacgtggcgggatatggctcacactcttatcatgattggcagtaatgccagcgacagaatgggtatgggggtgacctacttggcactgatagccacattcaagatccagccctttttagctctcggattctttctgaggaaacttacctctcgcgagaacctgctactcggcgtcggcctggcgatggccactacattgcaactgccggaagatattgagcagatggcaaatgggatcgctttaggactcatggccctgaagcttattacccagttcgagacatatcagctgtggactgccttgatctccctcacctgttcaaacacgatatttacactgaccgtggcttggcgaactgcaaccctaatcctggccggtgttagtcttctccctgtgtgccaaagctcgtccatgcggaaaacagactggctgccaatgactgtcgcggctatgggcgtaccccctttgcccctgttcatttttaatttaaaggataccctccgtagaaggtcttggccactgaacgaaggggtgatggccgttggacttgtgagcatcctggcatcaagtttgctccgcaacgacgtccctatggccggccccctggtggctggtgggctactgattgcatgttacgtaatcacgggaacatccgccgatcttaccgtggagaaggcggctgacgtcacttgggaagaggaagccgagcagacaggcgtttctcataatctcatgataaccgtggacgatgacggcactatgcggattaaagatgacgagacagaaaacatcctgaccgtgttgttaaagacggcactgctcatcgtcagcgggattttcccatactccataccggccactctgcttgtgtggcacacctggcagaaacagacacaaagatcaggagttctgtgggatgtacctagccccccagagacccagaaggctgaattggaggagggtgtgtataggatcaaacagcagggcatttttgggaagacacaagtcggagtgggcgttcagaaagaaggtgtgttccatactatgtggcacgtcacccgaggggccgtgctaacgtacaatggaaagcgcctggagcccaactgggcaagtgtaaagaaagacctcatctcttatggcggcgggtggcggctgtccgctcagtggcaaaagggagaagaggtccaggtgattgccgttgaacctggtaaaaatccaaagaactttcagacaatgcccggcactttccagaccacaaccggggagatcggagcgatagcccttgatttcaaacctggcactagcggttcgccgatcattaatagagaggggaaggtggtcggattatacggcaacggcgtggttaccaagaatgggggatatgtgtcaggtatcgcacaaacaaacgctgaaccagacggccccacgcctgagctggaagaggaaatgtttaaaaagaggaatctcactattatggatttgcacccagggtctggaaaaacccgtaagtacctgcccgccatcgtccgcgaggctataaaacggagactcaggacactgattcttgcacctacccgagtggtagccgccgagatggaagaggctctgaagggcttgccgatccggtatcagactacagcgaccaagagtgaacatacgggtcgcgagatcgtggacctaatgtgccacgcaactttcacaatgagactgctctcccccgttagggtcccaaactacaatttaattatcatggatgaagcccattttaccgaccctgctagcatagccgcacgggggtacatttctacccgagtgggaatgggcgaggccgctgcgatcttcatgactgccacacccccaggcaccgcagatgcttttcctcagagcaacgcccccattcaggacgaggaaagagacatcccagagcgctcctggaattcagggaacgaatggataacagatttcgcaggaaaaactgtgtggtttgtcccgagtattaaggccggtaacgacatcgctaattgtctgaggaaaaacggcaagaaagtaatccaacttagccgtaagacgttcgataccgagtatcagaagacaaaactgaatgactgggattttgtggttactaccgacatttctgagatgggggccaacttcaaggcggatcgggtgatcgaccctagaaggtgcctcaaacccgtcattttgacagatggaccagaacgcgtgatactggcaggccccatgcctgttaccgccgcttccgccgctcagcgaagaggtcgggtggggaggaatccacagaaggagaacgaccaatacatctttactggccagcccctcaataacgatgaagaccacgcacattggacggaggccaaaatgctgcttgacaatattaacacccctgaaggaatcatcccggctctattcgagccagagcgcgaaaagtcagccgcaattgatggcgagtatcgtctgaagggggaaagtagaaaaacattcgtcgagttgatgcggaggggagacttacccgtgtggctggcgcacaaggtagccagcgaaggtataaaatacactgatcgcaagtggtgctttgacggccagcgaaataaccagatcctcgaggagaatatggatgtggaaatttggaccaaagagggggaaaagaaaaagctgagacctcggtggcttgacgctaggacatattccgatcccctggccctcaaggagttcaaagactttgcagctggacgcaagtctatcgccttggatctggttaccgaaattggcagagtcccaactcacctagcacataggacacggaacgccctggacaatctcgtgatgcttcacacgtcggagcatggtgggaaagcttaccgtcacgcggtggaggaactgcctgagaccatggaaactttattgctgctcggcctgatgatccttctgacaggaggcgccatgctcttcttgataagcgggaagggactgggtaaaacctcaatcggcttaatttgtgtcatcgcatccagtgggatgctatggatggctgagattcccctgcaatggatcgcctctgccatagttctcgagtttttcatgatggtgcttctgattccagaacctgagaagcagcgcaccccgcaggataaccaattggcatatgtagtgatcggaattctgacactcgctgccatcatagcggctaatgaaatgggcctgcttgagactacgaagcgagacctcggtatgagcaaagaacccggggtcgtgtccccaacctcatacctggatgttgacttgcaccctgcctctgcatggacactgtacgccgtggctactaccgtcatcacacccatgttaagacataccattgagaacagcactgcaaacgtaagtctagccgcgatcgctaatcaggccgtggttctgatgggcctcgacaagggatggccaatttccaaaatggatcttggcgtgcctctgttggcactggggtgctatagccaggtcaaccccctcacgctgacagccgctgtgcttttactgatcacccactacgccataattggaccgggcctccaggcaaaggctactagggaggcccaaaaacggaccgcggccggtatcatgaagaatccaacagtcgacgggatcatgactattgatttggaccctgtgatctatgattctaagtttgaaaaacagctgggacaggttatgctactggtgctctgtgcagtacagcttctgttgatgcgcacctcatgggctctgtgcgaggccctcacactggcaacgggccccataaccactttatgggaaggttccccaggcaagttctggaacacaaccattgctgtgagtatggccaatatctttagagggagctaccttgccggagcgggcctggctttctcgattatgaaatctgtcgggactggaaagaggggcacaggttcccaaggggagaccctcggagaaaaatggaagaagaaactaaaccagctgagccggaaggagtttgacttgtataaaaagtcaggcatcacggaggttgatcgaaccgaagcaaaagagggtctgaagagaggcgaaataacacatcacgccgtgagtcgcgggtctgctaaactccagtggttcgtcgagaggaatatggtgatccccgaaggacgggtaattgaccttggctgtgggcgtggaggctggtcctactattgcgccggtctgaagaaggtgactgaggttagagggtacaccaaaggaggccctggccatgaggaaccggtgcccatgagcacatacgggtggaacatcgtcaagttgatgtcaggaaaagatgtgttttatctgccacctgagaagtgtgacactctcttatgcgatattggtgaaagtagcccctcccctaccgtcgaggagtctaggacaatccgcgtgctgaaaatggttgaaccatggcttaagaataaccagttctgtattaaggtactgaatccctacatgcctaccgtgatcgagcacctagaacggctccaacgaaaacacggcgggatgctggtcagaaacccattgagcaggaattccactcatgagatgtattggatatcaaacggaacgggcaatattgtggcatctgttaacatggtgagtcgcctgctccttaaccggttcacaatgacccacagacgtcccactatcgaaaaggacgtcgatctgggtgccgggaccaggcatgtgaatgctgagccggagacacctaacatggacgtaatcggagaacggattaaacgcataaaggaggaacacaattcgacgtggcactacgacgatgagaacccatataaaacctgggcgtaccatggcagctatgaagtgaaggccactggctccgcatcttcaatgatcaatggggttgtcaagttactgacaaaaccctgggacgtggtgcctatggtcattcagatggctatgaccgatactacaccatttggacagcaacgagttttcaaggagaaagtggacaccagaacacccaggagcatgccgggtactcggcgcgtaatgggcatcaccgccgagtggttgtggagaacgctcgggaggaacaagaaacctcgactgtgcacccgggaagagtttacaaagaaggtgcgtactaatgcagccatgggagctgtcttcaccgaagagaaccagtgggattccgccaaagcggcagtggaagacgaggatttttggaagctagttgacagagagcgcgaacttcacaaactgggcaagtgtggtagttgcgtgtacaatatgatggggaaaagggagaagaaactcggagaattcggcaaggccaagggctctcgggctatttggtacatgtggctgggggccagatatttggagtttgaggcactgggattcctcaacgaagatcattggtttagccgcgagaattcatactccggtgtcgaaggcgaggggcttcacaaactgggatatatcttaagggacataagtaagatccccggcggtgctatgtacgccgatgacacagctgggtgggacactcgaattaccgaagatgacctgcataacgaggagaaaatcacgcagcagatggatccagaacaccggcaattggccaatgcaattttcaagctcacatatcagaacaaagtggtaaaggttcagagacctacccccactggaacagtgatggacatcataagcaggaaggatcagcgcggctctggccaagtcgggacctacggactgaatacttttaccaacatggaggcgcagctaattcgtcagatggaaggtgagggcgtgctttccaaagccgacctggaaaacccacacctccccgagaagaaaatcacacagtggctggagacgaagggggtggaacggttgaaaagaatggctatctcaggagatgactgcgtcgttaagcctattgatgacaggttcgccaatgcattactggctctcaacgatatgggcaaggtgcgcaaagacataccacaatggcagccgagcaagggttggcatgattggcagcaggtacccttttgttcgcaccatttccacgagcttatcatgaaagacgggcgaaagctggtggtcccttgccggccacaagacgaactaattggaagagccaggatctctcagggcgcaggctggagtctgcgcgagaccgcctgtctcgggaaagcgtatgctcagatgtggtccttgatgtacttccacagacgggatctgaggcttgccagcaatgcaatttgctcagccgtgcccgttcattgggtgcctacttcccgtacaacctggtctatccacgctcatcaccaatggatgactacagaagacatgctgaccgtctggaaccgagtgtggatagaggataatccatggatggaggacaagacgcccgtaacaacctgggaaaacgttccttacctcggaaagcgcgaggatcagtggtgtggtagcttaatcggcctgactagtagagccacctgggcacagaatattccgacagctatccagcaagtgcggtccttgattgggaacgaagagtttctggactatatgccaagcatgaaaaggttccgcaaggaggaagagtctgaaggagccatctggtga

SEQ ID NO: 15532 - RNA, 9873 nt, synthetic construct
  misc_feature 1..9873: note = derived and/or modified CDS sequence (opt3) from DENV-3__FJ639807__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaagatacagcccttcctggctttaggatttttcctcaggaaactgacttctcgcgagaaccttctgctaggcgtcggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaaaactgactggctcccaatgaccgtcgcggctatgggcgtaccccctctgcccttgtttatcttctctctgaaggatacgttaaagcgtagaagctggccactcaatgaaggggtgatggccgttggactggtgtcaattcttgcaagttccctgttgaggaacgacgtccctatggccggccccctcgtggctggtgggctgctaatcgcatgttacgtaattacaggaacctctgccgatctgactgtggagaaagcggctgacgtcacatgggaagaggaagccgagcagaccggcgttagccataaccttatgatcactgtggacgatgacggcacaatgcgcataaaggatgacgagaccgaaaatattctcacggtgctgttgaaaactgcattactgatcgtctccgggatctttccatactcaattccggccaccctcctggtgtggcacacatggcagaagcagacccaacggagcggagttctttgggatgtacctagtcccccagagacacagaaagctgaactggaggagggtgtgtatagaataaagcagcagggcatcttcgggaaaactcaagtcggagtgggcgttcagaaggaaggtgtgtttcataccatgtggcacgtcacgaggggggccgtgttgacatacaacggaaagcgactagagcccaattgggcatctgtaaaaaaggacctgatttcctatggcggcgggtggcgcctcagcgctcagtggcaaaaaggagaagaggtccaggtgatcgccgttgaacctggtaagaacccaaaaaatttccagactatgcccggcaccttccagacaaccactggggagattggagcgatcgccctggattttaagcctggcacctcgggttcaccgataatcaaccgggaggggaaggtggtcggactttacggcaatggcgtggttacaaaaaacgggggatatgtgtctggtattgcacaaacgaatgctgaaccagacggccccactcctgagttagaagaggaaatgttcaagaaaagaaacctgaccatcatggatctccacccagggagtggaaagacaaggaaatacttgcccgccattgtccgtgaggctatcaagcgccggctgagaaccctcatactggcacctactagggtggtagccgccgagatggaagaggctcttaagggcctgccgattcgatatcagacaaccgcgacgaaatccgaacatactggtcgggagatcgtggacttgatgtgccacgcaacatttaccatgcgcctactgagccccgttagagtcccaaattacaacctcatcattatggatgaagcccatttcaccgaccctgcttctatcgccgcaagggggtacataagcactcgggtgggaatgggcgaggccgctgcgatttttatgacagccacccccccaggcacagcagatgctttccctcagtccaatgcccccatccaggacgaggaacgagacattccagagagatcatggaacagtgggaatgaatggatcactgattttgcaggaaagacggtgtggttcgtcccgagcataaaagccggtaacgacattgctaactgtttacgcaagaatggcaaaaaggtaatccaactgtctaggaagacctttgatacagagtatcagaaaactaagcttaacgactgggatttcgtggttaccacagacatctccgagatgggggccaattttaaagcggatcgtgtgattgaccctcggagatgcctgaagcccgtcatcctcaccgatggaccagaaagggtgattttggcaggccccatgcctgttactgccgcttcagccgctcagcgccgaggtagagtggggcggaacccacagaaagagaatgaccaatacatattcacgggccagcccctgaacaatgatgaagaccacgcacattggaccgaggccaagatgctcctggacaacatcaatacacctgaaggaattatcccggctcttttcgagccagagagggaaaagagtgccgcaatcgatggcgagtatcgcctaaaaggggaaagccgtaagacttttgtcgagctgatgagacggggagacttgcccgtgtggttagcgcacaaagtagcctccgaaggtattaagtacaccgataggaaatggtgcttcgacggccagcgcaacaatcagatactggaggagaacatggatgtggaaatctggacaaaggagggggaaaaaaagaagctccgacctagatggctggacgctcggacctattctgatccccttgccctgaaagagtttaaggacttcgcagctggaaggaaatcgattgccctcgatttggttactgaaatcggccgcgtcccaacacacctggcacatagaacgaggaatgccctagacaacctggtgatgctccacaccagcgagcatggtgggaaggcttaccggcacgcggtggaggaacttcctgagactatggaaacactgttattgctgggcctcatgattctgcttaccggaggcgccatgctgtttctcatctcagggaaaggaataggtaagacctccatcggcttgatttgtgtcatcgcaagttctgggatgctgtggatggctgagattcccttacaatggatcgccagcgccatagttctagagttctttatgatggtgctgctcattccagaacctgagaagcagcgtacaccgcaggataatcaacttgcatatgtagtgatcggaattctgactttggctgccacgatcgcggctaacgaaatgggcctgctcgagaccacaaaacgcgacctgggtatgtccaaggaacccggggtcgtgtcaccaacttcttaccttgatgttgacctccaccctgccagcgcatggaccctgtacgccgtggctacaaccgtcataactcccatgttgcgacatacgatcgagaatagtacagcaaacgtatccctggccgcgattgctaaccaggccgtggttttaatgggcctagacaaaggatggccaatcagcaagatggatctgggcgtgcctctccttgcactggggtgctattctcaggtcaatcccttgaccctgactgccgctgtgctcctgcttattacccactacgccatcataggaccgggcttacaggcaaaagctacaagagaggcccaaaagaggactgcggccggtattatgaagaacccaaccgtcgacgggatcatgacaatcgatctggaccctgtgatttatgattcaaaattcgaaaagcagctcggacaggttatgttgctggtgctatgtgcagtacagctgctccttatgcggacgtcctgggctctgtgcgaggccttgaccctggcaactggccccatcacaaccctctgggaaggtagtccaggcaaattttggaatactacaatagctgtgagcatggccaacattttccgcgggtcgtacctggccggagcgggcttagctttttctatcatgaagtccgtcgggaccggaaaaagaggcacgggtagccaaggggagacccttggagaaaagtggaagaaaaggctgaatcagctctcacggaaggagttcgacctatataaaaagagtggcattacagaggttgatcgaactgaagcaaaagagggtctgaagagaggcgaaatcacccatcacgccgtgtctcgcgggtccgctaaattgcagtggtttgtcgagaggaacatggtgatacccgaaggacgggtaatcgacctgggctgtgggcgtggaggctggagctactattgcgccggtctcaagaaggtgacagaggttagagggtacactaaaggaggccctggccatgaggaaccggtgcccatgtcaacctacgggtggaatattgtcaagcttatgagtggaaaagatgtgttctatctgccacctgagaagtgtgacacattgctgtgcgatatcggtgaaagctccccctctcctaccgtcgaggagagcaggactattcgcgtgctcaaaatggttgaaccatggttaaagaacaatcagttctgtatcaaggtactgaacccctacatgcctacggtgattgagcaccttgaacggctgcaacgaaaacacggcgggatgctagtcagaaatccactctccaggaactcaacacatgagatgtattggatctctaatggaaccggcaacatagtggcaagtgttaatatggtgtcgcgcctgttgctgaaccggtttactatgacccacagacgtcccacaattgaaaaggacgtcgatctcggtgccgggacgaggcatgtgaacgctgagccggagacccctaatatggacgtaatcggagaacggatcaaacgcattaaggaggaacacaacagcacttggcactacgacgatgagaatccatataaaacatgggcgtaccatggctcctatgaagtgaaggccaccggctctgcatcaagcatgataaacggggttgtcaagcttctgactaaaccctgggacgtggtgcctatggtcacacagatggctatgaccgatacaactccattcggacagcaacgagtttttaaggagaaagtggacaccagaacgcccaggtccatgccgggtacccggcgcgtaatgggcatcacagccgagtggttatggagaactctggggaggaataagaaacctcgattgtgcacccgggaagagttcacaaagaaggtgcgtactaacgcagccatgggagctgtctttaccgaagagaatcagtgggatagtgccaaagcggcagtggaagacgaggatttctggaagctcgttgacagagagcgcgaactgcacaaactaggcaagtgtggttcttgcgtgtacaacatgatggggaaaagggagaagaaacttggagaatttggcaaggccaagggcagccgggctatttggtacatgtggctgggggccagatatctcgagttcgaggcactgggatttttgaatgaagatcattggttctcacgcgagaactcctacagtggtgtcgaaggcgaggggctgcacaaactcggatatatccttagggacattagcaagatccccggcggtgctatgtacgccgatgacacggctgggtgggacacacgaataaccgaagatgacctgcataatgaggagaaaatcactcagcagatggatccagaacaccggcaattagccaacgcaatttttaagctgacatatcagaataaagtggtaaaggttcagagacctacccccactggaaccgtgatggacatcatttctaggaaggatcagcgcggctccggccaagtcgggacatacggattgaacacgttcaccaatatggaggcgcagctcatccgtcagatggaaggtgagggcgtgctgtcaaaagccgacctagaaaacccacaccttcccgagaagaaaataactcagtggctggagacaaagggggtggaacggctcaaaagaatggctattagcggagatgactgcgtcgttaagcctatcgatgacaggtttgccaacgcactgttggctttaaatgatatgggcaaggtgcgcaaagacatcccacaatggcagccgtcgaagggttggcatgattggcagcaggtacccttctgttctcaccatttccacgagctgattatgaaagacgggcgaaagctcgtggtcccttgccggccacaagacgaacttataggaagagccaggatcagtcagggcgcaggctggtccctgcgcgagaccgcctgtctagggaaagcgtatgctcagatgtggagcctgatgtactttcacagacgggatctcaggttggcctcaaacgcaatttgctccgccgtgcccgttcattgggtgcctacttctcgtacaacctggagcatccacgctcatcaccaatggatgacgacagaagacatgctgaccgtctggaatcgagtgtggattgaggataacccatggatggaggacaagactcccgtaaccacatgggaaaatgttccttaccttggaaagcgcgaggatcagtggtgtggtagtctgatcggcctcacttccagagccacctgggcacagaacataccgacagctatccagcaagtgcggagcttaattgggaatgaagagttcctggactatatgccatctatgaaaaggtttcgcaaggaggaagagtcagaaggagccatctggtga

SEQ ID NO: 15533 - RNA, 9873 nt, synthetic construct
  misc_feature 1..9873: note = derived and/or modified CDS sequence (opt3) from DENV-3__FJ639810__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacactggttgtgtgatcaattggaaagggaaggagctgaagtgcggatccggcattttcgtgacaaacgaggtccatacctggactgaacagtacaaatttcaagcagattctcccaagcggctagccaccgctatcgccggtgcatgggagaatggcgtttgtgggatacgaagcacaacgcgcatggaaaacctcctgtggaaacagatcgctaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggccaggatagtgacagcggaaactcaaaacagttccttcattatcgatggccccaataccccagagtgccccaacacgagccgggcctggaatgtttgggaagtggaggactatggttttggggtcttcacaaccaacatttggctgaagcttcgcgaagtgtacactcagttgtgtgaccacagactcatgtctgctgcagttaaagatgagagggccgtgcacgctgacatgggatactggatcgagtcacagaagaatggcagttggaaactggaaaaggccagcctaatagaggtaaaaacctgcacatggcctaagtcccatactctgtggtctaacggtgtcctcgaatcggatatgatcattccaaagagcctggcaggcccgatctcccagcacaattatcgtcccgggtaccatacccaaacagcgggaccttggcaccttggcaaattggagctggactttaactattgcgaggggacgaccgtggtgattactgaaaattgtggaacacggggcccatcattacgaaccactacagtcagtggtaagctcatccacgagtggtgctgtagatcttgcaccctgccccctcttaggtacatgggggaagatggatgttggtatggcatggagatacgcccaattagcgaaaaagaggagaacatggttaagtccctggtgtcagccggtagcggcgaagtagacaatttcacgatgggggtgttgtgcctcgctatcctgtttgaggaagtcatgcggggaaaattcggcaagaagcatatgatcgccggggtgctattcacttttgttctgctcctgtctggacagattacctggagagatatggcacacacacttatcatgattggctccaacgctagtgacaggatgggtatgggggtgacctacttggccctgatagcaactttcaaaatccagccctttttagccctcggattctttctgcgcaagcttacaagccgagagaatctgctactcggcgtcggcctggctatggcgaccacattgcaactgccggaagatattgagcagatggccaacgggatcgcattaggactcatggctctgaaacttattactcagttcgagacctatcagctgtggacggccttgatctctctcacatgttccaataccatatttactctgaccgtggcctggcggacagctactctaatcctggcaggtgtttcacttctccctgtgtgccaaagtagctcgatgcgtaagaccgactggctgccaatgacggtcgccgcgatgggcgtaccccctttgcccctgttcattttttgtttaaaagatacactcaagagaaggtcctggccactgaacgaaggggtgatggctgttggacttgtgtctatcctggccagctcattgctccgcaacgacgtccctatggcaggccccctggtggccggtgggctactgattgcttgctacgtaatcaccggaactagtgcagatcttacagtggagaaggccgcggacgtcacctgggaagaggaagctgagcagactggcgtttcccataatctcatgataacagtggacgatgacggcaccatgcggattaaagatgacgagacggaaaacatcctgactgtgttgttaaagaccgccctgctcatcgtctctgggattttcccatacagcataccggcaacactgcttgtgtggcacacctggcagaaacagacacaaagatccggagttctgtgggatgtaccttcacccccagagactcagaaggccgaattggaggagggtgtgtataggatcaaacagcagggcatttttgggaagacccaagtcggagtgggcgttcagaaagaaggtgtgttccatacgatgtggcacgtcacacgaggggctgtgctaacttacaatggaaagcgcctggagcccaactgggccagcgtaaagaaagacctcatcagttatggcggcgggtggcggctgtctgcacagtggcaaaagggagaagaggtccaggtgattgctgttgaacctggtaaaaatccaaagaactttcagaccatgcccggcacattccagaccactaccggggagatcggagccatagcgcttgatttcaaacctggcacatccggtagcccgatcattaatagagaggggaaggtggtcggattatacggcaacggcgtggttacgaagaatgggggatatgtgtcgggtatcgcccaaactaacgcagaaccagacggccccacccctgagctggaagaggaaatgtttaaaaagaggaatctcacaattatggatttgcacccagggtcaggaaaaacccgtaagtacctgcccgctatcgtccgcgaggccataaaacggagactcaggactctgattcttgctcctacacgagtggtagcagccgagatggaagaggccctgaagggcttgccgatccggtatcagaccacggctactaagtctgaacatacaggtcgcgagatcgtggacctaatgtgtcacgcgaccttcaccatgagactgctcagtcccgttagggtcccaaactacaatttaattatcatggatgaagcacattttactgaccctgcctccatagctgcccgggggtacattagcacacgagtgggaatgggcgaggcagccgctatcttcatgaccgcgacacccccaggcactgccgatgcatttcctcagtctaacgctcccattcaggacgaggaaagagacatcccagagcgcagctggaattccgggaacgaatggataacggatttcgccggaaaaaccgtgtggtttgtcccgtcaattaaggcaggtaacgacatcgccaattgcctgaggaaaaacggcaagaaagtaatccaacttagtcgtaagacattcgatactgagtatcagaagaccaaactgaatgactgggattttgtggttacaaccgacattagcgagatgggggctaacttcaaggccgatcgggtgatcgaccctagaaggtgcctcaaacccgtcattttgactgatggaccagaacgcgtgatactggcgggccccatgcctgttacggcagcctctgctgcccagcgaagaggtcgggtggggaggaatccacagaaggagaacgaccaatacatctttaccggccagcccctcaataacgatgaagaccacgctcattggacagaggcaaaaatgctgcttgacaatattaacactcctgaaggaatcatgccggccctattcgagccagagcgcgaaaagtccgctgccatcgatggcgagtatcgtctgaagggggaatcaagaaaaaccttcgtcgagttgatgcggaggggagacttacccgtgtggctggcacacaaggtagcgagtgaaggtattaaatacacagatcgcaagtggtgttttgacggccagcgaaataaccagatactcgaggagaatatggatgtggaaatctggaccaaagagggggaaaagaaaaagctgagacctcggtggcttgacgccaggacttatagcgatcccctggctctcaaggagttcaaagactttgccgcaggacgcaagtccattgctttggatctggttacagaaatcggcagagtcccaacgcacctagcccataggacccggaacgcactggacaatctcgtgatgcttcacacttctgagcatggtgggaaagcctaccgtcacgctgtggaggaactgcctgagacaatggaaaccttattgctgctcggcctgatgattcttctgaccggaggcgcgatgctcttcttgatctcggggaagggaataggtaaaacaagcatcggcctgatttgcgtcatcgcctcatccgggatgttatggatggcagagattcccctacaatggatcgctagtgccatagttctggagtttttcatgatggtgctccttattccagaacctgagaagcagcgcactccgcaggataaccaactggcctatgtagtgatcggaattttgacgctggcagctatcatagccgcgaatgaaatgggcctcctggagaccacaaagcgagaccttggtatgtctaaagaacccggggtcgtgagcccaacttcctacctcgatgttgacctgcaccctgcttcagcctggaccttgtacgcagtggccacaaccgtcatcactcccatgctgagacatacgattgagaactctacagctaacgtaagcttagcagccatcgcgaatcaggctgtggttctaatgggcctggacaagggatggccaattagtaaaatggatctcggcgtgcctcttctggccttggggtgttattcccaggtcaaccccctgaccctcactgcagccgtgctgcttttaatcacccactacgctataattggaccgggcctgcaggccaaggcaacaagggaggctcaaaaacggactgccgcgggtatcatgaagaatccaaccgtcgacgggatcatgacaattgatctcgaccctgtgatctatgatagcaagtttgaaaaacagttgggacaggttatgctgctagtgctgtgcgccgtacagctccttctgatgcgcacgtcttgggcattgtgtgaggctctgaccctcgccactggccccataacaaccctgtgggaaggttcaccaggcaagttctggaacactacaattgcagtgtccatggctaatatctttagagggagttacttagccggagccggccttgcgttcagcattatgaaatcggtcgggaccggaaagaggggcacgggttctcaaggggagaccctgggagaaaaatggaagaagaaactcaaccagctatcccggaaggagtttgacctgtataaaaagagcggcatcacagaggttgatcgaactgaagctaaagagggtttgaagagaggcgaaataacccatcacgcagtgtcacgcgggagtgccaaactgcagtggttcgtcgagaggaatatggtgatccccgaaggacgggtaattgacctcggctgcgggcgtggaggctggtcttactattgtgctggtcttaagaaggtgacagaggttagagggtacactaaaggaggccctggccatgaggaaccggtgcccatgtccacctacgggtggaacatcgtcaagctgatgagcggaaaagatgtgttttatttgccacctgagaagtgcgacacactgctctgtgatattggtgaatcaagtcccagccctaccgtcgaggagtccaggactatccgcgtgttaaaaatggttgaaccatggctgaagaataaccagttctgcattaaggtacttaatccctacatgcctgccgtgatcgagcacctggaacggctacaacgaaaacacggcgggatgctcgtcagaaacccactgtctaggaatagcacgcatgagatgtattggatatccaacggaacaggcaatattgtggcatcagttaacatggtgtctcgcttgctgctcaaccggttcaccatgactcacagacgtcccaccatcgaaaaggacgtcgatcttggtgccgggacaaggcatgtgaatgctgagccggagacgcctaacatggacgtaatcggagaacggattaaacgcataaaggaggaacacaatagtacctggcactacgacgatgagaacccatataaaacttgggcgtaccatggctcgtatgaagtgaaggccacaggcagcgcatcctctatgatcaatggggttgtcaagctgttaaccaaaccctgggacgtggtgcctatggtcactcagatggctatgacagataccacaccatttggacagcaacgagttttcaaggagaaagtggacactagaacccccaggtcaatgccgggtacgcggcgcgtaatgggcattaccgccgagtggctgtggagaacattggggaggaacaagaaacctcgactctgtactcgggaagagtttaccaagaaggtgcgtacaaatgcagccatgggagctgtcttcactgaagagaaccagtgggatagcgccaaagcggcagtggaagacgaggatttttggaagctggttgacagagagcgcgaactacacaaacttggcaagtgcggttcctgcgtgtacaatatgatggggaaaagggagaagaaactgggagaattcggcaaggccaagggcagtcgggctatctggtacatgtggctcggggccagatatctggagtttgaggcattgggattcctgaacgaagatcattggttttctcgcgagaatagctactcaggtgtcgaaggcgaggggctccacaaacttggatatattctgagggacatctccaagatacccggcggtgctatgtacgccgatgacaccgctgggtgggacacgcgaatcacagaagatgacttatataacgaggagaaaattacccagcagatggatccagaacatcggcaactggccaatgcaatcttcaagttgacttaccagaacaaagtggtaaaggttcagagacctacacccaccggaactgtgatggacattatcagtaggaaggatcagcgcggcagcggccaagtcgggacctatggactcaatacatttacgaacatggaggcgcagctgatacgtcagatggaaggtgagggcgtgctatctaaagccgaccttgaaaacccacacctgcccgagaagaaaattacccagtggctcgagactaagggggtggaacggctgaaaagaatggctatctccggagatgactgtgtcgttaagcctatcgatgacaggttcgccaatgcattgttagctctgaacgatatgggcaaggtgcgcaaagacattccacaatggcagccgtcaaagggttggcacgattggcagcaggtacccttttgcagccatcacttccatgagctcataatgaaagacgggcgaaagcttgtggtcccttgtcggccacaagacgaactgatcggaagagccaggatttcgcagggcgcaggctggtctctacgcgagacagcctgcctggggaaagcgtacgctcagatgtggagtctcatgtacttccacagacgggatttgaggctggcctccaatgcaatctgtagcgccgtgcccgttcactgggtgcctacctcacgtactacatggtccattcatgctcaccatcaatggatgaccacggaagacatgcttacagtctggaaccgagtgtggatcgaggataatccatggatggaggacaagacccccgtaactacctgggaaaacgttccttatctgggaaagcgcgaggatcagtggtgcggttctctcataggcttaacaagcagagccacttgggcacagaatatcccgaccgctattcagcaagtgcggagtctgatcgggaacgaagagtttttggactacatgccatccatgaaaaggttccgcaaggaggaagagagcgaaggagccatttggtga

SEQ ID NO: 15534 - RNA, 9873 nt, synthetic construct
  misc_feature 1..9873: note = derived and/or modified CDS sequence (opt3) from DENV-3__FJ639816__SS-prME
  source 1..9873: mol_type = other RNA
accagcctgtgcctcatgatgatccttcccgccacactggctttccacttgacttccagagacggcgagcctaggatgattgtggggaagaacgaacggggaaaatctttactgtttaagacggcatcaggtataaatatgtgtaccctaatcgccatggatctcggcgagatgtgcgacgatacagtcacttacaaatgtccacatattaccgaagttgagccggaagacatcgattgctggtgtaacctgacaagtacctgggtgacttatgggacatgcaatcaggcgggagagcaccgccgagacaagcgtagcgtagctcttgccccccatgtgggcatgggtctggataccagaacgcaaacttggatgtccgcagagggggcctggaggcaggtcgaaaaagtggagacctgggctttgcggcaccctggattcacaattctcgcactgtttctggcccattacatcggcacttctctcacccagaaggttgtgatattcatcttactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacattgagctccagaagactgaagcgacacaactggcaacccttaggaaactgtgtatcgagggaaagattacgaacatcaccacagatagccggtgccctactcagggcgaagccgtcttgccagaggaacaggaccagaattatgtttgtaaacacacctacgtggatcgcggttgggggaacggatgcggcctcttcggcaaggggagtctggtaacatgcgctaagtttcaatgtttagagcccatagagggaaaagtggtccagtatgaaaatctgaagtacactgtgattatcaccgttcatacaggtgaccagcaccaggtgggcaacgagacccaaggggtcactgccgaaattacgcctcaggcatccacaaccgaggctatcctcccagaatatggaactcttggcctggagtgctctccgcgaaccggtttggacttcaatgagatgatcctactgacaatgaaaaacaaggcctggatggtgcatagacagtggtttttcgatctccccctgccttggaccagcggggcgactacagaaacgccaacctggaataggaaagagcttctggtaacttttaagaacgcccacgcaaaaaagcaagaagttgtggtcttgggctcccaggagggagctatgcacacagccctcaccggcgctacagaaattcagaattcagggggaactagtatattcgccggtcatctgaagtgtcggttaaaaatggacaagctggagctaaaaggcatgagctacgcaatgtgcaccaacacgtttgtgctcaagaaagaggtctctgaaacccagcacgggacaatcctgattaaggtggagtacaagggagaagatgttccctgtaaaatccctttctccactgaggacgagcaaggcaaggcccataacggtcgtcttataaccgctaatccagtggtaacaaaaaaggaagagcccgtcaacattgaagcggagccgcctttcggggaatcaaatatcgtgatcggcattggagataacgcattgaaaatcaattggtataagaagggcagcagtattgggaaaatgtttgaggccactgctcgcggagccagaaggatggcaatactgggtgacaccgcctgggatttcggctctgttgggggagtgctcaactccctgggcaagatggtccaccagatctttggtagcgcttacacggcccttttctcgggggtgtcttgggtaatgaaaattggcatcggagtgctgttgacatggatcggcctcaattccaagaacacctcaatgagttttagctgcattgcaatagggatcattactctgtatttaggagcggttgtccaggctgacatgggctgtgtgatcaattggaaaggtaaggagctgaagtgcgggtccggaattttcgtgacaaacgaagtccatacctggactgagcagtacaaatttcaagccgattctcccaagcggctagcaaccgccatcgctggcgcctgggaaaatggtgtttgtggcatacgaagcacaacgcgcatggagaacctcctgtggaaacagatcgcaaatgaacttaactatattttgtgggagaataacatcaagctgaccgtggtggtaggggacattatcggagtcctcgagcagggcaaaagaactctgacaccacagcctatggaattaaagtactcatggaaaacctgggggaaggctaggatagtgacagccgagactcaaaacagttccttcattatcgatggacccaataccccagaatgccccagcgcgtctcgggcctggaacgtttgggaggtggaagactatggctttggtgtcttcacgacaaatatttggctgaagcttcgcgaggtgtacacccagttgtgtgaccacagactcatgtcagctgcagttaaagatgagagggccgtgcacgctgacatggggtactggatcgaaagtcagaagaacggaagctggaaactggagaaggcctccctaatagaagtaaaaacttgcacctggcctaagtctcatacactgtggtcgaatggcgtcctcgagagcgatatgatcattccaaagtccctggcaggtccgatctcacagcacaactatcgtcccggctaccatactcaaaccgcggggccttggcaccttggaaaattggagctggactttaattattgcgaaggcacaacggtggtgattaccgagaactgtgggactcggggaccaagtttacgaacaaccactgtctctggcaagctcatccacgaatggtgctgtagaagctgcacactgccccctcttaggtacatgggtgaggatgggtgttggtatggaatggaaatacgcccaatttccgagaaagaggaaaatatggttaagtcactggtgagcgccggctctggtgaggtagacaacttcaccatgggcgtgttgtgcctcgctatcctgtttgaagaggtcatgcgggggaaattcggaaagaagcatatgatcgccggcgtgttctttacgttcgttctactgctctccgggcagattacttggagagatatggcacacaccctgatcatgattggaagtaatgctagcgacaggatgggcatgggtgtgacataccttgccttgatagcaacctttaaaatccagcccttcctggccttagggtttttcctccgcaagctgacttctcgagaaaaccttctgctaggagtcggcctcgctatggcgacaaccctgcaattgccggaggatattgagcagatggccaatggcatcgcactggggttaatggctctcaaactgattacacagtttgaaacttatcagctttggaccgccctgatctccttgacgtgttcaaacacaatattcaccctcactgtggcctggcggaccgctacactgatcctagcaggagttagtctgcttcctgtgtgccaaagctcgtccatgcgtaagactgactggctcccaatgaccgtcgccgcgatgggtgtaccccctctgcccttgtttattttctctctgaaagatacgttaaagagaaggagctggccactcaatgagggcgtgatggctgttgggctggtgtcaatccttgccagttccctgttgcgcaacgacgtccctatggcaggacccctcgtggccggcggtctgctaattgcttgttacgtaatcacagggacctctgcagatctgactgtggaaaaggccgcggacgtcacatgggaggaagaggctgagcagaccggagttagccataaccttatgataactgtggacgatgacggcacaatgcggattaaagatgacgaaaccgagaatatcctcacggtgctgttgaagactgccttactgatcgtctccggcatttttccatactcaataccggcaaccctcctggtgtggcacacatggcagaaacagacccaaagaagcggggttctttgggatgtacctagtcccccagaaacacagaaggccgagctggaggaaggagtgtataggatcaaacagcagggtattttcggcaagactcaagtcggggtgggagttcagaaagagggcgtgtttcataccatgtggcacgtcacgcgaggtgctgtgttgacatacaacgggaagcgcctagaacccaattgggcctctgtaaagaaagacctgatctcctatggaggcggctggcggctcagcgcacagtggcaaaagggggaggaagtccaggtgattgctgttgagcctggaaaaaacccaaagaatttccagactatgcccggtaccttccagacaaccactggcgagatcggggccatagcgctggattttaaacctggaacctcgggctcaccgatcattaacagagaaggtaagatcgtggggctttacggaaatggcgtcgtgacaaagaacggcgggtatgtttctggaattgcccaaacgaatgcagagccagacggtcccactcctgaattagaggaagagatgttcaaaaagaggaacctgaccatcatggatctccacccaggcagtgggaaaacacgtaagtacttgcccgctatagtgcgcgaggccattaaacggagactgaggaccctcatcctggctcctactcgagtcgtggcagccgaaatggaggaagcccttaagggactgccgatccggtatcagacaaccgctacgaagtccgagcatactggccgcgaaattgtagacttgatgtgccacgcgacatttaccatgagactactgagccccgtgagggttccaaattacaacctcatcataatggatgaggcacatttcaccgaccctgcctctattgctgcccggggttacatcagcactcgagtcgggatgggagaggcagccgctatttttatgacagcgacccccccaggcacagccgatgcattccctcagtccaatgctcccatccaggacgaagagagagacataccagaacgctcatggaacagtggcaatgagtggattactgattttgccgggaaaacggtgtggttcgtgccgagcatcaaggcaggaaacgacatcgccaactgtttaaggaaaaatggtaagaaagtcattcaactgtctcgtaagacctttgatacagagtatcagaagactaaacttaacgactgggatttcgtagtgaccacagacatctccgaaatgggcgctaattttaaggccgatcgggttattgaccctagaaggtgcctgaaacccgtgatactcaccgatgggccagagcgcgtcatcttggcgggacccatgcctgtgactgcagcctcagctgcccagcgaagaggccgggttggtaggaacccacagaaggaaaatgaccaatacattttcacggggcagcccctgaacaatgatgaggaccacgctcattggaccgaagcaaaaatgctcctggacaacatcaatacacctgagggcatcattccggcccttttcgagccagaacgcgagaagagtgctgccatagatggagaatatcgtctaaagggcgagagcagaaaaacttttgtggaactgatgcggaggggggacttgcccgtctggttagcacacaaggtggcgtccgagggaatcaaatacaccgatcgcaagtggtgcttcgacggtcagcgaaacaatcagattctggaggaaaacatggatgtagagatctggacaaaagaaggcgagaagaaaaagctcagacctcggtggctggacgccaggacctattctgatccccttgctctgaaggaatttaaagacttcgccgcagggcgcaagtcgattgctctcgatttggtgactgagatcggaagagttccaacacacctggcccataggacgcggaatgcactagacaacctggtcatgctccacaccagcgagcatggcggtaaagcctaccgtcacgctgtggaagagcttcctgaaactatggagacactgttattgctggggctcatgatactgcttaccggcggagcgatgctgtttctcatctcaggcaaggggattggaaaaacctccatcggtttgatttgtgtgatcgccagttctggcatgctgtggatggcagagatacccttacaatggattgctagcgccatcgtcctagaattctttatgatggttctgctcattccagagcctgaaaagcagcgcacaccgcaggataatcaacttgcctatgtggtaatcgggatactgactttggcagctacgatcgccgcgaacgagatgggactgctcgaaaccacaaagcgagacctgggcatgtccaaagagcccggtgtggtctcaccaacttcttaccttgatgtggacctccaccctgctagcgcctggaccctgtacgcagttgccacaaccgtgattactcccatgttgagacatacgatcgagaatagtacagctaacgtctccctggcagccattgcgaaccaggctgtagtgttaatggggctagacaagggctggccaatcagcaaaatggatctgggagttcctctccttgccctgggctgctattctcaggtgaatcccttgaccctgactgcagccgtcctcctgcttataacccactacgctattatcgggccgggattacaggccaaggcaacaagggaagctcaaaaacggactgccgcgggcatcatgaagaacccaaccgtggacggtattatgacaatcgatctggaccctgtcatatatgattcaaagttcgagaaacagctcgggcaggtgatgttgctggttctatgtgccgtgcagctgctccttatgcgcacgtcctgggcactgtgcgaagctttgaccctggccactggacccattacaaccctctgggagggcagtccaggtaagttttggaatactacaatcgcagtaagcatggctaacattttcagaggctcgtacctggccggggccggattagcgttttctgtgatgaaatccgtcggcaccgggaagaggggaacgggcagccaaggtgaaacccttggggagaaatggaagaagaaactgaatcagctctcacggaaggagttcgacctatataaaaagagtggaatcacagaagttgatcgaactgaggctaaagaaggcctgaagagaggtgagataacccatcacgcagtgtctcgcggctccgccaaattgcagtggtttgtcgaaaggaacatggtgatccccgaggggcgggtaattgacctgggatgtggccgtgggggatggagctactattgcgctggcctcaagaaggtgacagaggttagaggttacactaaagggggacctggccatgaagagccggtgcccatgtcaacctacggctggaatatcgtcaagcttatgagtgggaaagatgtgttctatctgccacctgaaaagtgtgacacattgctgtgcgatattggagagagctccccctctcctaccgtcgaggaaagcaggactatccgcgtgctcaaaatggttgagccatggttaaagaacaatcagttctgtattaaggtactgaacccctacatgcctacggtgatcgaacaccttgagcggctgcaacgaaaacacggtggcatgctagtcagaaatccactctccaggaactcaacacatgaaatgtattggatatctaatgggaccggaaacattgtggccagtgttaatatggtgtcgcgcctgttgctgaaccggtttactatgacccacagacgtcccacaatcgagaaggacgtcgatctcggcgcaggtacgaggcatgtgaacgccgagccggaaacccctaatatggacgtaatcggggagcggattaaacgcataaaggaagagcacaacagcacttggcactacgacgatgaaaatccatataaaacatgggcttaccatggatcctatgaggtgaaggcgaccggctctgcctcaagcatgatcaacggcgttgtcaagcttctgactaaaccctgggacgtggtgcctatggtcacacagatggcaatgaccgatacaactccattcgggcagcaacgagtttttaaggagaaagtggacaccagaacgcccaggtccatgccgggaacccggcgcgtaatgggtattacagctgaatggttatggagaactctgggcaggaataagaaacctcgattgtgcacccgggaggaattcacaaagaaggtgcgtactaacgccgcaatgggggccgtctttaccgaggaaaatcagtgggatagtgctaaagccgcggtggaggacgaggatttctggaagctcgttgacagagaacgcgagctgcacaaactaggaaagtgtggctcttgcgtgtacaacatgatgggtaaaagggaaaagaaacttggggagtttggaaaggcaaagggcagccgggccatctggtacatgtggctgggcgctagatatctcgagttcgaagccctggggtttttgaatgaggatcattggttctcacgcgaaaactcctacagtggagtcgagggtgaaggcctgcacaaactcgggtatattcttagggacatcagcaagatacccggaggcgcaatgtacgctgatgacacggccggttgggacacacgaatcaccgaggatgacctgcataatgaggaaaaaattactcagcagatggatccagagcaccggcaattagctaacgccatctttaagctgacatatcagaataaagtggtaaaggttcagagacctacccccactgggaccgtgatggacattatctctaggaaggatcagcgcggatccggccaagtcggcacatacgggttgaacacgttcaccaatatggaagcacagctcatacgtcagatggagggagaaggtgtgctgtcaaaagcggacctagagaacccacaccttcccgagaagaaaattactcagtggctggaaacaaagggcgtggagcggctcaaaagaatggccatcagcggggatgactgcgtcgttaagcctatcgatgacaggtttgctaacgccctgttggcattaaatgatatgggaaaggtgcgcaaagacattccacaatggcagccgtcgaagggctggcatgattggcagcaggtacccttctgttctcaccatttccacgaactgataatgaaagacggtcgaaagctcgtggtcccttgccggccacaagacgagcttatcgggagagctaggattagtcagggagccggctggtccctgcgcgaaaccgcatgtctaggcaaagcctatgcgcagatgtggagcctgatgtactttcacagacgggatctcaggttggcttcaaacgccatctgctccgcagtgcccgttcattgggtgcctacttctcgtacaacctggagcattcacgcccatcaccaatggatgacgacagaggacatgctgaccgtctggaatcgagtgtggatcgaggataacccatggatggaagacaagactcccgtaaccacatgggagaatgttccttaccttgggaagcgcgaagatcagtggtgtggaagtctgataggtctcacttccagagctacctgggcccagaacatcccgacagcaattcagcaagtgcggagcttaatcggcaatgaggagttcctggactatatgccatctatgaaaaggtttcgcaaggaagaggaatcagagggggctatttggtga

SEQ ID NO: 15535 - RNA, 9873 nt, synthetic construct
  misc_feature 1..9873: note = derived and/or modified CDS sequence (opt3) from DENV-3__FJ639817__SS-prME
  source 1..9873: mol_type = other RNA
acaagcctgtgcctcatgatgatccttcccgccgctctggcattccacttgacatccagagacggagagcctaggatgattgtggggaagaacgaacggggaaaatctttactgtttaagactgcctcaggtataaatatgtgtacgttaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacgtcacgaccgatagccggtgccctacacagggcgaagctgttttgccagaggaacaggaccagaattatgtgtgtaaacacacttacgtagatcgcggttgggggaacggatgcggcctcttcggcaaggggagtctggtgacctgcgccaagtttcaatgtttagagcccatcgagggaaaagtcgtgcagtatgaaaatctgaagtacacagttataattactgtgcataccggtgaccagcaccaggtcggcaacgagacacaaggggtgaccgcagaaatcactcctcaggcttccacgacagaggccattctcccagaatatggaacccttggcctggagtgctctccgcgaactggtttggacttcaatgagatgatcctactgaccatgaaaaacaaggcgtggatggtacatagacagtggtttttcgatctccccctgccttggacaagcggggccaccactgaaacaccaacgtggaataggaaagagcttctggttacctttaagaacgcacacgctaaaaagcaagaagtggtcgtgttgggctcccaggagggagccatgcacactgctctcacaggcgccaccgaaatccaaaattcagggggaacaagtattttcgcaggtcatctgaagtgtcggttaaaaatggacaagctggagctaaaaggcatgagctacgccatgtgcactaacacctttgtcctcaagaaagaggtgtctgaaacgcagcacgggaccatactgatcaaggttgagtacaagggagaagatgtgccctgtaaaattcctttctccacagaggacggccaaggtaaggctcataacgggcgtcttatcactgcgaatccagtagtcaccaaaaaggaggaacccgtgaacatagaggcagaaccgcctttcggcgagtcaaatattgttatcggaatcggcgataacgccttgaaaattaattggtataagaaggggagcagtatcggaaaaatgtttgaagctacagcccgcggtgcaagaaggatggccattctgggcgacactgcttgggatttcgggtctgtgggaggcgtcctcaactccctgggtaagatggtgcaccagatatttgggagcgcctacaccgcacttttctcgggcgtatcttgggtgatgaaaatcggaattggcgttctgttgacgtggatcgggctcaattcccggaacacatcaatgagttttagctgcatcgcgattggaataatcaccctgtatttaggcgctgtcgtgcaggccgacatgggttgtgtgattaattggaaggggaaagagctgaagtgcggatccggcatcttcgtcactaacgaggttcatacatggaccgaacagtacaagtttcaagcagattctcccaaacgactagccactgctattgccggtgcatgggagaatggcgtgtgtgggatccgcagcaccacaagaatggaaaacctcctgtggaagcagatagctaatgagcttaactatatcttgtgggaaaataacattaaactgacggtggtagtcggagacatcattggcgtgctcgagcaggggaagaggaccctgactccacagcctatggagttaaaatactcatggaagacatggggaaaagccaagatcgttaccgcggaaacacaaaacagttccttcataattgatggccccaatactccagagtgccccagcgcctctcgggcttggaacgtgtgggaagtcgaggactatggttttggggtgttcaccacgaatatctggctgaaacttcgcgaagtttacacacagttgtgtgaccacagactcatgtcagcagccgtgaaagatgagagggctgtacacgccgacatgggatactggattgagagtcagaagaacggcagctggaaactggaaaaggcatccctaatcgaggtcaaaacctgcacttggcctaagtctcataccctgtggtcgaatggtgtgctcgaaagcgatatgataatcccaaagtccctggcgggcccgatttcacagcacaactatcgtcccgggtaccatacacaaactgccggaccttggcaccttggcaaattggagctggactttaattattgcgaggggaccacagtggtcatcacggaaaactgtggaacccggggcccaagtttacgaactacaaccgtttctggtaagctcattcacgagtggtgctgtagaagctgcactctgccccctcttaggtacatgggggaagatggatgttggtatggcatggagatccgcccaatatccgaaaaagaggagaatatggtgaagtcactggtaagcgctggttctggcgaagtggacaacttcacaatgggggtcttgtgcctcgccattctgtttgaggaagtgatgcggggaaaattcggcaagaagcatatgatcgcaggggttttctttaccttcgtgctactgctctccggacagatcacgtggagagatatggctcacactctgattatgatcggcagtaatgccagcgacaggatgggtatgggggtcacctaccttgcattgattgccacatttaaaatacagcccttcctggctttaggatttttcctccgcaagctgacctctcgagagaaccttctgctaggcgtgggcctcgcgatggccactacactgcaattgccggaagatatcgagcagatggcaaatgggattgctctgggattaatggccctcaaactgatcacccagtttgagacatatcagctttggactgccctgatttccttgacctgttcaaacacgatcttcacactcaccgttgcttggcggactgcaaccctgatactagccggtgtgagtctgcttcctgtctgccaaagctcgtccatgcgtaagacagactggctcccaatgactgtagcggctatgggcgtgccccctctgcccttgtttatcttctctctgaaagataccttaaagagaaggagctggccactcaatgaaggggttatggccgtgggactggtctcaattcttgcaagttccctgttgcgcaacgacgtgcctatggccggccccctcgtagctggtgggctgctaatcgcatgttacgtgattacgggaacatctgccgatctgaccgtcgagaaggcggctgacgttacttgggaagaggaagccgagcagacaggcgtgagccataaccttatgatcaccgtggacgatgacggcactatgcggataaaagatgacgagacagaaaatattctcaccgtcctgttgaagacggcattactgatcgtgtccgggatctttccatactcaattccggccactctcctggtttggcacacctggcagaaacagacacaaagaagcggagtactttgggatgtgcctagtcccccagagacccagaaggctgaactggaggagggtgtctataggataaaacagcagggcatcttcgggaagacacaagtgggagttggcgtgcagaaagaaggtgtctttcatactatgtggcacgtgacccgaggggccgtattgacgtacaacggaaagcgcctagagcccaattgggcatctgtcaagaaagacctgatttcctatggcggcgggtggcggctcagcgctcagtggcaaaagggagaagaggtgcaggttatcgccgtggaacctggtaaaaacccaaagaatttccagacaatgcccggcactttccagaccacaaccggggagattggagcgatcgccctggattttaaacctggcacttcgggttcaccgataatcaacagagaggggaaggtcgtgggactttacggcaatggcgttgtgaccaagaacgggggatatgtctctggtattgcacaaacaaatgctgaaccagacggccccacgcctgagttagaagaggaaatgttcaaaaagaggaacctgactatcatggatctccacccagggagtggaaaaacccgtaagtacttgcccgccattgtgcgcgaggctatcaaacggagactgaggacactcatactggcacctacccgagtagtggccgccgagatggaagaggctcttaagggcctgccgattcggtatcagactacagcgaccaagtccgaacatacgggtcgcgagatcgttgacttgatgtgccacgcaacttttacaatgagactactgagccccgtcagggtgccaaattacaacctcatcattatggatgaagcccatttcaccgaccctgcttctatcgccgcacgggggtacataagcacccgagtgggaatgggcgaggccgctgcgatttttatgactgccacacccccaggcaccgcagatgctttccctcagtccaatgcccccatccaggacgaggaaagagacattccagagcgctcatggaacagtgggaatgaatggatcacagattttgcaggaaaaactgtctggttcgtaccgagcataaaggccggtaacgacattgctaactgtttaaggaaaaatggcaagaaagtgatccaactgtctcgtaagacgtttgataccgagtatcagaagacaaaacttaacgactgggatttcgttgtgactaccgacatctccgagatgggggccaattttaaggcggatcgggtcattgaccctagaaggtgcctgaaacccgtgatcctcacagatggaccagaacgcgttattttggcaggccccatgcctgtgaccgccgcttcagccgctcagcgaagaggtcgggtcgggaggaacccacagaaggagaatgaccaatacatattcactggccagcccctgaacaatgatgaagaccacgcacattggacggaggccaaaatgctcctggacaacatcaatacccctgaaggaattatcccggctcttttcgagccagagcgcgaaaagagtgccgcaatcgatggcgagtatcgtctaaagggggaaagcagaaaaacatttgtggagctgatgcggaggggagacttgcccgtatggttagcgcacaaggtggcctccgaaggtattaaatacactgatcgcaagtggtgcttcgacggccagcgaaacaatcagatactggaggagaacatggatgttgaaatctggaccaaagagggggaaaagaaaaagctcagacctcggtggctggacgctaggacatattctgatccccttgccctgaaggagtttaaagacttcgcagctggacgcaagtcgattgccctcgatttggtcaccgaaatcggcagagtgccaactcacctggcacataggacacggaatgccctagacaacctggtgatgctccacacgagcgagcatggtgggaaggcttaccgtcacgcggtcgaggaacttcctgagaccatggaaactctgttattgctgggcctcatgattctgcttacaggaggcgccatgctgtttctcatctcagggaagggaataggtaaaacctccatcggcttgatttgtgttatcgcaagttctgggatgctgtggatggctgagattcccttacaatggatcgccagcgccatagtgctagagttctttatgatggtactgctcattccagaacctgagaagcagcgcaccccgcaggataatcaacttgcatatgtggtcatcggcattctgacattggctgccatcatagcggctaacgaaatgggcctgctcgagactacgaagcgagacctgggtatgtccagagaacccggggtggtttcaccaacctcttaccttgatgtggacctccaccctgccagcgcatggacactgtacgccgtcgctactaccgtaatcacacccatgttgaggcataccattgagaatagtactgcaaacgtgtccctggccgcgatcgctaaccaggccgttgtgttaatgggcctagacaaaggatggccaattagcaagatggatctgggcgtccctctccttgcactggggtgctattctcaggtgaatcccttgacgctgacagccgctgtcctcctgcttatcacccactacgccataattggaccgggcttacaggcaaaagctactcgggaggcccaaaagcgcaccgcggccggtatcatgaaaaacccaacagtggacgggatcatgactattgatctggaccctgttatctatgattcaaagttcgaaaagcagctcggacaggtgatgttgctggtactatgtgcagtgcagctgctccttatgagaacctcctgggctctgtgcgaggccttgacactggcaacgggccccataaccactctctgggaaggtagtccaggcaaattttggaatacaaccattgctgtcagcatggccaacatcttcagggggtcgtacctggccggagcgggcttagctttttctattatgaagtccgttgggactggaaaacggggcacaggtagccaaggggagacccttggagaaaagtggaaaaagaagctgaatcagctctcacgaaaagagttcgacctatataagaaaagtggcatcacggaggtggatagaaccgaagcaaaggagggtctgaaacgcggcgaaataacacatcacgccgtctctagggggtccgctaagttgcagtggtttgtggagcggaacatggtaatccccgaaggacgtgtgattgacctgggctgtgggagaggaggctggagctactattgcgccggtctcaaaaaggttactgaggtgagggggtacaccaagggaggccctggccatgaggaaccggtccccatgtcaacatacgggtggaatatcgtgaaacttatgagtggaaaggatgtcttctatctgccacctgagaaatgtgacactttgctgtgcgatattggtgaaagctccccctctcctaccgtggaggagagccgcacaatccgggttctcaagatggtagaaccatggctaaagaacaatcagttctgtattaaggtgctgaacccctacatgcctgcagtcatcgagcaccttgaacgactgcaaagaaagcacggcgggatgctagtgaggaatccactctcccgcaactcaacccatgagatgtattggatatctaatggaactggcaacattgttgccagtgtgaatatggtctcgcggctgttgctgaacagatttacgatgacacaccgtaggcccaccatcgaaaaagacgtggatctcggtgctgggactcggcatgtaaacgcggagccggagacccctaatatggacgtgatcggagaacgcattaagcgaataaaagaggaacacaacagcacatggcactacgacgatgagaatccatataagacgtgggcctaccatggctcctatgaagttaaagcaaccggctctgcttcaagcatgatcaacggggtcgtgaaacttctgactaagccctgggacgtggtccctatggttacacagatggccatgaccgatactacaccattcggacagcaaagagtgtttaaagagaaggtagacaccaggacaccccggtccatgccgggtactcgcagagtgatgggcattaccgcagagtggttatggaggacgctggggcgaaataaaaagcctcggttgtgcacccgtgaagagttcaccaagaaggtcagaactaacgccgctatgggagccgtgtttaccgaagagaatcagtgggatagtgcgaaggcagccgttgaagacgaggatttctggaaactcgtggaccgcgagagggaactgcacaagctaggcaaatgtggttcttgcgtctacaacatgatggggaagcgggagaagaaacttggagaatttggcaaagctaaaggcagcagagccatctggtacatgtggctgggggcacgctatctcgagttcgaggctctgggatttttgaatgaagatcattggttctcaagggagaactcctacagtggtgtggaaggcgaggggctgcacaagctcggatatattcttcgagacatcagcaaaatacccggcggtgccatgtacgctgatgacacagccgggtgggacactcggatcaccgaagatgacctgcataatgaggagaagattacgcagcagatggatccagaacacagacaattagcaaacgcgatctttaaactgacatatcagaataaggtagttaaagtgcagaggcctacccccactggaacagtcatggacattatctctcgcaaggatcagcgtggctccggccaagtggggacctacggattgaacactttcaccaatatggaggcccagctcatacggcagatggaaggtgagggcgtgctgtcaaaggctgacctagaaaacccacaccttcccgagaaaaagattacacagtggctggagacgaaaggggtcgaaagactcaagaggatggccatcagcggagatgactgcgttgtgaaacctatcgatgaccgctttgcaaacgctctgttggccttaaatgatatgggcaaggtacgaaaggacattccacaatggcagccgtcgaaaggttggcatgattggcaacaggtgcccttctgttctcaccatttccacgagctgataatgaaggacgggcggaaactcgtcgtgccttgcagaccacaagacgaacttatcggaagggcacgcattagtcagggcgccggctggtccctgagagagaccgcgtgtctagggaaggcttatgcccagatgtggagcctgatgtactttcaccggagggatctccgtttggcatcaaacgccatctgctccgctgttcccgtgcattgggtccctacttctcgaacaacctggagcattcacgcccatcaccaatggatgactacagaagacatgctgaccgtgtggaatcgcgtatggatcgaggataacccatggatggaggacaaaacgcccgttacaacctgggaaaatgtgccttaccttggaaagagagaggatcagtggtgtggtagtctgataggcctcacttcccgggcaacctgggctcagaacatcccgacagccattcagcaagtcaggagcttaatcgggaatgaagagttcctggactatatgccatctatgaagcgctttagaaaagaggaagagtcagaaggagcgatttggtga

SEQ ID NO: 15536 - RNA, 9873 nt, synthetic construct
  misc_feature 1..9873: note = derived and/or modified CDS sequence (opt3) from DENV-3__FJ639825__SS-prME
  source 1..9873: mol_type = other RNA
accagcctgtgcctcatgatgatccttcccgccgctctggcattccacttgacctccagggacggcgaacctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtagaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggattacaagggagaggacgttccctgtaaaatccctttctccacagaagatggccaaggtaaggctcataacgggcgtcttataactgcgaatccagtggtaaccaaaaaggaggagcccgtcaacattgaagcagagccgcctttcggcgaatcaaatatcgtgatcggaattggcgacaacgccttgaaaatcaattggtataagaaggggagcagtattggaaaaatgtttgaggctacagcccgcggtgcaagaaggatggccatactgggcgatactgcttgggacttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgatactggttgtgtgatcaattggaaagggaaggaactgaagtgcggatccggcattttcgtgacaaacgaggtccatacctggactgagcagtacaaatttcaagcagactctcccaagcggctagccaccgctatcgccggtgcatgggaaaatggcgtttgtgggatacgaagcacaacgcgcatggagaacctcctgtggaaacagatcgctaatgaacttaactatattttgtgggagaataacatcaagctgaccgtggtggtaggagatattatcggcgtcctcgaacaggggaaaagaactctgacaccacagcctatggagttaaagtactcatggaaaacctggggaaaggccaagatagtgacagcggagactcaaaacagttccttcattatcgacggccccaataccccagaatgccccagcgcctctagggcttggaacgtttgggaggtggaagactatggttttggggtcttcacgacaaatatttggctgaaacttcgggaggtgtacacccagcagtgtgatcaccgcttgatgtcagcagccgttaaggacgaaagagctgtgcacgccgatatgggatactggatcgagagtcagaaaaacggcagctggaagctcgagaaagcatccctgatagaagtaaagacttgcacctggcctaagtctcatacactatggtcgaatggtgtcctggagagcgacatgatcattccaaaatccctcgcgggcccgatctcacaacacaactataggcccgggtaccatactcagaccgccggaccttggcacctgggcaaacttgaattggattttaattattgcgaggggacaacggtggtgattaccgagaactgtggaactcgtggcccaagtctgcggacaaccactgtctctggtaaattaatccacgaatggtgctgtcgaagctgcacactcccacctctgagatacatgggggaggacggatgttggtatggcatggaaataaggccaatttccgagaaggaagagaatatggttaaatcacttgtgagcgctggttctggcgaggtagataacttcaccatgggggtgctgtgcttggccatcctctttgaagaggtcatgcgcggaaagttcggcaagaaacatatgatcgcaggggtgttctttacgttcgttctgctactgtccggacagattacttggcgggacatggctcacaccctcatcatgattggcagtaatgccagcgatagaatgggtatgggggtgacatacctggcacttatagccacctttaagatccaacccttcttggctctgggatttttcttaaggaaactcacttctcgcgaaaacctgcttctgggcgtcggcctagcgatggccacaaccctccagctgccggaggacattgaacagatggcaaatgggatcgctttgggactgatggccttaaagctcattacacagtttgagacttatcaactgtggaccgcccttatctccctgacgtgttcaaacacaatattcaccttgactgtggcttggcgaaccgcaacactcatcctggccggtgttagtctactgcctgtgtgccagagctcgtccatgcggaaaactgattggcttccaatgaccgtcgcggctatgggcgtaccccctctccccctgtttattttctctttgaaggacacgctgaagcgtagaagctggccattaaatgagggggtgatggccgttggactcgtgtcaatcctggcaagttcccttctgaggaacgatgtccctatggccggccccttggtggctggtgggctcctgattgcatgttacgtaatcacaggaacctctgccgacctaactgtggaaaaagcggctgacgtcacatgggaggaagaggccgaacagaccggcgttagccataacctgatgataactgtggatgacgatggcacaatgcgcattaaggacgatgagaccgagaatatccttacggtgctcctgaaaactgcattgttaatcgtctccgggatttttccatactcaataccggccaccctgctcgtgtggcacacatggcagaagcaaacccagcggagcggagttctgtgggacgtacctagtcccccagaaacacagaaagctgagcttgaagagggtgtgtatagaatcaagcagcaaggcattttcgggaaaactcaggtcggagtgggcgttcagaaggagggtgtgtttcataccatgtggcacgtcacgagaggggccgtgctgacatacaacggaaagcgattggaacccaattgggcatctgtcaagaaggatctaatctcctatggcggcgggtggcgcctgagcgctcaatggcagaaaggagaggaagtccaggtgattgccgttgagcctggtaagaaccccaagaatttccagactatgcccggcaccttccaaacaaccactggggaaatcggagcgatagccctcgactttaagcctggcacctcgggttcaccgatcattaaccgggaggggaaggtggtcggactgtacggcaatggcgtggttaccaagaacgggggatatgtgtctggtatcgcacagacgaatgctgagccagatggccccactcctgaacttgaggaagagatgttcaagaaaagaaacttaaccattatggacctgcacccagggagtggaaagacaaggaaatacctccccgccatcgtccgtgaagctataaagcgccggttgagaaccctgattctcgcacctactagggtggtagccgccgagatggaggaagctctgaagggccttccgatccgatatcagacaaccgcgacgaaatccgagcatactggtcgggaaatcgtggatctgatgtgccacgcaacatttaccatgcgcttgctaagccccgttagagtcccaaattacaacctgattatcatggacgaggcccatttcaccgatcctgcttctatagccgcaagggggtacattagcactcgggtgggaatgggcgaagccgctgcgatctttatgacagccacacccccaggcacagcagacgctttccctcagtccaatgcccccattcaagacgaggagcgagatatcccagaaagatcatggaacagtgggaatgagtggataactgactttgcaggaaagacggtgtggttcgtcccgagcattaaagccggtaacgatatcgctaactgtctccgcaagaatggcaaaaaggtaatccagttatctaggaagacctttgacacagaatatcagaaaactaagctgaacgattgggacttcgtggttaccacagatatttccgagatgggggccaattttaaagcggaccgtgtgatcgatcctcggagatgccttaagcccgtcattctgaccgacggaccagagagggtgatactcgcaggccccatgcctgttactgccgcttcagccgctcagcgccgaggtagagtggggcggaacccacaaaaagaaaatgatcagtacatcttcacgggccagcccttgaacaatgacgaggaccacgcacattggaccgaagccaagatgctgctcgataacattaatacacctgagggaatcatcccggctctgttcgaaccagagagggagaagagtgccgcaattgacggcgaatatcgccttaaaggggagagccgtaagacttttgtcgaactaatgagacggggagatctgcccgtgtggttggcgcacaaagtagcctccgagggtataaagtacaccgacaggaaatggtgcttcgatggccagcgcaacaatcaaatcttagaagagaacatggacgtggagatttggacaaaggaaggggagaaaaagaagctgcgacctagatggctcgatgctcggacctattctgaccccctggcccttaaagaatttaaggatttcgcagctggaaggaaatcgatcgccctggacctcgttactgagattggccgcgtcccaagccacttggcacatagaacaaggaatgccctggataacctagtgatgctgcacacgtcagaacatggtgggaaggcttaccggcacgcggtggaggagctccctgaaaccatggagactcttctgttattgggcctgatgatcctcctgacaggaggcgccatgctttttctgatatccgggaaaggaatcggtaagaccagtattggcctcatctgtgtcattgcatctagcgggatgttgtggatggctgaaatccccctgcagtggatagcctccgccattgttttagagttctttatgatggtgctactgatcccagagcctgaaaagcagcgtaccccgcaagacaatcagctcgcatatgtagtgattggaatccttacactggctgccataatcgcggctaacgagatgggcttgctggaaactacgaaacgcgatctcggtatgtcaaaggagcccggggtcgtgtctccaaccagctacctggacgttgaccttcaccctgccagtgcatggacactctacgccgtggctactaccgtcattacacccatgctgcgacataccatcgaaaattccactgcaaacgtcagcttggccgcgattgctaaccaggccgtggttctgatgggcttagataaaggatggccaatctctaagatggacctaggcgtgcctctgctcgcacttgggtgctattcacaggtcaatcccctgacgttgacagccgctgtgctgctcctgataacccactacgccattatcggaccgggccttcaagcaaaagctactagagaggcccagaagaggaccgcggccggtatcatgaagaacccaacagtcgatgggattatgactatcgacttagatcctgtgatatatgactccaaattcgagaagcagctgggacaggttatgctcttggtgctgtgtgcagtacaactactgctcatgcggaccagttgggctctttgcgaagccctgacattggcaacgggccccattaccactctgtgggagggtagcccaggcaaattttggaatacaaccatcgctgtgtcgatggccaacattttccgcgggtcttacctcgccggagcgggcctggctttttccatcatgaaaagcgtcgggactggaaaaagaggcacaggttcacagggggaaaccttaggagagaagtggaagaagaaacttaatcagctgagtaggaaagagttcgatctctataagaaatctggcataacggaggttgaccggaccgaggcaaaagaaggtctaaaacgaggcgagatcacacatcacgccgtgtccagagggagcgctaagctgcagtggtttgtcgaacgcaacatggtgattcccgagggaagggtaatcgatttgggctgtgggcggggaggctggtcatactattgcgccggtctgaagaaagtgactgaagttcgtgggtacaccaagggaggccctggccatgaggagccggtgcccatgagtacatacgggtggaatattgtcaaactcatgagcggaaaggacgtgttctatcttccacctgaaaaatgtgatactctgttgtgcgacatcggtgagtcctctcccagccctaccgtcgaagagtccagaacaattagggtgctgaagatggttgagccatggctcaagaacaatcaattctgtatcaaagtattaaacccctacatgcctaccgtgatagaacacctggagcgccttcagcggaagcacggcgggatgctggtccgaaatccactatcaagaaactctactcatgaaatgtattggattagtaatggaacgggcaacatcgtggcatcggttaatatggtgagcaggctcctgttgaaccgctttacaatgacccaccggagacccactatcgagaaagatgtcgacctgggtgccgggacccgtcatgtgaacgctgaaccggagacacctaatatggacgtaattggagagaggataaagcggatcaaagaagaacacaactccacgtggcactacgatgacgaaaatccatataagacctgggcgtaccatggctcttatgaggtgaaggccactggctcagcaagctccatgattaacggggttgtcaaactccttacaaagccctgggatgtggtgcctatggtcacccagatggctatgactgacacaaccccattcggacaacagcgcgtttttaaagaaaaggtggatacacgaactcccagaagtatgccgggtaccaggcgggtaatgggcatcacggccgagtggctgtggcgcaccttagggagaaataaaaagcctaggctgtgcacacgagaggagttcactaagaaagtgcggaccaacgcagccatgggagctgtctttacagaggaaaatcagtgggactctgccaaggcggcagtggaggatgaagacttctggaaattggttgatcgtgagagagagctccacaagctgggcaaatgtggtagctgcgtgtacaacatgatggggaagcgcgagaaaaagctaggagagtttggcaaggccaaaggctcaagggctatttggtacatgtggcttggggcccggtatctggagttcgaggcactcggatttctgaatgaggaccattggttctccagagaaaacagttacagcggtgtcgagggcgaagggttgcacaagctgggatatatcctccgcgatatatctaaaatccccggcggtgctatgtacgccgacgacactgctgggtgggataccaggattacggaggacgatcttcataatgaagagaagatcacacagcaaatggacccagagcacaaacagctggccaacgcaatttttaagttaacctatcagaataaggtggtaaaagttcagcgacctactcccacaggaaccgtgatggatatcatatcccggaaggaccaaagaggctcaggccaggtcgggacttacggactgaacaccttcacaaatatggaagcgcagttgattaggcagatggagggtgaaggcgtgctcagcaaagccgatctggagaacccacacctacccgaaaagaaaatcacgcaatggcttgagaccaagggggtggagcgcctgaagcgtatggctatctcgggagacgattgcgtcgttaaacctattgacgatcggtttgccaacgcactcctggctttgaatgacatgggcaaggtgagaaaagatataccacagtggcagccgtctaagggttggcatgactggcagcaagtacccttctgtagtcaccatttccacgaattaatcatgaaagacgggaggaagctggtggtcccttgccgcccacaggatgagctcattggacgagcccggatctcccagggcgcaggctggagccttagagaaactgcctgtctggggaaggcgtatgctcaaatgtggtcactaatgtactttcacaggcgcgacctgagactcgcctccaacgcaatttgctctgccgtgcccgttcattgggtgcctacaagccggaccacttggagtatccacgctcatcaccagtggatgacaaccgaggatatgttgacggtctggaatagggtgtggatagaagacaacccatggatggaggataaaacacccgtaaccacttgggagaatgttccttacctgggaaagcgtgaagaccagtggtgtggttcccttatcggcctgaccagccgagccacatgggcacagaacattccgactgctatccaacaggtgcgctctctcattgggaatgaggagttcttagattatatgccatcaatgaaaagatttcggaaggaggaggaaagtgagggagccatctggtga

SEQ ID NO: 15537 - RNA, 9873 nt, synthetic construct
  misc_feature 1..9873: note = derived and/or modified CDS sequence (opt3) from DENV-3__FJ639826__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacactggttgtgtgatcaattggaaagggaaggagctgaagtgcggatccggcattttcgtgacaaacgaggtccatacctggactgaacagtacaaatttcaagcagattctcccaagcggctagccaccgctatcgccggtgcatgggagaatggcgtttgtgggatacgaagcacaacgcgcatggaaaacctcctgtggaaacagatcgctaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggccaggatagtgacagcggaaactcaaaacagttccttcattatcgatggccccaataccccagagtgccccaacacgagccgggcctggaatgtttgggaagtggaggactatggttttggggtcttcacaaccaacatttggctgaagcttcgcgaagtgtacactcagttgtgtgaccacagactcatgtctgctgcagttaaagatgagagggccgtgcacgctgacatgggatactggatcgagtcacagaagaatggcagttggaaactggaaaaggccagcctaatagaggtaaaaacctgcacatggcctaagtcccatactctgtggtctaacggtgtcctcgaatcggatatgatcattccaaagagcctggcaggcccgatctcccagcacaattatcgtcccgggtaccatacccaaacagcgggaccttggcaccttggcaaattggagctggactttaactattgcgaggggacgaccgtggtgattactgaaaattgtggaacacggggcccatcattacgaaccactacagtcagtggtaagctcatccacgagtggtgctgtagatcttgcaccctgccccctcttaggtacatgggggaagatggatgttggtatggcatggagatacgcccaattagcgaaaaagaggagaacatggttaagtccctggtgtcagccggtagcggcgaagtagacaatttcacgatgggggtgttgtgcctcgctatcctgtttgaggaagtcatgcggggaaaattcggcaagaagcatatgatcgccggggtgttctttactttcgttctactgctctctggacagattacctggagagatatggcacacacactgatcatgattggctccaacgctaccgacaggatgggtatgggggtgacttaccttgccttgatagcaacatttaaaatccagcccttcctggccttaggatttttcctccgcaagctgaccagtcgagagaatcttctgctaggcgtcggcctcgctatggcgacaactctgcaattgccggaagatattgagcagatggccaacgggatcgcactgggattaatggctctcaaactgattacccagtttgagacgtatcagctttggacagccctgatcagcttgacctgttctaatactatattcaccctcacagtggcctggcggactgctaccctgatcctagcaggtgtttccctgcttcctgtgtgccaatcaagtagcatgcgtaagacggactggctcccaatgacagtcgccgcgatgggcgtaccccctctgcccttgtttattttctcgctgaaagataccttaaagagaaggtcctggccactcaacgaaggggtgatggctgttggactggtgtctatccttgccagctcactgttgcgcaacgacgtccctatggcaggccccctcgtggccggtgggctgctaattgcttgttacgtaatcactggaacaagtgcagatctgaccgtggagaaggccgcggacgtcacttgggaagaggaagctgagcagacaggcgtttcccataatcttatgataaccgtggacgatgacggcacgatgcggattaaagatgacgagactgaaaacatcctcaccgtgctgttgaagacagccttactgatcgtctctgggatttttccatacagcataccggcaaccctcctggtgtggcacacatggcagaaacagactcaaagatccggagttctttgggatgtaccttcacccccagagacccagaaggccgaactggaggagggtgtgtataggatcaaacagcagggcattttcgggaagacgcaagtcggagtgggcgttcagaaagaaggtgtgtttcatacaatgtggcacgtcactcgaggggctgtgttgacctacaatggaaagcgcctagagcccaactgggccagcgtaaagaaagacctgatcagttatggcggcgggtggcggctctctgcacagtggcaaaagggagaagaggtccaggtgattgctgttgaacctggtaaaaatccaaagaacttccagacaatgcccggcaccttccagactaccacaggggagatcggagccatagcgctggattttaaacctggcacgtccggtagcccgatcattaatagagaggggaaggtggtcggactttacggcaacggcgtggttactaagaatgggggatatgtgtcgggtatcgcccaaaccaacgcagaaccagacggccccacacctgagttagaagaggaaatgttcaaaaagaggaatctgaccattatggatctccacccagggtcaggaaaaactcgtaagtacttgcccgctatcgtccgcgaggccataaaacggagactgaggacactcattctggctcctacccgagtggtagcagccgagatggaagaggcccttaagggcctgccgatccggtatcagacgactgctacaaagtctgaacataccggtcgcgagatcgtggacttgatgtgccacgcgacctttactatgagactactgagtcccgttagggtcccaaactacaatctcattatcatggatgaagcacatttcacagaccctgcctccatagctgcccgggggtacattagcacccgagtgggaatgggcgaggcagccgctatctttatgacagcgactcccccaggcacggccgatgcattccctcagtctaacgctcccattcaggacgaggaaagagacatcccagagcgcagctggaattccgggaacgaatggataaccgattttacaggaaaaactgtgtggttcgtcccgtcaattaaggccggtaacgacatcgcaaattgtttaaggaaaaacggcaagaaagtaatccaactgagtcgtaagacctttgatacagagtatcagaagaccaaacttaatgactgggatttcgtggttactacggacattagcgagatgggggccaactttaaggctgatcgggtgatcgaccctagaaggtgcctgaaacccgtcattctcaccgatggaccagaacgcgtgatattggccggccccatgcctgttacagcggcatctgccgctcagcgaagaggtcgggtggggaggaatccacagaaggagaacgaccaatacatcttcactggccagcccctgaataacgatgaagaccacgcccattggaccgaggctaaaatgctcctggacaatattaacacacctgaaggaatcatcccggcacttttcgagccagagcgcgaaaagtccgccgctattgatggcgagtatcgtctaaagggggaatcaagaaaaacctttgtcgagctgatgcggaggggagacttgcccgtgtggttagcccacaaggtagcaagtgaaggtataaaatacactgatcgcaagtggtgcttcgacggccagcgaaataaccagatcctggaggagaatatggatgtggaaatttggacaaaagagggggaaaagaaaaagctcagacctcggtggctggacgcgaggacgtatagcgatccccttgccctgaaggagtttaaagacttcgctgccggacgcaagtccatcgcactcgatttggttaccgaaattggcagagtcccaactcacctggctcataggacacggaacgccctagacaatctggtgatgctccacacctctgagcatggtgggaaagcataccgtcacgccgtggaggaacttcctgagaccatggaaacactgttattgctgggcctcatgatcctgcttactggaggcgctatgctgtttctcatatcggggaagggaatcggtaaaacgagcattggcttgatctgtgtcattgcgtcatccgggatgctgtggatggccgagatccccttacaatggatagcaagtgctattgttctagagttctttatgatggtgctgctcatcccagaacctgagaagcagcgcaccccgcaggataaccaacttgcctatgtagtgattggaatcctgacattggccgcaataatcgctgccaatgaaatgggcctgctcgagactaccaagcgagacctgggtatgtctaaagaacccggggtcgtgagcccaacatcctaccttgatgttgacctccaccctgcgtcagcttggaccctgtacgccgtggcaactacggtcattacacccatgttgagacataccatcgagaactctactgccaacgtaagcctggctgcaattgccaatcaggcggtggttttaatgggcctagacaagggatggccaatcagtaaaatggatctgggcgtgcctctccttgctctggggtgctattcccaggtcaaccccttgaccctgacagccgcagtgctcctgcttataactcactacgccattatcggaccgggcttacaggctaaggccaccagggaggcacaaaaacggacagctgccggtatcatgaagaatccaacggtcgacgggattatgaccatcgatctggaccctgtgatatatgatagcaagttcgaaaaacagctcggacaggttatgttgctggtgctatgtgcggtacagctgctccttatgcgcacttcttgggccctgtgcgaggcattgacactggctaccggccccattactacactctgggaaggttcaccaggcaagttttggaacaccacgatcgccgtgtccatggcaaatattttcagagggagttacctggctggagccggcttagcctttagcatcatgaaatcggtcgggaccggaaagaggggcacaggttctcaaggggagactcttggagaaaaatggaagaagaaactgaaccagctctcccggaaggagttcgacctatataaaaagagcggcataaccgaggttgatcgaacagaagcgaaagagggtctgaagagaggcgaaatcactcatcacgctgtgtcacgcgggagtgcaaaattgcagtggtttgtcgagaggaatatggtgattcccgaaggacgggtaatcgacctgggctgtgggcgtggaggctggtcttactattgcgccggtctcaagaaggtgaccgaggttagagggtacacaaaaggaggccctggccatgaggaaccggtgcccatgtccacctacgggtggaacattgtcaagcttatgagcggaaaagatgtgttctatctgccacctgagaagtgtgacactttgctgtgcgatatcggtgaatcaagtcccagccctacggtcgaggagtccaggacaattcgcgtgctcaaaatggttgaaccatggttaaagaataaccagttctgtatcaaggtactgaatccctacatgcctgctgtgatagagcaccttgaacggctgcaacgaaaacacggcgggatgctagtcagaaacccactctctaggaatagcacccatgagatgtattggatttccaacggaactggcaatatcgtggcctcagttaacatggtgtctcgcctgttgctgaaccggtttaccatgacacacagacgtcccacgatcgaaaaggacgtcgatctcggtgcagggaccaggcatgtgaatgccgagccggagactcctaacatggacgtaattggagaacggataaaacgcatcaaggaggaacacaatagtacatggcactacgacgatgagaacccatataaaacctgggcttaccatggctcgtatgaagtgaaggcgactggcagcgcctcctctatgattaatggggttgtcaagcttctgacaaaaccctgggacgtggtgcctatggtcacccagatggcaatgacagatactaccccattcggacagcaacgagtttttaaggagaaagtggacacgagaacccccaggtcaatgccgggtacacggcgcgtaatggagatcactgctgaatggttatggagaaccctgggcaggaacaagaaacctcgattgtgcacacgggaggaattcactaagaaggtgcgtaccaatgccgcaatgggggccgtctttacggaggaaaaccagtgggatagcgctaaagccgcggtggaggacgaggatttctggaagctcgttgacagagaacgcgagctgcacaaactaggaaagtgtggctcctgcgtgtacaatatgatgggtaaaagggaaaagaaacttggggagtttggaaaggcaaagggcagtcgggccatttggtacatgtggctgggcgctagatatctcgagttcgaagccctggggtttttgaacgaggatcattggttctctcgcgaaaatagctactcaggagtcgagggtgaaggcctgcacaaactcgggtatatccttagggacatatccaagatccccggaggcgcaatgtacgctgatgacacagccggttgggacacccgaattactgaggatgacctgcataacgaggaaaaaatcacacagcagatggatccagagcaccggcaattagctaatgccatttttaagctgacctatcagaacaaagtggtaaaggttcagagacctactcccaccgggacagtgatggacatcataagtaggaaggatcagcgcggaagcggccaagtcggcacgtacgggttgaataccttcactaacatggaagcacagctcattcgtcagatggagggagaaggtgtgctgtctaaagcggacctagagaacccacaccttcccgagaagaaaatcacacagtggctggaaaccaagggcgtggagcggctcaaaagaatggccatctccggggatgactgcgtcgttaagcctattgatgacaggtttgctaatgccctgttggcattaaacgatatgggaaaggtgcgcaaagacataccacaatggcagccgtcaaagggctggcatgattggcagcaggtacccttctgtagccaccatttccacgaactgatcatgaaagacggtcgaaagctcgtggtcccttgccggccacaagacgagcttattgggagagctaggatctcgcagggagccggctggtctctgcgcgaaactgcatgtctaggcaaagcctatgcgcagatgtggagtctgatgtactttcacagacgggatctcaggttggcttccaatgccatttgcagcgcagtgcccgttcattgggtgcctacatcacgtaccacgtggtccatccacgcccatcaccaatggatgacaaccgaggacatgctgactgtctggaaccgagtgtggatagaggataatccatggatggaagacaagacccccgtaacaacttgggagaacgttccttaccttgggaagcgcgaagatcagtggtgtggatctctgatcggtctcaccagcagagctacatgggcccagaatattccgacggcaatccagcaagtgcggagtttaattggcaacgaggagttcctggactatatgccatccatgaaaaggtttcgcaaggaagaggaaagcgagggggctatctggtga

SEQ ID NO: 15538 - RNA, 9873 nt, synthetic construct
  misc_feature 1..9873: note = derived and/or modified CDS sequence (opt3) from DENV-3__FJ810416__SS-prME
  source 1..9873: mol_type = other RNA
accagcctgtgcctcatgatgatccttccagccgctctggcattccacttgacttccagagacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaagaagaagctccgacctagatggctggacgctcggacatattctgatccccttgccctgaaagagtttaaggacttcgcagctggaaggaaatcgatcgccctcgatttgatgaccgaaattggccgcgttccaagccacctggcacatagaactaggaatgccctagacaacctggtcatgctccacacatcagagcatggtgggaaggcttaccggcacgcggtggaggaacttcctgagacgatggaaaccctgttattgctgggcctcatgatcctgcttactggaggcgccatgctgtttctcatatccgggaaaggaatcggtaagacaagtattggcttgatctgtgtgattgcatctagcgggatgctgtggatggctgagatccccttacaatggatagcctccgccattgtcctagagttctttatgatggttctgctcatcccagaacctgagaagcagcgtaccccgcaggataatcaacttgcatatgtggtaattggaatcctgaccttggctgccataatcgcggctaacgaaatgggcctgctcgagacaactaaacgcgacctgggtatgtcaaaggaacccggggtggtctctccaacgagctaccttgatgtggacctccaccctgccagtgcatggaccctgtacgccgttgctacaactgtgattacccccatgttgcgacatacaatcgaaaattccaccgcaaacgtcagcctggccgcgattgctaaccaggccgtagtgttaatgggcctagacaaaggatggccaatctctaagatggatctgggcgttcctctccttgcactggggtgctattcacaggtgaatcccttgactctgacggccgctgtcctcctgcttataacacactacgccattatcggaccgggcttacaggcaaaagctaccagagaggcccaaaagaggactgcggccggtatcatgaagaacccaaccgtggacgggattatgacaatcgatctggaccctgtcatatatgattccaaattcgagaagcagctcggacaggtgatgttgctggttctatgtgcagtgcagctgctccttatgcggacaagttgggctctgtgcgaggccttgaccctggcaacaggccccattacgaccctctgggaaggtagcccaggcaaattttggaatactacaatcgctgtatcgatggccaacattttccgcgggtcttacctggccggagcgggcttagctttttccatcatgaaaagcgtggggaccggaaaaagaggcactggttcacaaggggagacacttggagaaaagtggaagaaaaagctgaatcagctcagtaggaaagagttcgacctatataagaaatctggcataaccgaggtcgatcggacggaagcaaaggagggtctgaaacgaggcgaaatcacccatcacgccgtttccagagggagcgctaagttgcagtggtttgtggagcgcaacatggtcattcccgaaggaagggtgatcgacctgggctgtgggcggggaggctggtcatactattgcgccggtctcaagaaagtaacagaggtgcgtgggtacactaagggaggccctggccatgaggaaccggttcccatgagtacctacgggtggaatattgtgaaacttatgagcggaaaggatgtcttctatctgccacctgagaaatgtgacacattgctgtgcgatatcggtgaatcctctcccagccctactgtggaggagtccagaaccattagggtcctcaagatggtggaaccatggttaaagaacaatcagttctgtatcaaagttctgaacccctacatgcctacagtagtggagcaccttgaacgcctgcaacggaagcacggcgggatgctagtccgaaatccactctcaagaaactctacccatgagatgtattggataagtaatggaactggcaacattgtggcatcggttaatatggtgagcaggctgttgctgaaccgctttacgatgacacaccggagacccaccatcgaaaaagacgtcgatctcggtgccgggactcgtcatgtgaacgctgagccggagacccctaatatggacgtaatcggagaaaggattaagcggataaaagaggaacacaactccacatggcactacgacgatgagaatccatataagacgtgggcgtaccatggctcttatgaagtgaaggccaccggctcagcaagctccatgatcaacggggttgtcaaacttctgactaagccctgggacgtggtgcctatggtcacacagatggctatgaccgatactacaccattcggacagcaacgcgtttttaaagagaaggtggacacccgaacacccagaagtatgccgggtactaggcgggtaatgggcattaccgccgagtggttatggcgcacgctggggagaaataaaaagcctaggttgtgcacccgagaagagttcacaaagaaagtgcggactaacgcagccatgggagctgtctttaccgaagagaatcagtgggattctgccaaggcggcagtggaagacgaggatttctggaaactcgttgaccgtgagagagaactgcacaagctaggcaaatgtggtagctgcgtgtacaacatgatggggaagcgcgagaagaaacttggagaatttggcaaagccaaaggctcaagggctatctggtacatgtggctgggggcccggtatctcgagttcgaggcactgggatttttgaatgaagatcattggttctccagagagaacagttacagcggtgtcgaaggcgaggggctgcacaagctcggatatattcttcgcgacatctctaaaatacccggcggtgctatgtacgccgatgacacagctgggtgggacactaggatcaccgaagatgacctgcataatgaggagaagattacgcagcagatggatccagaacaccgacaattagccaacgcaatctttaaactgacatatcagaataaggtggtaaaggttcagcggcctacccccactggaacagtgatggacattatctccagaaaagatcagaggggctcaggccaagtcgggacctacggattgaacactttcaccaatatggaggcgcagctcatacgccagatggaaggtgagggcgtgctgagcaaggccgacctagaaaacccacgtcttcccgagaaaaagattacacagtggctggagacgaaaggggtggaacggctcaagagaatggctatctcgggagatgactgcgtcgttaagcctatcgatgacaggtttgccaacgcactgttggctttaaatgatatgggcaaagtgcgcaaggacattccacaatggcagccgtctaaaggttggcacgattggcagcaggtacccttctgtagtcatcacttccatgagctgataatgaaggacgggcgaaaactcgtggtcccttgccggccacaagacgaacttatcggaagggccaggatttcccagggcgcaggctggagcctgcgcgagaccgcctgtctagggaaggcgtatgctcagatgtggtcactgatgtactttcacagacgggatctcaggttggcctccaacgcaatctgctctgccgtgcccgttcactgggtgcctactagccgtacaacctggagtattcatgctcaccatcaatggatgactacagaagacatgctgaccgtctggaatcgagtgtggatcgaggataacccatggatggaggacaagacgcccataacaacctgggaaaatgtaccttaccttggaaaacgcgaggatcagtggtgtggttccctgatcggcctcactagcagagccacctgggcacagaacattccgacagctatccagcaagttcggtctttaattgggaatgaagagttcctggactatatgccatcaatgaagaggtttcgcaaagaggaagagagtgaaggagccatctggtga

SEQ ID NO: 15539 - RNA, 9873 nt, synthetic construct
  misc_feature 1..9873: note = derived and/or modified CDS sequence (opt3) from DENV-3__GQ252678__SS-prME
  source 1..9873: mol_type = other RNA
accagcctgtgcctcatgatgatccttccagccgctctggcattccacttgacatccagggacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgcacaacggaaagcgactagagcccaattgggcatctgtcaagaaggacctgatctcctacggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttatggcaatggcgtggttaccaaaaacgggggatacgtgtctggtatcgcacaaacaaatgctgaaccagacggccccacgcctgagttagaagaggaaatgttcaagaaaagaaacctgactattatggatctccatccagggagtggaaagaccaggaaatatttgcccgccatcgtccgtgaggctataaagcgccggctgagaacactcattctggcacctaccagggtggtagccgccgagatggaagaggctcttaagggcctgccgatccgataccagactacagcgaccaaatccgaacacacgggtcgggagatcgtggacttgatgtgccatgcaacttttacaatgcgcctactgagccccgttagagtcccaaattataacctcattatcatggatgaagcccacttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtaccagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatatatcttcactggccagcccctgaacaatgatgaagaccatgcacactggacggaggccaagatgctcctggacaacattaatacccctgaaggaatcatcccggctcttttcgagccagagagggaaaagagtgccgcaattgatggcgagtaccgcctaaaaggggaaagccgtaagacatttgtcgagctgatgagacggggagacttgcccgtgtggttagcgcacaaagtagcctccgaaggtataaagtatactgataggaaatggtgcttcgacggccagcgcaacaatcagatcctggaggagaacatggatgtggaaatttggaccaaggagggggagaaaaagaagctccgacctagatggctggacgctcggacatactctgatccccttgccctgaaagagtttaaggacttcgcagctggaaggaaatcgatcgccctcgatttggttaccgaaattggccgcgtcccaactcatctggcacacagaacaaggaatgccctagacaacctggtgatgctccatacgagcgagcacggtgggaaggcttatcggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatacgtagtgattggaatcctgacattggctgccataatcgcggctaacgaaatgggcctgctcgagactacgaaacgcgacctgggtatgtccaaggaacccggggtcgtgtcaccaacctcttatcttgatgttgacctccatcctgccagcgcatggacactgtacgccgtggctactaccgtcattacacccatgttgcgacacaccatcgagaatagtactgcaaacgtatccctggccgcgattgctaaccaggccgtggttttaatgggcctagacaaaggatggccaatcagcaagatggatctgggcgtgcctctccttgcactggggtgctactctcaggtcaatcccttgacgctgacagccgctgtgctcctgcttataacccattatgccattatcggaccgggcttacaggcaaaagctactagagaggcccaaaagaggaccgcggccggtatcatgaagaacccaacagtcgacgggattatgactatcgatctggaccctgtgatatacgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtatctggccggagcgggcttagctttttctatcatgaagtccgtcgggactggaaaaagaggcacaggtagccaaggggagacccttggagaaaagtggaagaaaaagctgaatcagctctcaaggaaagagttcgacctatacaagaaaagtggcataacggaggttgatcggaccgaagcaaaggagggtctgaaacgaggcgaaatcacacaccatgccgtgtctagagggtccgctaagttgcagtggtttgtcgagcgcaacatggtgattcccgaaggaagggtaatcgacctgggctgtgggcggggaggctggagctattactgcgccggtctcaagaaagtgactgaggttcgtgggtataccaagggaggccctggccacgaggaaccggtgcccatgtcaacatacgggtggaatattgtcaaacttatgagtggaaaggatgtgttctacctgccacctgagaaatgtgacactttgctgtgcgatatcggtgaaagctccccctctcctaccgtcgaggagagcagaacaattagggtgctcaagatggttgaaccatggttaaagaacaatcagttctgtatcaaagtactgaacccctatatgcctaccgtgatagagcaccttgaacgcctgcaacggaagcatggcgggatgctagtccgaaatccactctccagaaactcaactcacgagatgtactggatttctaatggaacgggcaacatcgtggcaagtgttaatatggtgtcgaggctgttgctgaaccgctttacaatgacccatcggagacccactatcgaaaaagacgtcgatctcggtgccgggacccgtcacgtgaacgctgagccggagacacctaatatggacgtaattggagaaaggataaagcggatcaaagaggaacacaacagcacgtggcattatgacgatgagaatccatacaagacctgggcgtatcacggctcctacgaagtgaaggccactggctctgcatcaagcatgattaacggggttgtcaaacttctgacaaagccctgggacgtggtgcctatggtcacccagatggctatgactgatacaaccccattcggacagcaacgcgtttttaaagagaaggtggacacacgaactcccagatccatgccgggtaccaggcgggtaatgggcatcacggccgagtggttatggcgcaccctggggagaaataaaaagcctaggttgtgcacacgagaagagttcactaagaaagtgcggaccaacgcagccatgggagctgtctttacagaagagaatcagtgggatagtgccaaggcggcagtggaagacgaggatttctggaaactcgttgaccgtgagagagaactgcataagctaggcaaatgtggttcttgcgtgtataacatgatggggaagcgcgagaagaaacttggagaatttggcaaagccaaaggcagcagggctatttggtacatgtggctgggggcccggtacctcgagttcgaggcactgggatttttgaatgaagatcactggttctcaagagagaactcctatagtggtgtcgaaggcgaggggctgcataagctcggatacatccttcgcgacataagcaaaatccccggcggtgctatgtatgccgatgacactgctgggtgggacaccaggattacggaagatgacctgcacaatgaggagaagatcacacagcagatggatccagaacaccgacaattagccaacgcaatttttaaactgacctaccagaataaggtggtaaaggttcagcggcctactcccacaggaaccgtgatggacatcatatctagaaaagatcagaggggctccggccaagtcgggacttatggattgaacaccttcacaaatatggaggcgcagctcattcgccagatggaaggtgagggcgtgctgtcaaaggccgacctagaaaacccacatcttcccgagaaaaagatcacgcagtggctggagaccaaaggggtggaacgtctcaagcggatggctatcagcggagatgactgcgtcgttaagcctattgatgacagatttgccaacgcactgttggctttaaatgatatgggcaaagtgaggaaggacataccacaatggcagccgtcgaaaggttggcacgattggcagcaggtacccttctgttctcatcacttccacgagctgatcatgaaggacgggcgcaaactcgtggtcccttgccgaccacaagacgaacttattggacgggccagaatcagtcagggcgcaggctggtccctgagggagactgcctgtctagggaaggcgtacgctcagatgtggagcctgatgtattttcatcgcagagatctccggttggcctcaaacgcaatttgctccgccgtgcccgttcactgggtgcctacatctaggaccacttggagcatccatgctcaccatcaatggatgacaaccgaagacatgctgacggtctggaatcgtgtgtggatagaggataacccatggatggaggacaagacacccgtaaccacttgggaaaatgttccttaccttggaaaacgagaggatcagtggtgtggtagtctgatcggcctcacctcccgcgccacatgggcacagaacattagcactgctatccagcaagtgagatctttaattgggaatgaagagttcctggactacatgccgtcaatgaagcggtttaggaaagaggaagagagtgaaggagccatctggtga

SEQ ID NO: 15540 - RNA, 9873 nt, synthetic construct
  misc_feature 1..9873: note = derived and/or modified CDS sequence (opt3) from DENV-3__FJ850098__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggatcccgtcaacattgaagcagagccgcctttcggcgaatcaaatatcgtgatcggaattggcgacaacgccttgaaaatcaattggtataagaaggggagcagtattggaaaaatgtttgaggctacagcccgcggtgcaagaaggatggccatactgggcgatactgcttgggacttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgatatgggttgtgtgatcaattggaaagggaaggaactgaagtgcggatccggcattttcgtgactaacgaggtccatacatggaccgagcagtacaaatttcaagcagactctcccaagcggctagccactgctatcgccggtgcatgggaaaatggcgtttgtgggatacgaagcaccacacgcatggagaacctcctgtggaaacagatcgctaatgaacttaactatattttgtgggagaataacatcaagctgacggtggtggtaggagatgtcattggcgtgctcgaacaggggaaaagaaccctgactttacagccaatggagctgaagtactcatggaaaacatggggaaaggccaagatcgttaccgcggagacacaaaacagttccttcataattgacggccctaatactcccgaatgcccaagcgcctctagggcttggaacgtgtgggaggtcgaagactatggttttggggtgttcaccacgaatatctggcttaaattgcgggaggtttacacacagctctgtgatcaccgcctgatgtcagcagccgtgaaggacgaaagagctgtacacgccgatatgggatactggattgagagtcagaaaaacggcagctggaagctagagaaagcatccctgatcgaagtcaagacctgcacttggcccaagtctcataccctctggtcgaatggtgtgctggagagcgacatgataatccctaaatcccttgcgggcccaatttcacagcacaactataggccggggtaccatacacaaactgccggaccctggcacttgggcaagctggaattagattttaattattgcgaggggaccacagtggtcatcacggagaactgtggaacccgtggccctagtctccggactacaaccgtttctggtaaactgattcacgaatggtgctgtcgaagctgcactcttccacccctgagatacatgggggaggacggatgttggtatggcatggaaatcaggcctatatccgagaaggaagagaatatggtgaaatcattggtaagcgctggttctggcgaggtggataacttcacaatgggggtcctctgcctggccattctatttgaagaggtgatgcgcggaaagttcggcaagaaacatatgatcgcaggggttttctttaccttcgtgctgctcctgtccggacagatcacgtggcgggacatggctcacactcttattatgatcggcagtaatgccagcgatagaatgggtatgggggtcacctacttggcactgattgccacatttaagatacagccattcttagctctcggatttttcctgaggaaacttacctctcgcgaaaacctgctactcggcgtgggcctggcgatggccactacattgcaactgcccgaggacatcgaacagatggcaaatgggattgctttaggactcatggccctgaagcttatcacccagtttgagacatatcagctgtggactgccttgatttccctcacctgttcaaacacgatcttcacactgaccgttgcttggcgaactgcaaccctaatactggccggtgtgagtcttctcccggtctgccaaagctcgtccatgcggaaaacagattggctgcctatgactgtagcggctatgggcgtgccacccttgcctctgtttatcttctctttaaaggacaccctcaagcgtagaagctggcccctgaatgagggggttatggccgtgggacttgtctcaattctggcaagttccttgctcaggaacgatgtgccaatggccggccctctggtagctggtgggctactgatcgcatgttacgtgattacgggaacatctgccgaccttaccgtcgaaaaagcggctgacgttacttgggaggaagaggccgaacagacaggcgtgagccataacctcatgatcaccgtggatgacgatggcactatgcgcataaaggacgatgagacagagaatattctgaccgtcttgttaaaaacggcactgctcatcgtgtccgggatctttccctactcaattccagccactctgcttgtttggcacacctggcagaagcagacacaacggagcggagtactgtgggacgtgccgagtcctcccgaaacccagaaagctgagttggaagagggtgtctatagaataaagcagcagggcatcttcgggaaaacacaagtgggagttggcgtgcagaaggagggtgtctttcatactatgtggcacgtgaccaggggggccgtactaacgtacaacggaaagcgactggaaccaaattgggcatctgtcaaaaaggatctcatttcctatggcggcgggtggcgcctgagcgctcagtggcaaaaaggagaggaagtgcaggttatcgccgtggagcccggtaagaaccctaaaaatttccagacaatgccaggcactttccagaccacaaccggggaaattggagcgatcgcccttgactttaagcccggcacttcgggttcacctataatcaaccgggaggggaaggtcgtgggattatacggcaatggcgttgtgaccaaaaacgggggatatgtctctggtattgcacaaacaaatgctgagccggatggcccaacgcccgaactggaggaagagatgttcaagaaaagaaacctcactatcatggacttgcaccctgggagtggaaagaccaggaaatacctgccagccattgtgcgtgaagctatcaagcgccggctcagaacactgatacttgcacccaccagggtagtggccgccgagatggaggaagctctgaagggcttgcctattcgatatcagactacagcgaccaaatccgagcatacgggtcgggaaatcgttgatctaatgtgccacgcaacttttacaatgcgcctgctcagcccggtcagagtgcccaattacaacttaatcattatggacgaggcccatttcaccgatccagcttctatcgccgcaagggggtacataagcacccgggtgggaatgggcgaagccgctgcgatttttatgactgccacacctcccggcaccgcagacgctttcccacagtccaatgcccctatccaggacgaggagcgagatattcccgaaagatcatggaacagtgggaatgagtggatcacagactttgcaggaaagactgtctggttcgtaccaagcataaaagccggtaacgatattgctaactgtctgcgcaagaatggcaaaaaggtgatccaactttctaggaagacgtttgacaccgaatatcagaaaacaaagctgaacgattgggacttcgttgtgactaccgatatctccgagatgggggccaattttaaagcggaccgtgtcattgatccgcggagatgcctcaagcctgtgatcttgacagacggacccgagagggttattctggcaggcccaatgcccgtgaccgccgcttcagccgctcagcgccgaggtagagtcgggcggaaccctcagaaagaaaatgatcaatacatattcactggccagccactcaacaatgacgaggaccacgcacattggacggaagccaagatgctgcttgataacatcaatacccccgagggaattatccctgctctattcgaaccggagagggagaagagtgccgcaatcgacggcgaatatcgcctgaaaggggagagccgtaagacatttgtggaattgatgagacggggagatttaccagtatggctggcgcacaaagtggcctccgagggtattaagtacactgacaggaaatggtgcttcgatggccagcgcaacaatcagatactcgaagagaacatggacgttgagatctggaccaaggaaggggagaaaaagaagctgcgacccagatggcttgatgctcggacatattctgaccctctggccctcaaagaatttaaggatttcgcagctggaaggaaatcgattgccttggacctggtcaccgagatcggccgcgtgcccagccacctagcacatagaactaggaatgccctggataacctcgtgatgcttcacacatcagaacatggtgggaaggcttaccggcacgcggtcgaggagctgccagaaacgatggagaccttattgctgctcggcctgatgattcttctgactggaggcgccatgctctttttgatctccgggaaaggaataggtaagacaagtatcggcctgatttgtgttatcgcatctagcgggatgttatggatggctgaaattcctctacaatggatcgcctccgccatagtgctggagttctttatgatggtactccttattcccgagccagaaaagcagcgtacccctcaggacaatcaactggcatatgtggtcatcggaattttgaccctggctgccatcatagcggctaacgagatgggcctcctggaaacaactaaacgcgatcttggtatgtcaaaggagccgggggtggtttctcccacgagctacctcgacgtggacctgcacccagccagtgcatggaccttgtacgccgtcgctacaactgtaatcacccctatgctgcgacatacaattgaaaattccaccgcaaacgtgagcttagccgcgatcgctaaccaggccgttgtgctaatgggcctggataaaggatggcccatttctaagatggacctcggcgtcccacttctggcattggggtgctattcacaggtgaatcctctgactctcacggccgctgtcctgcttttaatcacacactacgccataattggacccggcctgcaggcaaaagctaccagagaggcccaaaagaggactgcggccggtatcatgaagaacccgaccgtggatgggatcatgacaattgacctcgatccagttatctatgactccaaattcgagaagcagttgggacaggtgatgctgctagtactgtgtgcagtgcagctccttctgatgcggactagttgggctttgtgcgaagccctgaccctcgcaacaggccctataacgaccctgtgggagggtagccccggcaaattttggaatactacaattgctgtctcgatggccaacatcttccgcgggtcttacttagccggagcgggccttgctttttccattatgaagagcgttgggaccggaaaaagaggcactggttcacaaggggaaacactgggagagaagtggaagaaaaagctcaatcagctaagtaggaaagaattcgatctgtataagaaatctggcatcaccgaggtggaccggacggaggcaaaggaaggtttgaaacgaggcgagataacccatcacgccgtctccagagggagcgctaagctgcagtggtttgtggaacgcaacatggtaatcccagagggaagggtgattgatctcggctgtgggcggggaggctggtcatactattgcgccggtcttaagaaagttacagaagtgcgtgggtacactaagggaggccccggccatgaggagcctgtcccgatgagtacctacgggtggaatatcgtgaaactgatgagcggaaaggacgtcttctatttgcccccagaaaaatgtgatacactgctctgcgacattggtgagtcctctcctagccccactgtggaagagtccagaaccatcagggttttaaagatggtagagccttggctgaagaacaatcagttctgtattaaagtgcttaacccatacatgcccacagtcgtggaacacctggagcgcctacaacggaagcacggcgggatgctcgttcgaaatcctctgtcaagaaactctacccatgaaatgtattggatcagtaatggaactggcaacatagtggcatcggtcaatatggtgagcaggttgctgctcaaccgctttacgatgacacaccggagaccaaccattgagaaagatgtagaccttggtgccgggactcgtcatgtgaacgctgaacccgagaccccgaatatggacgttatcggagagaggatcaagcggattaaagaagagcacaactccacatggcactacgatgacgaaaatccttataagacgtgggcgtaccatggctcttatgaggtcaaggccaccggctcagcaagctccatgataaacggggtggtgaaactgttaactaagccatgggatgtcgttcccatggtgacacagatggctatgaccgacactacacctttcggacagcaacgcgtatttaaagaaaaggtggatacccgaacaccaagaagtatgcccggtactaggcgggtcatgggcatcaccgccgagtggctgtggcgcacgttggggagaaataaaaagccgaggctctgcacccgagaggaattcacaaagaaagtgcggactaacgcagccatgggagctgtttttaccgaggaaaatcagtgggactctgccaaggcggcagtggaggatgaagacttctggaaactggtcgatcgtgagagagagctacacaagcttggcaaatgtggtagctgcgtgtacaacatgatggggaagcgcgaaaaaaagctgggagagtttggcaaggccaaaggctcaagggctatttggtacatgtggctcggggcccggtatctggaattcgaggcattgggatttctgaatgaggaccattggttctccagagaaaacagttacagcggtgtagagggcgaagggctccacaagcttggatatatcctgcgcgatatttctaaaatccctggcggtgctatgtacgccgacgacacagctgggtgggatactaggataaccgaggacgatttacataatgaagagaagatcacgcagcagatggaccccgagcaccgacaactggccaacgcaatttttaaattgacatatcagaataaggttgtgaaggtccagcggccaacccctactggaacagtgatggatatcatttccagaaaagaccagaggggctcaggccaagtggggacctacggactcaacactttcaccaatatggaagcgcagctgatccgccagatggagggtgaaggcgtcctaagcaaggccgatcttgagaacccccgtctgccagaaaaaaagataacacagtggctcgagacgaaaggggttgagcggctgaagagaatggctatttcgggagacgattgcgtggtaaagcccatcgacgataggtttgccaacgcattgttagctctgaatgacatgggcaaagtgcgcaaggatatccctcaatggcagccatctaaaggttggcacgactggcagcaggtcccgttctgtagtcatcacttccatgaactcattatgaaggacgggcgaaaacttgtggttccctgccggcctcaagatgagctgataggaagagccaggatctcccagggcgcaggctggagcctacgcgaaaccgcctgtctggggaaggcgtatgctcagatgtggtcactcatgtactttcacagacgggacttgaggctggcctccaacgcaatttgctctgccgtgccagtccactgggtgcccactagccgtacaacctggagtatccatgctcaccatcaatggatgactacagaggatatgcttaccgtatggaatcgagtttggattgaagacaacccttggatggaggataagacgccagtgacaacctgggagaatgtcccctacctgggaaaacgcgaagaccagtggtgtggttccctcatcggcttaactagcagagccacctgggcacagaacatacctacagctatccagcaagtgcggtctctgattgggaatgaggaattcttggattatatgccgtcaatgaagaggtttcgcaaagaggaggaaagtgagggagccatctggtga

SEQ ID NO: 15541 - RNA, 9873 nt, synthetic construct
  misc_feature 1..9873: note = derived and/or modified CDS sequence (opt3) from DENV-3__KF955479__SS-prME
  source 1..9873: mol_type = other RNA
accagcctgtgcctcatgatgatccttcccgccgctctggcattccacttgacttccagggacggcgaacctaggatgattgtggggaagaacgaacggggaaaatctttactgtttaagactgcctcaggtattaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtagaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatcctttatagaggtaaagacctgcacttggcctaagtctcataccctatggtcgaatggtgtcctggaaagcgatatgatcattccaaaatccctcgcgggcccgatctcacagcacaactataggcccgggtaccatacacaaactgccggaccttggcacctgggcaaacttgagttggacttcaattattgcgaggggaccacagtggtgattacggaaaactgtggaacccgtggcccaagtctgcggactacaaccgtctctggtaaattaatccacgagtggtgctgtcgaagctgcactctcccacctctgagatacatgggggaagatggatgttggtatggcatggagataaggccaatttccgaaaaggaggagaatatggttaaatcacttgtgagcgctggttctggcgaagtagacaactttacaatgggggtgctgtgcttggccatcctcttcgaggaagtcatgcgcggaaagttcggcaagaaacatatgatcgcaggggtgtttttcacctttgttctgctactgtccggacagattacgtggcgggatatggctcacactctcatcatgattggcagtaatgccagcgacagaatgggtatgggggtgacctacctggcacttatagccacattcaagatccagccctttttggctctgggattctttttaaggaaactcacctctcgcgagaacctgcttctgggcgtcggcctagcgatggccactacactccaactgccggaagatattgagcagatggcaaatgggatcgctttgggactgatggccttaaagctcattacccagttcgagacatatcagctgtggactgcccttatctccctgacctgttcaaacacgatatttacattgaccgtggcttggcgaactgcaaccctcatcctggccggtgttagtctactgcctgtgtgccaaagctcgtccatgcggaaaacagactggcttccaatgactgtcgcggctatgggcgtaccccctctccccctgttcatattttctttgaaggataccctgaagcgtagaagctggccattaaatgaaggggtgatggccgttggactcgtgtcaatcctggcaagttcccttctgaggaacgacgtccctatggccggccccttggtggctggtgggctcctgattgcatgttacgtaatcacgggaacatctgccgatctaaccgtggagaaagcggctgacgtcacttgggaagaggaagccgagcagacaggcgttagccataacctgatgataaccgtggacgatgacggcactatgcgcattaaggatgacgagacagaaaatatccttaccgtgctcctgaaaacggcattgttaatcgtctccgggattttcccatactcaataccggccactctgctcgtgtggcacacctggcagaagcagacacaacggagcggagttctgtgggatgtacctagtcccccagagacccagaaagctgaacttgaggagggtgtgtatagaatcaagcagcagggcatttttgggaaaacacaagtcggagtgggcgttcagaaggaaggtgtgttccatactatgtggcacgtcaccagaggggccgtgctgacgtacaacggaaagcgattggagcccaattgggcatctgtcaagaaggacctaatctcctatggcggcgggtggcgcctgagcgctcagtggcaaaaaggagaagaggtccaggtgattgccgttgaacctggtaagaaccccaagaatttccagacaatgcccggcacttttcagaccacaaccggggagatcggagcgatagccctcgatttcaagcctggcacttcgggttcaccgatcattaaccgggaggggaaggtggtcggactgtacggcaatggcgtggttaccaaaaacgggggatatgtgtctggtatcgcacaaacaaatgctgaaccagacggccccacgcctgagcttgaagaggaaatgtttaagaaaagaaacttaactattatggatctgcacccagggagtggaaagaccaggaaatacctccccgccatcgtccgtgaggctataaagcgccggttgagaacactgattctcgcacctaccagggtggtagccgccgagatggaagaggctctgaagggccttccgatccgatatcagactacagcgaccaaatccgaacatacgggtcgggagatcgtggacctgatgtgccacgcaactttcacaatgcgcttgctaagccccgttagagtcccaaattacaacctgattatcatggatgaagcccattttaccgaccctgcttctatagccgcaagggggtacattagcacccgggtgggaatgggcgaggccgctgcgatcttcatgactgccacacccccaggcaccgcagatgcttttcctcagtccaatgcccccattcaggacgaggaacgagacatcccagagagatcatggaacagtgggaatgaatggataacagatttcgcaggaaagactgtgtggtttgtcccgagcattaaagccggtaacgacatcgctaactgtctccgcaagaatggcaaaaaggtaatccaattatctaggaagacgttcgataccgagtatcagaaaacaaagctgaacgactgggattttgtggttactaccgacatttccgagatgggggccaatttcaaagcggatcgtgtgatcgaccctcggagatgccttaagcccgtcattctgacagatggaccagaaagggtgatactcgcaggccccatgcctgttaccgccgcttcagccgctcagcgccgaggtagagtggggcggaacccacagaaagagaatgaccaatacatcttcactggccagcccttgaacaatgatgaagaccacgcacattggacggaggccaagatgctgctcgacaacattaatacccctgaaggaatcatcccggctctgtttgagccagagagggaaaagagtgccgcaattgatggcgagtatcgccttaaaggggaaagccgtaagacattcgtcgagctaatgagacggggagacctgcccgtgtggttggcgcacaaagtagcctccgaaggtataaagtacactgataggaaatggtgctttgacggccagcgcaacaatcagatcttagaggagaacatggatgtggaaatttggaccaaggagggggagaagaagaagctgcgacctagatggctcgacgctcggacatattctgatcccctggcccttaaagagttcaaggactttgcagctggaaggaaatcgatcgccctggatctcgttaccgaaattggccgcgtcccaagccacttggcacatagaactaggaatgccctggacaacctagtgatgctgcacacatcagagcatggtgggaaggcttaccggcacgcggtggaggaactccctgagacgatggaaacccttctgttattgggcctgatgatcctcctgactggaggcgccatgcttttcctgatatccgggaaaggaatcggtaagacaagtattggcctcatctgtgtcattgcatctagcgggatgttgtggatggctgagatccccctgcaatggatagcctccgccattgttttagagtttttcatgatggtgctactgatcccagaacctgagaagcagcgtaccccgcaggataatcaactcgcatatgtagtgattggaatccttaccctggctgccataatcgcggctaacgaaatgggcttgctggagacaactaaacgcgacctcggtatgtcaaaggaacccggggtcgtgtctccaacgagctacctggatgttgaccttcaccctgccagtgcatggaccctctacgccgtggctacaactgtcattacccccatgctgcgacatacaatcgaaaattccaccgcaaacgtcagcttggccgcgattgctaaccaggccgtggttctgatgggcttagacaaaggatggccaatctctaagatggatctaggcgtgcctctgctcgcacttgggtgctattcacaggtcaatcccctgactttgacggccgctgtgctgctcctgataacacactacgccattatcggaccgggccttcaggcaaaagctaccagagaggcccaaaagaggactgcggccggtatcatgaagaacccaaccgtcgacgggattatgacaatcgatttagaccctgtgatatatgattccaaatttgaaaagcagctgggacaggttatgctcttggtgctgtgtgcagtacagctactgctcatgcggacaagttgggctctttgcgaggccctgaccttggcaacaggccccattacgaccctgtgggaaggtagcccaggcaaattctggaatactacaatcgctgtgtcgatggccaacatttttcgcgggtcttacctcgccggagcgggcctggctttctccatcatgaaaagcgtcgggaccggaaaaagaggcactggttcacaaggggagacattaggagaaaagtggaagaagaaacttaatcagctgagtaggaaagagtttgacctctataagaaatctggcataaccgaggttgatcggacggaagcaaaagagggtctaaaacgaggcgaaatcacccatcacgccgtgtccagagggagcgctaagctgcagtggttcgtcgagcgcaacatggtgattcccgaaggaagggtaatcgacttgggctgtgggcggggaggctggtcatactattgcgccggtctgaagaaagtgacagaggttcgtgggtacactaagggaggccctggccatgaggaaccggtgcccatgagtacctacgggtggaatattgtcaaactcatgagcggaaaggatgtgttctatcttccacctgagaaatgtgacacactgttgtgcgatatcggtgaatcctctcccagccctactgtcgaggagtccagaaccattagggtgctgaagatggttgaaccatggctcaagaacaatcagttttgtatcaaagtattaaacccctacatgcctacagtgatagagcacctggaacgccttcaacggaagcacggcgggatgctggtccgaaatccactatcaagaaactctacccatgagatgtattggattagtaatggaactggcaacatcgtggcatcggttaatatggtgagcaggctcctgttgaaccgcttcacgatgacacaccggagacccaccatcgaaaaagacgtcgatctgggtgccgggactcgtcatgtgaacgctgagccggagacccctaatatggacgtaattggagaaaggataaagcggatcaaagaggaacacaactccacatggcactacgacgatgagaatccatataagacgtgggcgtaccatggctcttatgaagtgaaggccaccggctcagcaagctccatgattaacggggttgtcaaactccttactaagccctgggacgtggtgcctatcgtcacacagatggctatgaccgatactacaccatttggacagcaacgcgttttcaaagagaaggtggacacccgaacacccagaagtatgccgggtactaggcgggtaatgggcattaccgccgagtggctgtggcgcacgttagggagaaataaaaagcctaggctgtgcacccgagaagagtttacaaagaaagtgcggactaacgcagccatgggagctgtcttcaccgaagagaatcagtgggattctgccaaggcggcagtggaagacgaggatttttggaaattggttgaccgtgagagagaactccacaagctgggcaaatgtggtagctgcgtgtacaacatgatggggaagcgcgagaaaaagctaggagagttcggcaaggccaaaggctcaagggctatctggtacatgtggcttggggcccggtatctggagtttgaggcactcggattcctgaatgaagatcattggttttccagagagaacagttacagcggtgtcgaaggcgaggggttgcacaagctgggatatatactccgcgacatctctaaaattcccggcggtgctatgtacgccgatgacacagctgggtgggacactaggatcaccgaagatgaccttcataatgaggagaagattacgcagcagatggatccagaacaccgacaactggccaacgcaatcttcaaattaacatatcagaataaggtggtaaaggttcagcggcctacccccactggaacagtgatggacataatttccagaaaagatcagaggggctcaggccaagtcgggacctacggactgaacacttttaccaatatggaggcgcagttgatccgccagatggaaggtgagggcgtgctcagcaaggccgacctggaaaacccacacctacccgagaaaaagatcacacagtggcttgagacgaaaggggtggaacgtctgaagcggatggctatttcgggagatgactgcgtcgttaagcctatagatgacagattcgccaacgcactcctggctttgaatgatatgggcaaagtgaggaaggacatcccacaatggcagccgtctaaaggttggcatgattggcagcaggtacccttctgtagtcaccattttcacgagttaattatgaaggacgggcgcaaactggtggtcccttgccgaccacaagacgaactcatcggacgggccagaatttcccagggcgcaggctggagccttagggagaccgcctgtctggggaaggcgtatgctcagatgtggtcactaatgtacttccaccgcagagatctgcggctcgcctccaacgcaatctgctctgccgtgcccgttcattgggtgcctactagcaggacaacctggagtatacacgctcatcaccaatggatgactacagaagacatgttgaccgtctggaatcgtgtgtggatcgaggataacccatggatggaggacaagacgcccgtaacaacctgggaaaatgttccttacctgggaaaacgagaggatcagtggtgtggttcccttattggcctgactagccgcgccacctgggcacagaacatcccgacagctattcagcaagtgagatctctcatcgggaatgaagagtttttagactatatgccatcaatgaagcggttcaggaaagaggaagagagtgaaggagccatttggtga

SEQ ID NO: 15542 - RNA, 9873 nt, synthetic construct
  misc_feature 1..9873: note = derived and/or modified CDS sequence (opt3) from DENV-3__FJ850109__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacacaggcacttctctcacccagaaggttgtgatcttcatattactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaacaaaaaaggaggaacccgtcaacatagaggcagaaccgcctttcggcgagtcaaatattgtgatcggaatcggcgataacagcttgaaaattaattggtataagaaggggagttctatcggaaaaatgtttgaagccactgctcgcggtgccagaaggatggcaattctgggcgacaccgcctgggatttcgggtccgttggaggcgtgctcaacagcctgggtaagatggtccaccagatatttgggtcggcttacacggcccttttctctggcgtgtcctgggtaatgaaaatcggaattggcgtgctgttgacatggatcgggctcaattcaaagaacaccagtatgagcttttcctgcatcgcaattggaataatcactctgtatttaggcgcggttgtccaggctgacacaggttgtgtgattaattggaaagggaaggagctgaagtgcggatctggcatcttcgtgaccaacgaggtccatacttggaccgaacagtacaaatttcaagccgatagccccaagcggctagcaacagccattgctggtgcctgggagaatggcgtttgtgggatccgatcaacgacccgcatggaaaacctcctgtggaaacagatagcaaatgagcttaactatatcttgtgggaaaataacattaagctgactgtggtggtaggagacatcattggcgtcctcgagcaggggaaaagaacactgaccccacagcctatggagttaaagtacagttggaaaacatggggaaaggctaggatcgtgactgccgaaacccaaaactccagcttcataattgatggccccaatacgccagagtgccccaacacatctcgggcgtggaatgtttgggaagtggaggactatggttttggggtcttcaccactaacatctggctgaagcttcgcgaagtgtacacccagttgtgtgaccacagactcatgtcagccgctgttaaagatgagagggcagtgcacgccgacatgggatactggattgagagtcagaagaatggcagctggaaactggaaaaggcttccctaatcgaggtaaaaacatgcacttggcctaagtctcataccctgtggtcgaacggtgtcctcgaaagcgatatgataatcccaaagtccctggccggcccgatttcacagcacaattatcgtcccgggtaccatacacaaacggcaggaccttggcaccttggcaaattggagctggactttaactattgcgaggggaccactgtggtgatcacagaaaattgtggaacccggggcccaagtttacgaactacaaccgtctctggtaagctcattcacgagtggtgctgtagaagctgcacgctgccccctcttaggtacatgggggaagatggatgttggtatggcatggagatccgcccaatatccgaaaaagaggagaacatggttaagtcactggtgagcgcgggttctggcgaagtagacaatttcactatgggggtgttgtgcctcgccattctgtttgaggaagtcatgcggggaaaattcggcaagaagcatatgatcgctggggtgttctttaccttcgttctactgctctccggacagatcacatggagagatatggcccacaccctgattatgatcggcagtaacgcaactgacaggatgggtatgggggtgacataccttgctttgattgccacctttaaaatacagcccttcctggcattaggatttttcctccgcaagctgacaagccgagagaatcttctgctaggcgtcggcctcgccatggctactaccctgcaattgccggaagatatcgagcagatggcgaacgggattgccctgggattaatggcactcaaactgatcacgcagtttgagacatatcagctttggaccgctctgatttctttgacttgttccaataccatcttcacactcactgtggcctggcggaccgccacgctgatactagctggtgtttcactgcttcctgtgtgccaaagtagctcgatgcgtaagacagactggctcccaatgaccgtcgcagccatgggcgtaccccctctgcccttgtttatcttctccctgaaagatactttaaagagaaggtcttggccactcaacgaaggggtgatggcggttggactggtgagcattcttgcttcaagtctgttgcgcaacgacgtccctatggccggccccctcgtggcaggtgggctgctaatcgcctgttacgtaattacaggaacctccgctgatctgactgtggagaaggcagccgacgtcacatgggaagaggaagcggagcagaccggcgtttctcataatcttatgatcacggtggacgatgacggcactatgcggataaaagatgacgagaccgaaaacattctcacagtgctgttgaagaccgctttactgatcgtcagcgggatctttccatactccattccggccacactcctggtgtggcacacttggcagaaacagacccaaagatcaggagttctttgggatgtacctagccccccagagacgcagaaggcagaactggaggagggtgtgtataggataaaacagcagggcatcttcgggaagacacaagtcggagtgggcgttcagaaagaaggtgtgtttcatactatgtggcacgtcacccgaggggccgtgttgacatacaatggaaagcgcctagagcccaactgggctagtgtaaagaaagacctgatttcttatggcggcgggtggcggctctccgcccagtggcaaaagggagaagaggtccaggtgatcgcagttgaacctggtaaaaatccaaagaacttccagaccatgcccggcactttccagaccacaacgggggagattggagctatcgccctggattttaaacctggcactagcggttcgccgataatcaatagagaggggaaggtggtcggactttacggcaacggcgtggttaccaagaatgggggatatgtgtcaggtattgcgcaaacaaacgccgaaccagacggccccacccctgagttagaagaggaaatgttcaaaaagaggaatctgactatcatggatctccacccagggtctggaaaaacacgtaagtacttgcccgcaattgtccgcgaggctatcaaacggagactgaggaccctcatactggcccctacgcgagtggtagctgcagagatggaagaggcccttaagggcctgccgattcggtatcagactacagccaccaagagtgaacataccggtcgcgagatcgtggacttgatgtgccacgctacttttacaatgagactactgtcccccgttagggtcccaaactacaatctcatcattatggatgaagcgcatttcaccgaccctgcaagcatcgccgctcgggggtacatatctacacgagtgggaatgggcgaggccgcagccatttttatgactgctacgcccccaggcaccgcggatgccttccctcagagcaacgcacccatccaggacgaggaaagagacattccagagcgctcctggaattcagggaacgaatggatcacagattttgctggaaaaactgtgtggttcgtcccgagtataaaggccggtaacgacattgcaaattgtttaaggaaaaacggcaagaaagtaatccaactgagccgtaagacctttgatacagagtatcagaagaccaaacttaatgactgggatttcgtggttactacggacatctctgagatgggggccaactttaaggctgatcgggtgattgaccctagaaggtgcctgaaacccgtcatcctcaccgatggaccagaacgcgtgattttggccggccccatgcctgttacagcggcatccgccgctcagcgaagaggtcgggtggggaggaatccacagaaggagaacgaccaatacatattcactggccagcccctgaataacgatgaagaccacgcccattggaccgaggctaaaatgctcctggacaatatcaacacacctgaaggaattatcccggcacttttcgagccagagcgcgaaaagtcagccgctatcgatggcgagtatcgtctaaagggggaaagtagaaaaacctttgtcgagctgatgcggaggggagacttgcccgtgtggttagcccacaaggtagcaagcgaaggtattaaatacactgatcgcaagtggtgcttcgacggccagcgaaataaccagatactggaggagaatatggatgtggaaatctggacaaaagagggggaaaagaaaaagctcagacctcggtggctggacgcgaggacgtattccgatccccttgccctgaaggagtttaaagacttcgctgccggacgcaagtctattgcactcgatttggttaccgaaatcggcagagtcccaactcacctggctcataggacacggaacgccctagacaatctggtgatgctccacacctcggagcatggtgggaaagcataccgtcacgccgtggaggaacttcctgagaccatggaaacactgttattgctgggcctcatgattctgcttactggaggcgctatgctgtttctcatcagcgggaagggaataggtaaaacgtcaatcggcttgatttgtgtcatcgcgtccagtgggatgctgtggatggccgagattcccttacaatggatcgcatctgctatagttctagagttctttatgatggtgctgctcattccagaacctgagaagcagcgcaccccgcaggataaccaacttgcctatgtagtgatcggaattctgacattggccgcaatcatagctgccaatgaaatgggcctgctcgagactaccaagcgagacctgggtatgagcaaagaacccggggtcgtgtccccaacatcataccttgatgttgacctccaccctgcgtctgcttggaccctgtacgccgtggcaactacggtcatcacacccatgttgagacataccattgagaacagcactgccaacgtaagtctggctgcaatcgccaatcaggcggtggttttaatgggcctagacaagggatggccaatttccaaaatggatctgggcgtgcctctccttgctctggggtgctatagccaggtcaaccccttgaccctgacagccgcagtgctcctgcttatcactcactacgccataattggaccgggcttacaggctaaggccaccagggaggcacaaaaacggacagctgccggtatcatgaagaatccaacggtcgacgggatcatgaccattgatctggaccctgtgatctatgattctaagttcgaaaaacagctcggacaggttatgttgctggtgctatgtgcggtacagctgctccttatgcgcacttcatgggccctgtgcgaggcattgacactggctaccggccccataactacactctgggaaggttccccaggcaagttttggaacaccacgattgccgtgagtatggcaaatatcttcagagggagctacctggctggagccggcttagccttttcgattatgaaatctgtcgggaccggaaagaggggcacaggttcccaaggggagactcttggagaaaaatggaagaagaaactgaaccagctcagccggaaggagttcgacctatataaaaagtcaggcatcaccgaggttgatcgaacagaagcgaaagagggtctgaagagaggcgaaataactcatcacgctgtgagtcgcgggtctgcaaaattgcagtggtttgtcgagaggaatatggtgatccccgaaggacgggtaattgacctgggctgtgggcgtggaggctggtcctactattgcgccggtctcaagaaggtgaccgaggttagagggtacacaaaaggaggccctggccatgaggaaccggtgcccatgagcacctacgggtggaacatcgtcaagcttatgtcaggaaaagatgtgttctatctgccacctgagaagtgtgacactttgctgtgcgatattggtgaaagtagcccctcccctacggtcgaggagtctaggacaatccgcgtgctcaaaatggttgaaccatggttaaagaataaccagttctgtattaaggtactgaatccctacatgcctgctgtgatcgagcaccttgaacggctgcaacgaaaacacggcgggatgctagtcagaaacccactcagcaggaattccacccatgagatgtattggatatcaaacggaactggcaatattgtggcctctgttaacatggtgagtcgcctgttgctgaaccggtttaccatgacacacagacgtcccacgatcgaaaaggacgtcgatctcggtgcagggaccaggcatgtgaatgccgagccggagactcctaacatggacgtaatcggagaacggattaaacgcataaaggaggaacacaattcgacatggcactacgacgatgagaacccatataaaacctgggcttaccatggcagctatgaagtgaaggcgactggctccgcctcttcaatgatcaatggggttgtcaagcttctgacaaaaccctgggacgtggtgcctatggtcattcagatggcaatgaccgatacaactccattcggacagcaacgagtttttaaggagaaagtggacaccagaacgcccaggagcatgccgggtacccggcgcgtaatggagatcacagctgaatggttatggagaactctgggcaggaacaagaaacctcgattgtgcacccgggaggaattcacaaagaaggtgcgtactaatgccgcaatgggggccgtctttaccgaggaaaaccagtgggattccgctaaagccgcggtggaggacgaggatttctggaagctcgttgacagagaacgcgagctgcacaaactaggaaagtgtggcagttgcgtgtacaatatgatgggtaaaagggaaaagaaacttggggagtttggaaaggcaaagggctctcgggccatttggtacatgtggctgggcgctagatatctcgagttcgaagccctggggtttttgaacgaggatcattggttcagccgcgaaaattcatactccggagtcgagggtgaaggcctgcacaaactcgggtatatccttagggacataagtaagatccccggaggcgcaatgtacgctgatgacacggccggttgggacacacgaattaccgaggatgacctgcataacgaggaaaaaatcactcagcagatggatccagagcaccggcaattagctaatgccatttttaagctgacatatcagaacaaagtggtaaaggttcagagacctacccccactgggaccgtgatggacatcataagcaggaaggatcagcgcggatctggccaagtcggcacatacgggttgaatacgttcaccaacatggaagcacagctcattcgtcagatggagggagaaggtgtgctgtccaaagcggacctagagaacccacaccttcccgagaagaaaatcactcagtggctggaaacaaagggcgtggagcggctcaaaagaatggccatctcaggggatgactgcgtcgttaagcctattgatgacaggtttgctaatgccctgttggcattaaacgatatgggaaaggtgcgcaaagacataccacaatggcagccgagcaagggctggcatgattggcagcaggtacccttctgttcgcaccatttccacgaactgatcatgaaagacggtcgaaagctcgtggtcccttgccggccacaagacgagcttattgggagagctaggatctctcagggagccggctggagtctgcgcgaaaccgcatgtctaggcaaagcctatgcgcagatgtggtccctgatgtactttcacagacgggatctcaggttggctagcaatgccatttgctcagcagtgcccgttcattgggtgcctacttcccgtacaacctggtctatccacgcccatcaccaatggatgacgacagaggacatgctgaccgtctggaaccgagtgtggatagaggataatccatggatggaagacaagactcccgtaaccacatgggagaacgttccttaccttgggaagcgcgaagatcagtggtgtggaagcctgatcggtctcactagtagagctacctgggcccagaatattccgacagcaatccagcaagtgcggtccttaattggcaacgaggagttcctggactatatgccaagcatgaaaaggtttcgcaaggaagaggaatctgagggggctatctggtga

SEQ ID NO: 15543 - RNA, 9873 nt, synthetic construct
  misc_feature 1..9873: note = derived and/or modified CDS sequence (opt3) from DENV-3__GQ868586__SS-prME
  source 1..9873: mol_type = other RNA
accagcctgtgcctcatgatgatccttcccgccgctctggcattccacttgacctccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtagaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggattacaagggagaggacgttccctgtaaaatccctttctccacagaagatggccaaggtaaggctcataacgggcgtcttataactgcgaatccagtggtaaccaaaaaggaggagcccgtcaacattgaagcagagccgcctttcggcgaatcaaatatcgtgatcggaattggcgacaacgccttgaaaatcaattggtataagaaggggagcagtattggaaaaatgtttgaggctacagcccgcggtgcaagaaggatggccatactgggcgatactgcttgggacttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgatactggttgtgtgatcaattggaaagggaaggaactgaagtgcggatccggcattttcgtgacaaacgaggtccatacctggactgagcagtacaaatttcaagcagactctcccaagcggctagccaccgctatcgccggtgcatgggaaaatggcgtttgtgggatacgaagcacaacgcgcatggagaacctcctgtggaaacagatcgctaatgaacttaactatattttgtgggagaataacatcaagctgaccgtggtggtaggagatattatcggcgtcctcgaacaggggaaaagaactctgacaccacagcctatggagttaaagtactcatggaaaacctggggaaaggccaagatagtgacagcggagactcaaaacagttccttcattatcgacggccccaataccccagaatgccccagcgcctctagggcttggaacgtttgggaggtggaagactatggttttggggtcttcacgacaaatatttggctgaaacttcgggaggtgtacacccagcagtgtgatcaccgcttgatgtcagcagccgttaaggacgaaagagctgtgcacgccgatatgggatactggatcgagagtcagaaaaacggcagctggaagctcgagaaagcatccctgatagaagtaaagacttgcacctggcctaagtctcatacactatggtcgaatggtgtcctggagagcgacatgatcattccaaaatccctcgcgggcccgatctcacaacacaactataggcccgggtaccatactcagaccgccggaccttggcacctgggcaaacttgaattggattttaattattgcgaggggacaacggtggtgattaccgagaactgtggaactcgtggcccaagtctgcggacaaccactgtctctggtaaattaatccacgaatggtgctgtcgaagctgcacactcccacctctgagatacatgggggaggacggatgttggtatggcatggaaataaggccaatttccgagaaggaagagaatatggttaaatcacttgtgagcgctggttctggcgaggtagataacttcaccatgggggtgctgtgcttggccatcctctttgaagaggtcatgcgcggaaagttcggcaagaaacatatgatcgcaggggtgttctttacgttcgttctgctactgtccggacagattacttggcgggacatggctcacaccctcatcatgattggcagtaatgccagcgatagaatgggtatgggggtgacatacctggcacttatagccacctttaagatccaacccttcttggctctgggatttttcttaaggaaactcacttctcgcgaaaacctgcttctgggcgtcggcctagcgatggccacaaccctccagctgccggaggacattgaacagatggcaaatgggatcgctttgggactgatggccttaaagctcattacacagtttgagacttatcaactgtggaccgcccttatctccctgacgtgttcaaacacaatattcaccttgactgtggcttggcgaaccgcaacactcatcctggccggtgttagtctactgcctgtgtgccagagctcgtccatgcggaaaactgattggcttccaatgaccgtcgcggctatgggcgtaccccctctccccctgtttattttctctttgaaggacacgctgaagcgtagaagctggccattaaatgagggggtgatggccgttggactcgtgtcaatcctggcaagttcccttctgaggaacgatgtccctatggccggccccttggtggctggtgggctcctgattgcatgttacgtaatcacaggaacctctgccgacctaactgtggaaaaagcggctgacgtcacatgggaggaagaggccgaacagaccggcgttagccataacctgatgataactgtggatgacgatggcacaatgcgcattaaggacgatgagaccgagaatatccttacggtgctcctgaaaactgcattgttaatcgtctccgggatttttccatactcaataccggccaccctgctcgtgtggcacacatggcagaagcaaacccagcggagcggagttctgtgggacgtacctagtcccccagaaacacagaaagctgagcttgaagagggtgtgtatagaatcaagcagcaaggcattttcgggaaaactcaggtcggagtgggcgttcagaaggagggtgtgtttcataccatgtggcacgtcacgagaggggccgtgctgacatacaacggaaagcgattggaacccaattgggcatctgtcaagaaggatctaatctcctatggcggcgggtggcgcctgagcgctcaatggcagaaaggagaggaagtccaggtgattgccgttgagcctggtaagaaccccaagaatttccagactatgcccggcaccttccaaacaaccactggggaaatcggagcgatagccctcgactttaagcctggcacctcgggttcaccgatcattaaccgggaggggaaggtggtcggactgtacggcaatggcgtggttaccaagaacgggggatatgtgtctggtatcgcacagacgaatgctgagccagatggccccactcctgaacttgaggaagagatgttcaagaaaagaaacttaaccattatggacctgcacccagggagtggaaagacaaggaaatacctccccgccatcgtccgtgaagctataaagcgccggttgagaaccctgattctcgcacctactagggtggtagccgccgagatggaggaagctctgaagggccttccgatccgatatcagacaaccgcgacgaaatccgagcatactggtcgggaaatcgtggatctgatgtgccacgcaacatttaccatgcgcttgctaagccccgttagagtcccaaattacaacctgattatcatggacgaggcccatttcaccgatcctgcttctatagccgcaagggggtacattagcactcgggtgggaatgggcgaagccgctgcgatctttatgacagccacacccccaggcacagcagacgctttccctcagtccaatgcccccattcaagacgaggagcgagatatcccagaaagatcatggaacagtgggaatgagtggataactgactttgcaggaaagacggtgtggttcgtcccgagcattaaagccggtaacgatatcgctaactgtctccgcaagaatggcaaaaaggtaatccagttatctaggaagacctttgacacagaatatcagaaaactaagctgaacgattgggacttcgtggttaccacagatatttccgagatgggggccaattttaaagcggaccgtgtgatcgatcctcggagatgccttaagcccgtcattctgaccgacggaccagagagggtgatactcgcaggccccatgcctgttactgccgcttcagccgctcagcgccgaggtagagtggggcggaacccacaaaaagaaaatgatcagtacatcttcacgggccagcccttgaacaatgacgaggaccacgcacattggaccgaagccaagatgctgctcgataacattaatacacctgagggaatcatcccggctctgttcgaaccagagagggagaagagtgccgcaattgacggcgaatatcgccttaaaggggagagccgtaagacttttgtcgaactaatgagacggggagatctgcccgtgtggttggcgcacaaagtagcctccgagggtataaagtacaccgacaggaaatggtgcttcgatggccagcgcaacaatcaaatcttagaagagaacatggacgtggagatttggacaaaggaaggggagaaaaagaagctgcgacctagatggctcgatgctcggacctattctgaccccctggcccttaaagaatttaaggatttcgcagctggaaggaaatcgatcgccctggacctcgttactgagattggccgcgtcccaagccacttggcacatagaacaaggaatgccctggataacctagtgatgctgcacacgtcagaacatggtgggaaggcttaccggcacgcggtggaggagctccctgaaaccatggagactcttctgttattgggcctgatgatcctcctgacaggaggcgccatgctttttctgatatccgggaaaggaatcggtaagaccagtattggcctcatctgtgtcattgcatctagcgggatgttgtggatggctgaaatccccctgcagtggatagcctccgccattgttttagagttctttatgatggtgctactgatcccagagcctgaaaagcagcgtaccccgcaagacaatcagctcgcatatgtagtgattggaatccttacactggctgccataatcgcggctaacgagatgggcttgctggaaactacgaaacgcgatctcggtatgtcaaaggagcccggggtcgtgtctccaaccagctacctggacgttgaccttcaccctgccagtgcatggacactctacgccgtggctactaccgtcattacacccatgctgcgacataccatcgaaaattccactgcaaacgtcagcttggccgcgattgctaaccaggccgtggttctgatgggcttagataaaggatggccaatctctaagatggacctaggcgtgcctctgctcgcacttgggtgctattcacaggtcaatcccctgacgttgacagccgctgtgctgctcctgataacccactacgccattatcggaccgggccttcaagcaaaagctactagagaggcccagaagaggaccgcggccggtatcatgaagaacccaacagtcgatgggattatgactatcgacttagatcctgtgatatatgactccaaattcgagaagcagctgggacaggttatgctcttggtgctgtgtgcagtacaactactgctcatgcggaccagttgggctctttgcgaagccctgacattggcaacgggccccattaccactctgtgggagggtagcccaggcaaattttggaatacaaccatcgctgtgtcgatggccaacattttccgcgggtcttacctcgccggagcgggcctggctttttccatcatgaaaagcgtcgggactggaaaaagaggcacaggttcacagggggaaaccttaggagagaagtggaagaagaaacttaatcagctgagtaggaaagagttcgatctctataagaaatctggcataacggaggttgaccggaccgaggcaaaagaaggtctaaaacgaggcgaggtgacacatcacgccgtctccagagggagcgctaagctgcagtggtttgtggaacgcaacatggtaatccccgagggaagggtgattgatttgggctgtgggcggggaggctggtcatactattgcgccggtctgaagaaagttactgaagtgcgtgggtacaccaagggaggccctggccatgaggagccggtccccatgagtacatacgggtggaatatcgtgaaactcatgagcggaaaggacgtcttctatcttccacctgaaaaatgtgatactctgttgtgcgacattggtgagtcctctcccagccctaccgtggaagagtccagaacaatcagggttctgaagatggtagagccatggctcaagaacaatcaattctgtattaaagtgttaaacccctacatgcctaccgtcatcgaacacctggagcgccttcagcggaagcacggcgggatgctggtgcgaaatccactatcaagaaactctactcatgaaatgtattggataagtaatggaacgggcaacattgttgcatcggtgaatatggtcagcaggctcctgttgaaccgctttacaatgacccaccggagacccactatcgagaaagatgtggacctgggtgccgggacccgtcatgtaaacgctgaaccggagacacctaatatggacgtgatcggagagaggattaagcggataaaagaagaacacaactccacgtggcactacgatgacgaaaatccatataagacctgggcgtaccatggctcttatgaggttaaggccactggctcagcaagctccatgatcaacggggtcgtgaaactccttacaaagccctgggatgtggtccctatggttacccagatggctatgactgacacaaccccattcggacaacagcgcgtgtttaaagaaaaggtagatacacgaactcccagaagtatgccgggtaccaggcgggtgatgggcattacggccgagtggctgtggcgcaccttagggagaaataaaaagcctaggctgtgcacacgagaggagttcactaagaaagtccggaccaacgcagccatgggagctgtgtttacagaggaaaatcagtgggactctgccaaggcggcagttgaggatgaagacttctggaaattggtggagcgtgagagagaactccacaagctgggcaaatgtggtagctgcgtctacaacatgatggggaagcgcgagaaaaagctaggagaatttggcaaggccaaaggctcaagggctatctggtacatgtggcttggggcccggtatctggagttcgaggcactcggatttctgaatgaagatcattggttctccagagagaacagttacagcggtgtggaaggcgaggggttgcacaagctgggatatattctccgcgacatctctaaaatacccggcggtgctatgtacgccgatgacactgctgggtgggacaccaggatcacggaagatgaccttcataatgaggagaagattacacagcaaatggatccagaacacaaacagctggccaacgcaatctttaagttaacctatcagaataaggtagttaaagtgcagcgacctactcccacaggaaccgtcatggacattatctcccggaaggatcaaagaggctcaggccaggtggggacttacggactgaacaccttcacaaatatggaggcgcagttgataaggcagatggaaggtgagggcgtgctcagcaaagccgacctggaaaacccacacctacccgagaagaaaattacgcaatggcttgagaccaagggggtcgaacgcctgaagcgtatggctatctcgggagatgactgcgttgtgaaacctatcgatgaccggtttgccaacgcactcctggctttgaatgatatgggcaaggtaagaaaagacattccacagtggcagccgtctaagggttggcatgattggcagcaagtgcccttctgtagtcaccatttccacgagttaataatgaaagacgggaggaagctggtcgtgccttgccgcccacaggacgaactcatcggacgagcccggatttcccagggcgcaggctggagccttagagagactgcctgtctggcgaaggcttatgcccaaatgtggtcactaatgtactttcacaggcgcgatctgagactcgcatccaacgccatctgctctgctgttcccgtgcattgggtccctacaagccggaccacttggagtattcacgcccatcaccagtggatgacaaccgaagacatgttgacggtgtggaatagggtatggatcgaggataacccatggatggaggacaaaacacccgttaccacttgggaaaatgtgccttacctggggaagcgtgaggatcagtggtgtggatcccttataggtctgaccagccgagcaacatgggctcagaacatcccgactgccattcaacaggtccgctctctcatcggcaatgaagagttcttagactatatgccatcaatgaaaagatttcggaaggaggaagagagtgaaggggcgatttggtga

SEQ ID NO: 15544 - RNA, 9873 nt, synthetic construct
  misc_feature 1..9873: note = derived and/or modified CDS sequence (opt3) from DENV-3__FJ850110__SS-prME
  source 1..9873: mol_type = other RNA
accagcctgtgcctcatgatgatccttcccgcagctctggcattccacttgacatccagagacggcgaacctaggatgattgtggggaagaacgaacggggaaagtctttactgtttaagactgcctcaggtataaatatgtgtacgctaatcgcgatggatctcggcgaaatgtgcgacgataccgtcacatacaagtgtccacatattactgaagttgagccggaagacatcgattgctggtgtaacctgaccagtacatgggtgacctatgggacttgcaatcaggctggagagcaccgccgagacaagcgttccgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacactggttgtgtgatcaattggaaagggaaggagctgaagtgcggatccggcattttcgtgacaaacgaggtccatacctggactgaacagtacaaatttcaagcagattctcccaagcggctagccaccgctatcgccggtgcatgggagaatggcgtttgtgggatacgaagcacaacgcgcatggaaaacctcctgtggaaacagatcgctaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggccaggatagtgacagcggaaactcaaaacagttccttcattatcgatggccccaataccccagagtgccccaacacgagccgggcctggaatgtttgggaagtggaggactatggttttggggtcttcacaaccaacatttggctgaaacttcgcgaagtgtacactcagttgtgtgaccacagactcatgtctgctgcagttaaagatgagagggccgtgcacgctgacatgggatactggatcgagtcacagaagaatggcagttggaaactggaaaaggccagcctaatagaggtaaaaacctgcacatggcctaagtcccatactctgtggtctaacggtgtcctcgaatcggatatgatcattccaaagagcctggcaggcccgatctcccagcacaattatcgtcccgggtaccatacccaaacagcgggaccttggcaccttggcaaattggagctggactttaactattgcgaggggacgaccgtggtgattactgaaaattgtggaacacggggcccatcattacgaaccactacagtcagtggtaagctcatccacgagtggtgctgtagatcttgcaccctgccccctcttaggtacatgggggaagatggatgttggtatggcatggagatacgcccaattaacgaaaaagaggagaatatggttaagagcctggtgtccgccggttcaggcgaagtagacaacttcacgatgggggtgttgtgcctcgctatcctgtttgaggaagtcatgcggggaaaattcggcaagaagcatatgatcgccggggtgttctttactttcgttctactgctcagcggacagattacctggagagatatggcacacacactgatcatgattggctctaatgctaccgacaggatgggtatgggggtgacttaccttgccttgatagcaacatttaaaatccagcccttcctggccttaggatttttcctccgcaagctgacctcccgagagaaccttctgctaggcgtcggcctcgctatggcgacaactctgcaattgccggaagatattgagcagatggccaatgggatcgcactgggattaatggctctcaaactgattacccagtttgagacgtatcagctttggacagccctgatcagtttgacctgtagcaacactatattcaccctcacagtggcctggcggactgctaccctgatcctagccggtgtttctctgcttcctgtgtgccaatcctcaagtatgcgtaagacggactggctcccaatgacagtcgccgcgatgggcgtaccccctctgcccttgtttattttcagcctgaaagataccttaaagagaaggtcgtggccactcaacgaaggggtgatggctgttggactggtgtccatccttgcctctagcctgttgcgcaatgacgtccctatggcaggccccctcgtggccggtgggctgctaattgcttgttacgtaatcactggaacatcagcagatctgaccgtggagaaggccgcggacgtcacttgggaagaggaagctgagcagacaggcgttagtcataaccttatgataaccgtggacgatgacggcacgatgcggattaaagatgacgagactgaaaatatcctcaccgtgctgttgaagacagccttactgatcgtctccgggatttttccatactctataccggcaaccctcctggtgtggcacacatggcagaaacagactcaaagaagcggagttctttgggatgtaccttcacccccagagacccagaaggccgaactggaggagggtgtgtataggatcaaacagcagggcattttcgggaagacgcaagtcggagtgggcgttcagaaagaaggtgtgtttcatacaatgtggcacgtcactcgaggggctgtgttgacctacaacggaaagcgcctagagcccaattgggccagcgtaaagaaagacctgatcagctatggcggcgggtggcggctcagtgcacagtggcaaaagggagaagaggtccaggtgattgctgttgaacctggtaaaaacccaaagaatttccagacaatgcccggcaccttccagactaccacaggggagatcggagccatagcgctggattttaaacctggcacgtctggttccccgatcattaacagagaggggaaggtggtcggactttacggcaatggcgtggttactaagaacgggggatatgtgagcggtatcgcccaaaccaatgcagaaccagacggccccacacctgagttagaagaggaaatgttcaaaaagaggaacctgaccattatggatctccacccagggtcgggaaaaactcgtaagtacttgcccgctatcgtccgcgaggccataaaacggagactgaggacactcattctggctcctacccgagtggtagcagccgagatggaagaggcccttaagggcctgccgatccggtatcagacgactgctacaaagtcagaacataccggtcgcgagatcgtggacttgatgtgccacgcgacctttactatgagactactgtctcccgttagggtcccaaattacaacctcattatcatggatgaagcacatttcacagaccctgccagtatagctgcccgggggtacatttccacccgagtgggaatgggcgaggcagccgctatctttatgacagcgactcccccaggcacggccgatgcattccctcagagcaatgctcccattcaggacgaggaaagagacatcccagagcgctcttggaacagcgggaacgaatggataaccgattttgccggaaaaacagtgtggttcgtcccgtccattaaggcaggtaatgacatcgccaactgtttaaggaaaaatggcaagaaagtaatccaactgtcacgtaagacttttgataccgagtatcagaagacaaaacttaacgactgggatttcgtggttaccactgacattagtgagatgggggctaattttaaggccgatcgggtgatcgaccctagaaggtgcctgaaacccgtcattctcacggatggaccagaacgcgtgatattggcgggccccatgcctgttaccgcagccagcgctgcccagcgaagaggtcgggtggggaggaacccacagaaggagaatgaccaatacatcttcacaggccagcccctgaacaatgatgaagaccacgctcattggactgaggcaaaaatgctcctggacaacattaatacccctgaaggaatcatcccggcccttttcgagccagagcgcgaaaagtctgctgccattgatggcgagtatcgtctaaagggggaatccagaaaaacatttgtcgagctgatgcggaggggagacttgcccgtgtggttagcacacaaggtagcgtcagaaggtataaaatacaccgatcgcaagtggtgcttcgacggccagcgaaacaatcagatcctggaggagaacatggatgtggaaatttggactaaagagggggaaaagaaaaagctcagacctcggtggctggacgccaggacatatagtgatccccttgctctgaaggagtttaaagacttcgccgcaggacgcaagagcatcgctctcgatttggttacggaaattggcagagtcccaacccacctggcccataggactcggaatgcactagacaacctggtgatgctccacacatccgagcatggtgggaaagcctaccgtcacgctgtggaggaacttcctgagaccatggaaaccctgttattgctgggcctcatgatcctgcttacaggaggcgcgatgctgtttctcatatctgggaagggaatcggtaaaacttcgattggcttgatctgtgtcattgccagctcagggatgctgtggatggcagagatccccttacaatggatagcttccgccattgttctagagttctttatgatggtgctgctcatcccagaacctgagaagcagcgcacgccgcaggataatcaacttgcctatgtagtgattggaatcctgaccttggcagctataatcgccgcgaacgaaatgggcctgctcgagacaactaagcgagacctgggtatgagtaaagaacccggggtcgtgtctccaaccagctaccttgatgttgacctccaccctgcttccgcctggacactgtacgcagtggccaccactgtcattacgcccatgttgagacatacaatcgagaactcaaccgctaatgtatctctggcagccattgcgaaccaggctgtggttttaatgggcctagacaagggatggccaatcagcaaaatggatctgggcgtgcctctccttgccctggggtgctatagtcaggtcaatcccttgactctgaccgcagccgtgctcctgcttataacacactacgctattatcggaccgggcttacaggccaaggcaactagggaggctcaaaaacggaccgccgcgggtatcatgaagaacccaacagtcgacgggattatgacgatcgatctggaccctgtgatatatgattccaagttcgaaaaacagctcggacaggttatgttgctggtgctatgtgccgtacagctgctccttatgcgcaccagctgggcactgtgcgaggctttgactctggccacaggccccattaccactctctgggaaggttctccaggcaagttttggaatacaaccatcgcagtgtcaatggctaacattttcagagggtcctacctggccggagccggcttagcgtttagtatcatgaaaagcgtcgggacgggaaagaggggcaccggttcgcaaggggagacacttggagaaaaatggaagaagaaactgaatcagctctctcggaaggagttcgacctatataaaaagtccggcataactgaggttgatcgaaccgaagctaaagagggtctgaagagaggcgaaatcacacatcacgcagtgagccgcgggtcagccaaattgcagtggtttgtcgagaggaacatggtgattcccgaaggacgggtaatcgacctgggctgtgggcgtggaggctggagttactattgcgctggtctcaagaaggtgactgaggttagagggtacaccaaaggaggccctggccatgaggaaccggtgcccatgtctacatacgggtggaatattgtcaaacttatgtccggaaaagatgtgttctatctgccacctgagaagtgtgacaccttgctgtgcgatatcggtgaaagctcacccagtcctactgtcgaggagagcaggacgattcgcgtgctcaaaatggttgaaccatggttaaagaacaatcagttctgtatcaaggtactgaacccctacatgcctgccgtgatagagcaccttgaacggctgcaacgaaaacacggcgggatgctagtcagaaatccactctccaggaactctacacatgagatgtattggattagcaatggaaccggcaacatcgtggcatccgttaacatggtgtcacgcctgttgctgaatcggtttactatgacccacagacgtcccacaatcgaaaaggacgtcgatctcggtgccgggacgaggcatgtgaacgctgagccggagacccctaatatggacgtaattggagaacggataaaacgcatcaaggaggaacacaactctacttggcactacgacgatgagaatccatataaaacatgggcgtaccatggcagttatgaagtgaaggccaccggctcggcaagctccatgattaacggggttgtcaaacttctgactaaaccctgggacgtggtgcctatggtcacacagatggctatgaccgatacaactccattcggacagcaacgagtttttaaggagaaagtggacaccagaacgcccaggtctatgccgggtacccggcgcgtaatggagatcacagccgaatggttatggagaactctgggcaggaataagaaacctcgattgtgcacccgggaggagttcacaaagaaggtgcgtactaacgcagccatgggggctgtctttaccgaggaaaatcagtgggattcagccaaagcggcagtggaggacgaggatttctggaagctcgttgacagagaacgcgagctgcacaaactaggaaagtgtggcagctgcgtgtacaacatgatgggtaaaagggaaaagaaacttggggagtttggaaaggccaagggctcccgggctatttggtacatgtggctgggcgccagatatctcgagttcgaagcactggggtttttgaatgaggatcattggttcagtcgcgaaaactcttacagcggagtcgagggtgaaggcctgcacaaactcgggtatatccttagggacatatcaaagatccccggaggcgctatgtacgccgatgacacggctggttgggacacacgaattaccgaggatgacctgcataatgaggagaagatcactcagcagatggatccagagcaccggcaattagccaacgcaatttttaagctgacatatcagaataaagtggtaaaggttcagagacctacccccactgggaccgtgatggacatcatatccaggaaggatcagcgcggaagtggccaagtcggcacatacgggttgaacacgttcaccaacatggaagcgcagctcattcgtcagatggagggagaaggtgtgctgagcaaagccgacctagagaatccacaccttcccgagaagaaaatcactcagtggctggaaacaaagggcgtggagcggctcaaaagaatggctatctctggggatgactgcgtcgttaagcctattgatgacaggtttgccaacgcactgttggctttaaatgatatgggaaaggtgcgcaaagacataccacaatggcagccgtccaagggctggcatgattggcagcaggtacccttctgttcacaccatttccacgaactgatcatgaaagacggtcgaaagctcgtggtcccttgccggccacaagacgagcttattgggagagccaggatcagccagggagcaggctggtcgctgcgcgaaaccgcctgtctaggcaaagcgtatgctcagatgtggtctctgatgtactttcacagacgggatctcaggttggccagtaacgcaatttgctccgccgtgcccgttcattgggtgcctactagccgtacaacctggtcaatccacgctcatcaccaatggatgacgacagaggacatgctgaccgtctggaatcgagtgtggatagaggataacccatggatggaagacaagactcccgtaaccacatgggagaatgttccttaccttgggaagcgcgaagatcagtggtgtggatccctgatcggtctcacttctagagccacctgggcacagaacattccgacagctatccagcaagtgcggagcttaattggcaatgaggagttcctggactatatgccaagtatgaaaaggtttcgcaaggaagaggaatccgagggggccatctggtga

SEQ ID NO: 15545 - RNA, 9873 nt, synthetic construct
  misc_feature 1..9873: note = derived and/or modified CDS sequence (opt3) from DENV-3__FJ850111__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacagcttgaaaatcaattggtataagaaggggagttctattggaaaaatgtttgaagccacagctcgcggtgccagaaggatggcaatactgggcgacactgcctgggatttcgggtccgttggaggcgtgctcaacagcctgggtaagatggtccaccagatctttgggtcggcttacaccgcccttttctctggcgtgtcctgggtaatgaaaattggaatcggcgtgctgttgacgtggatcgggctcaattcaaagaacacaagtatgagcttttcctgcattgcaataggaatcattaccctgtatttaggcgcggttgtccaggctgacactggttgtgtgatcaattggaaagggaaggagctgaagtgcggatctggcattttcgtgacaaacgaggtccatacctggactgaacagtacaaatttcaagccgatagccccaagcggctagcaaccgccatcgctggtgcctgggagaatggcgtttgtgggatacgatcaacaacgcgcatggaaaacctcctgtggaaacagatcgcaaatgagcttaactatattttgtgggaaaataacatcaagctgaccgtggtggtaggagacattatcggcgtcctcgagcaggggaaaagaactctgacaccacagcctatggagttaaagtacagttggaaaacctggggaaaggctaggatagtgacagccgaaactcaaaactccagcttcattatcgatggccccaataccccagagtgccccaacacgtctcgggcgtggaatgtttgggaagtggaggactatggttttggggtcttcacaaccaacatttggctgaagcttcgcgaagtgtacactcagttgtgtgaccacagactcatgtcagccgctgttaaagatgagagggcagtgcacgccgacatgggatactggatcgagagtcagaagaatggcagctggaaactggaaaaggcttccctaatagaggtaaaaacctgcacatggcctaagtctcatactctgtggtcgaacggtgtcctcgaaagcgatatgatcattccaaagtccctggccggcccgatctcacagcacaattatcgtcccgggtaccatacccaaacagcaggaccttggcaccttggcaaattggagctggactttaactattgcgaggggacgaccgtggtgattactgaaaattgtggaacacggggcccaagtttacgaaccactacagtctctggtaagctcatccacgagtggtgctgtagaagctgcaccctgccccctcttaggtacatgggggaagatggatgttggtatggcatggagatacgcccaatttccgaaaaagaggagaacatggttaagtcactggtgagcgcgggttctggcgaagtagacaatttcacgatgggggtgttgtgcctcgccatcctgtttgaggaagtcatgcggggaaaattcggcaagaagcatatgatcgctggggtgttctttactttcgttctactgctctccggacagattacctggagagatatggcccacacactgatcatgattggcagtaacgcaaccgacaggatgggtatgggggtgacttaccttgctttgatagccacatttaaaatccagcccttcctggcattaggatttttcctccgcaagctgaccagccgagagaatcttctgctaggcgtcggcctcgccatggctacaactctgcaattgccggaagatattgagcagatggcgaacgggatcgccctgggattaatggcactcaaactgattacccagtttgagacgtatcagctttggacagctctgatctctttgacctgttccaatactatattcaccctcacagtggcctggcggactgccaccctgatcctagctggtgtttcactgcttcctgtgtgccaaagtagctcgatgcgtaagacggactggctcccaatgacagtcgcagccatgggcgtaccccctctgcccttgtttattttctccctgaaagataccttaaagagaaggtcttggccactcaacgaaggggtgatggcggttggactggtgagcatccttgcttcaagtctgttgcgcaacgacgtccctatggccggccccctcgtggcaggtgggctgctaattgcctgttacgtaatcactggaacatccgctgatctgaccgtggagaaggcagccgacgtcacttgggaagaggaagcggagcagacaggcgtttctcataatcttatgataaccgtggacgatgacggcacgatgcggattaaagatgacgagactgaaaacatcctcaccgtgctgttgaagacagctttactgatcgtcagcgggatttttccatactccataccggccaccctcctggtgtggcacacatggcagaaacagactcaaagatcaggagttctttgggatgtacctagccccccagagacccagaaggcagaactggaggagggtgtgtataggatcaaacagcagggcattttcgggaagacgcaagtcggagtgggcgttcagaaagaaggtgtgtttcatacaatgtggcacgtcactcgaggggccgtgttgacctacaatggaaagcgcctagagcccaactgggctagtgtaaagaaagacctgatctcttatggcggcgggtggcggctctccgcccagtggcaaaagggagaagaggtccaggtgattgcagttgaacctggtaaaaatccaaagaacttccagacaatgcccggcaccttccagactaccacaggggagatcggagctatagccctggattttaaacctggcacgagcggttcgccgatcattaatagagaggggaaggtggtcggactttacggcaacggcgtggttactaagaatgggggatatgtgtcaggtatcgcgcaaaccaacgccgaaccagacggccccacacctgagttagaagaggaaatgttcaaaaagaggaatctgaccattatggatctccacccagggtctggaaaaactcgtaagtacttgcccgcaatcgtccgcgaggctataaaacggagactgaggacactcattctggcccctacccgagtggtagctgcagagatggaagaggcccttaagggcctgccgatccggtatcagacgactgccacaaagagtgaacataccggtcgcgagatcgtggacttgatgtgccacgctacctttactatgagactactgtcccccgttagggtcccaaactacaatctcattatcatggatgaagcgcatttcacagaccctgcaagcatagccgctcgggggtacatttctacccgagtgggaatgggcgaggccgcagccatctttatgacagctactcccccaggcacggcggatgccttccctcagagcaacgcacccattcaggacgaggaaagagacatcccagagcgctcctggaattcagggaacgaatggataaccgattttgctggaaaaacagtgtggttcgtcccgagtattaaggccggtaacgacatcgcaaattgtttaaggaaaaacggcaagaaagtaatccaactgagccgtaagacttttgataccgagtatcagaagacaaaacttaatgactgggatttcgtggttaccactgacatttctgagatgggggccaactttaaggctgatcgggtgatcgaccctagaaggtgcctgaaacccgtcattctcacggatggaccagaacgcgtgatattggccggccccatgcctgttaccgcggcatccgccgctcagcgaagaggtcgggtggggaggaatccacagaaggagaacgaccaatacatcttcacaggccagcccctgaataacgatgaagaccacgcccattggactgaggctaaaatgctcctggacaatattaacacccctgaaggaatcatcccggcacttttcgagccagagcgcgaaaagtcagccgctattgatggcgagtatcgtctaaagggggaaagtagaaaaacatttgtcgagctgatgcggaggggagacttgcccgtgtggttagcccacaaggtagcaagcgaaggtataaaatacaccgatcgcaagtggtgcttcgacggccagcgaaataaccagatcctggaggagaatatggatgtggaaatttggactaaagagggggaaaagaaaaagctcagacctcggtggctggacgcgaggacatattccgatccccttgccctgaaggagtttaaagacttcgctgccggacgcaagtctatcgcactcgatttggttacggaaattggcagagtcccaacccacctggctcataggactcggaacgccctagacaatctggtgatgctccacacatcggagcatggtgggaaagcataccgtcacgccgtggaggaacttcctgagaccatggaaaccctgttattgctgggcctcatgatcctgcttacaggaggcgctatgctgtttctcataagcgggaagggaatcggtaaaacttcaattggcttgatctgtgtcattgcgtccagtgggatgctgtggatggccgagatccccttacaatggatagcatctgctattgttctagagttctttatgatggtgctgctcatcccagaacctgagaagcagcgcacgccgcaggataaccaacttgcctatgtagtgattggaatcctgaccttggccgcaataatcgctgccaatgaaatgggcctgctcgagacaactaagcgagacctgggtatgagcaaagaacccggggtcgtgtccccaacctcataccttgatgttgacctccaccctgcgtctgcttggacactgtacgccgtggcaaccactgtcattacgcccatgttgagacatacaatcgagaacagcaccgccaacgtaagtctggctgcaattgccaatcaggcggtggttttaatgggcctagacaagggatggccaatctccaaaatggatctgggcgtgcctctccttgctctggggtgctatagccaggtcaaccccttgactctgaccgccgcagtgctcctgcttataacacactacgccattatcggaccgggcttacaggctaaggccactagggaggcacaaaaacggaccgctgccggtatcatgaagaatccaacagtcgacgggattatgacgatcgatctggaccctgtgatatatgattctaagttcgaaaaacagctcggacaggttatgttgctggtgctatgtgcggtacagctgctccttatgcgcacctcatgggccctgtgcgaggcattgactctggctacaggccccattaccactctctgggaaggttccccaggcaagttttggaacacaaccatcgccgtgagtatggcaaatattttcagagggagctacctggctggagccggcttagccttttcgatcatgaaatctgtcgggacgggaaagaggggcaccggttcccaaggggagacacttggagaaaaatggaagaagaaactgaaccagctcagccggaaggagttcgacctatataaaaagtcaggcataactgaggttgatcgaaccgaagcgaaagagggtctgaagagaggcgaaatcacacatcacgctgtgagtcgcgggtctgcaaaattgcagtggtttgtcgagaggaatatggtgattcccgaaggacgggtaatcgacctgggctgtgggcgtggaggctggtcctactattgcgccggtctcaagaaggtgactgaggttagagggtacaccaaaggaggccctggccatgaggaaccggtgcccatgagcacatacgggtggaacattgtcaagcttatgtcaggaaaagatgtgttctatctgccacctgagaagtgtgacaccttgctgtgcgatatcggtgaaagtagcccctcccctactgtcgaggagtctaggacgattcgcgtgctcaaaatggttgaaccatggttaaagaataaccagttctgtatcaaggtactgaatccctacatgcctgctgtgatagagcaccttgaacggctgcaacgaaaacacggcgggatgctagtcagaaacccactcagcaggaattccacacatgagatgtattggatttcaaacggaaccggcaatatcgtggcctctgttaacatggtgagtcgcctgttgctgaaccggtttactatgacccacagacgtcccacaatcgaaaaggacgtcgatctcggtgcagggacgaggcatgtgaatgccgagccggagacccctaacatggacgtaattggagaacggataaaacgcatcaaggaggaacacaattcgacttggcactacgacgatgagaacccatataaaacatgggcttaccatggcagctatgaagtgaaggcgaccggctccgcctcttcaatgattaatggggttgtcaagcttctgactaaaccctgggacgtggtgcctatggtcatccagatggcaatgacagataccacaccattcggacagcaacgagtttttaaggagaaagtggacactagaacccccaggagcatgccgggtacgcggcgcgtaatggagattaccgctgaatggttatggagaacactgggcaggaacaagaaacctcgattgtgcactcgggaggaattcaccaagaaggtgcgtacaaatgccgcaatgggggccgtctttactgaggaaaaccagtgggattccgctaaagccgcggtggaggacgaggatttctggaagctcgttgacagagaacgcgagctgcacaaactaggaaagtgtggcagttgcgtgtacaatatgatgggtaaaagggaaaagaaacttggggagtttggaaaggcaaagggctctcgggccatctggtacatgtggctgggcgctagatatctcgagttcgaagccctggggtttttgaacgaggatcattggttcagccgcgaaaattcatactccggagtcgagggtgaaggcctgcacaaactcgggtatatacttagggacatcagtaagattcccggaggcgcaatgtacgctgatgacaccgccggttgggacacgcgaatcacagaggatgacctgcataacgaggaaaaaattacccagcagatggatccagagcaccggcaattagctaatgccatctttaagctgacttatcagaacaaagtggtaaaggttcagagacctacacccaccgggactgtgatggacataattagcaggaaggatcagcgcggatctggccaagtcggcacctacgggttgaatacattcacgaacatggaagcacagctcatccgtcagatggagggagaaggtgtgctgtccaaagcggacctagagaacccacaccttcccgagaagaaaatcacccagtggctggaaactaagggcgtggagcggctcaaaagaatggccatttcaggggatgactgcgtcgttaagcctatagatgacaggtttgctaatgccctgttggcattaaacgatatgggaaaggtgcgcaaagacatcccacaatggcagccgagcaagggctggcatgattggcagcaggtacccttctgttcgcaccatttccacgaactgattatgaaagacggtcgaaagctcgtggtcccttgccggccacaagacgagcttatcgggagagctaggatttctcagggagccggctggagtctgcgcgaaacagcatgtctaggcaaagcctatgcgcagatgtggtccctgatgtactttcacagacgggatctcaggttggctagcaatgccatctgctcagcagtgcccgttcattgggtgcctacctcccgtactacatggtctatacacgcccatcaccaatggatgaccacggaggacatgctgacagtctggaaccgagtgtggatcgaggataatccatggatggaagacaagacccccgtaactacctgggagaacgttccttaccttgggaagcgcgaagatcagtggtgtggaagcctgattggtctcacaagtagagctacttgggcccagaatatcccgaccgcaattcagcaagtgcggtccttaatcggcaacgaggagttcctggactatatgccaagcatgaaaaggtttcgcaaggaagaggaatctgagggggctatttggtga

SEQ ID NO: 15546 - RNA, 9873 nt, synthetic construct
  misc_feature 1..9873: note = derived and/or modified CDS sequence (opt3) from DENV-3__KF955486__SS-prME
  source 1..9873: mol_type = other RNA
accagcctgtgcctcatgatgatccttcccgccgctctggcattccacttgacctccagagacggagaacctaggatgattgtggggaagaacgaacggggaaaatctttactgtttaagactgcctcaggtataaatatgtgtacgttaatcgcgatggatctcggcgagatgtgcgacgataccgtaacctacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcaccttactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccaaaattcagggggaacaagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaactaagaaagaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccaccagatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaagatacagcccttcctggctttaggatttttcctcaggaaactgacttctcgcgagaaccttctgctaggcgtcggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaaaactgactggctcccaatgaccgtcgcggctatgggcgtaccccctctgcccttgtttatcttctctctgaaggatacgttaaagcgtagaagctggccactcaatgaaggggtgatggccgttggactggtgtcaattcttgcaagttccctgttgaggaacgacgtccctatggccggccccctcgtggctggtgggctgctaatcgcatgttacgtaattacaggaacctctgccgatctgactgtggagaaagcggctgacgtcacatgggaagaggaagccgagcagaccggcgttagccataaccttatgatcactgtggacgatgacggcacaatgcgcataaaggatgacgagaccgaaaatattctcacggtgctgttgaaaactgcattactgatcgtctccgggatctttccatactcaattccggccaccctcctggtgtggcacacatggcagaagcagacccaacggagcggagttctttgggatgtacctagtcccccagagacacagaaagctgaactggaggagggtgtgtatagaataaagcagcagggcatcttcgggaaaactcaagtcggagtgggcgttcagaaggaaggtgtgtttcataccatgtggcacgtcacgagaggggccgtgttgacatacaacggaaagcgactagagcccaattgggcatctgtcaagaaggacctgatttcctatggcggcgggtggcgcctcagcgctcagtggcaaaaaggagaagaggtccaggtgatcgccgttgaacctggtaagaaccccaagaatttccagactatgcccggcaccttccagacaaccactggggagattggagcgatcgccctggattttaagcctggcacctcgggttcaccgataatcaaccgggaggggaaggtggtcggactttacggcaatggcgtggttaccaaaaacgggggatatgtgtctggtattgcacaaacgaatgctgaaccagacggccccactcctgagttagaagaggaaatgttcaagaaaagaaacctgaccatcatggatctccacccagggagtggaaagacaaggaaatacttgcccgccattgtccgtgaggctatcaagcgccggctgagaaccctcatactggcacctactagggtggtagccgccgagatggaagaggctcttaagggcctgccgattcgatatcagacaaccgcgacgaaatccgaacatactggtcgggagatcgtggacttgatgtgccacgcaacatttaccatgcgcctactgagccccgttagagtcccaaattacaacctcatcattatggatgaagcccatttcaccgaccctgcttctatcgccgcaagggggtacataagcactcgggtgggaatgggcgaggccgctgcgatttttatgacagccacaccaccaggcacagcagatgctttccctcagtccaatgcccccatccaggacgaggaaaaggacattccagagcgatcatggaacagtgggaatgaatggatcactgattttgcaggaaaaacggtgtggttcgtcccgagcataaaggccggtaacgacattgctaactgtttaaggaaaaatggcaagaaggtaatccaactgtctcgcaaaacctttgatacagagtatcagaagactaaacttaacgactgggatttcgtggttaccacagacatctccgagatgggggccaattttaaggcggatagggtgattgaccctcgtcggtgcctgaaacccgtcatcctcaccgatggaccagaaagagtgattttggcaggccccatgcctgttactgccgcttcagccgctcagaggcgcggtcgagtggggagaaacccacagaaggagaatgaccaatacatattcacgggccagcccctgaacaatgatgaagaccacgcacattggaccgaggccaagatgctcctggacaacatcaatacacctgaaggaattatcccggctcttttcgagccagagcgggagaaaagtgccgcaatcgatggcgagtataggctaaagggggaaagccgcaaaacttttgtcgagctgatgcgtagaggagacttgcccgtgtggttagcgcacaaggtagcctccgaaggtattaaatacaccgatcggaagtggtgcttcgacggccagaggaacaatcagatactggaggagaacatggatgtggaaatctggacaaaagagggggaaaagaagaaactccgccctcgatggctggacgctagaacctattctgatccccttgccctgaaggagtttaaagacttcgcagctggacggaagtcgattgccctcgatttggttactgaaatcggcagggtcccaacacacctggcacatcgcacgagaaatgccctagacaacctggtgatgctccacaccagcgagcatggtgggaaggcttacaggcacgcggtggaggaacttcctgagactatggaaacactgttattgctgggcctcatgattctgcttaccggaggcgccatgctgtttctcatctcagggaagggaataggtaagacctccatcggcttgatttgtgtcatcgcaagttctgggatgctgtggatggctgagattcccttacaatggatcgccagcgccatagttctagagttctttatgatggtgctgctcattccagaacctgagaaacagcggacaccgcaggataatcaacttgcatatgtagtgatcggcattctgactttggctgccatcatagcggctaacgaaatgggcctgctcgagacgaccaagcgtgacctgggtatgtccaaagaacccggggtcgtgtcaccaacatcttaccttgatgttgacctccaccctgccagcgcatggactctgtacgccgtggctaccacagtcatcacccccatgttgcgccatactattgagaatagtacggcaaacgtatccctggccgcgatcgctaaccaggccgtggttttaatgggcctagacaagggatggccaattagcaaaatggatctgggcgtgcctctccttgcactggggtgctattctcaggtcaatcccttgacactgaccgccgctgtgctcctgcttatcactcactacgccataattggaccgggcttacaggcaaaggctacccgagaggcccaaaagagaacagcggccggtatcatgaaaaacccaactgtcgacgggatcatgaccattgatctggaccctgtgatctatgattcaaagttcgaaaaacagctcggacaggttatgttgctggtgctatgtgcagtacagctgctccttatgaggacatcctgggctctgtgcgaggccttgacgctggcaaccggccccataactacactctgggaaggtagtccaggcaagttttggaataccactattgctgtgagcatggccaacatcttccgggggtcgtacctggccggagcgggcttagctttttctattatgaaatccgtcgggacaggaaagcgcggcaccggtagccaaggggagacgcttggagaaaagtggaaaaagaaactgaatcagctctcaagaaaggagttcgacctatataaaaagagtggcatcaccgaggttgataggacagaagcaaaagagggtctgaagcggggcgaaataactcatcacgccgtgtctcgagggtccgctaagttgcagtggtttgtcgagagaaacatggtgatccccgaaggacgcgtaattgacctgggctgtgggaggggaggctggagctactattgcgccggtctcaaaaaggtgaccgaggttcgggggtacacaaaaggaggccctggccatgaggaaccggtgcccatgtcaacttacgggtggaatatcgtcaaacttatgagtggaaaagatgtgttctatctgccacctgagaagtgtgacaccttgctgtgcgatattggtgaaagctccccctctcctacagtcgaggagagccgtaccatcagagtgctcaagatggttgaaccatggctgaaaaacaatcagttctgtattaaggtactaaacccctacatgcctactgtgatcgagcaccttgaaaggctgcaacgcaaacacggcgggatgctagtccggaatccactctcccgaaactcaacgcatgagatgtattggatatctaatggaacaggcaacattgtggcaagtgttaatatggtgtcgagactgttgctgaacaggtttaccatgactcaccgccggcccaccatcgaaaaggacgtcgatctcggtgccgggacaagacatgtgaacgctgagccggagacgcctaatatggacgtaatcggagaacgtattaaaaggataaaggaggaacacaacagcacctggcactacgacgatgagaatccatataagacttgggcgtaccatggctcctatgaagtgaaagccacaggctctgcatcaagcatgatcaacggggttgtcaaacttctgaccaaaccctgggacgtggtgcctatggtcactcagatggctatgacagataccacaccattcggacagcaacgggtttttaaggagaaagtggacactcgcacaccccgatccatgccgggtacgagaagggtaatgggcattaccgccgagtggttatggcggacactggggcgcaataagaagcctagattgtgcactagggaagagttcaccaaaaaggtgcgaacaaacgcagccatgggagctgtctttactgaagagaatcagtgggatagtgccaaagcggcagtggaagacgaggatttctggaagctcgttgaccgggagcgtgaactgcacaaactaggcaagtgtggttcttgcgtgtacaacatgatggggaaaagagagaagaaacttggagaatttggcaaagccaagggcagccgcgctatctggtacatgtggctgggggccaggtatctcgagttcgaggcactgggatttttgaatgaagatcattggttctcacgggagaactcctacagtggtgtcgaaggcgaggggctgcacaaactcggatatattcttagagacatcagcaagatacccggcggtgctatgtacgccgatgacaccgctgggtgggacacgcgcatcacagaagatgacctgcataatgaggagaaaattacccagcagatggatccagaacacaggcaattagccaacgcaatctttaagctgacttatcagaataaggtggtaaaagttcagcgacctacacccaccggaactgtgatggacattatctctcggaaggatcagagaggctccggccaagtcgggacctacggattgaacacattcacgaatatggaggcgcagctcataaggcagatggaaggtgagggcgtgctgtcaaaagccgacctagaaaacccacaccttcccgagaagaaaattacccagtggctggagactaagggggtggaacgcctcaagcgtatggctatcagcggagatgactgcgtcgttaaacctatcgatgaccggtttgccaacgcactgttggctttaaatgatatgggcaaggtgagaaaagacattccacaatggcagccgtcgaagggttggcatgattggcagcaggtacccttctgttctcaccatttccacgagctgataatgaaagacgggaggaagctcgtggtcccttgccgcccacaagacgaacttatcggacgagcccggattagtcagggcgcaggctggtccctgagagagacagcctgtctagggaaggcgtatgctcagatgtggagcctgatgtactttcacaggcgcgatctcagattggcctcaaacgcaatctgctccgccgtgcccgttcattgggtgcctacctctcggactacatggagcattcacgctcatcaccaatggatgaccacggaagacatgctgacagtctggaatagggtgtggatcgaggataacccatggatggaggacaaaacccccgtaactacctgggaaaatgttccttaccttggaaagcgtgaggatcagtggtgtggtagtctgataggcctcacatcccgagccacttgggcacagaacatcccgaccgctattcagcaagtgcgcagcttaatcgggaatgaagagttcctggactatatgccatctatgaaaagatttcggaaggaggaagagtcagaaggagccatttggtga

SEQ ID NO: 15547 - RNA, 9873 nt, synthetic construct
  misc_feature 1..9873: note = derived and/or modified CDS sequence (opt3) from DENV-3__FJ898468__SS-prME
  source 1..9873: mol_type = other RNA
accagcctgtgcctcatgatgatccttccagccgctctggcattccacttgacttccagagacggagaacctaggatgattgtggggaagaacgaacggggaaagtctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacgtcattggcgtgctcgagcaggggaaaagaaccctgactccacagcctatggagttaaagtactcatggaaaacatggggaaaggccaagatcgttaccgcggaaacacaaaacagttccttcataattgatggccccaatactccagagtgccccagcgcctctagggcttggaacgtgtgggaagtcgaggactatggttttggggtgttcaccacgaatatctggctgaaacttcgggaagtttacacacagttgtgtgaccaccgcctcatgtcagcagccgtgaaggatgagagagctgtacacgccgacatgggatactggattgagagtcagaaaaacggcagctggaagctggaaaaagcatccctaatcgaggtcaagacctgcacttggcctaagtctcataccctgtggtcgaatggtgtgctcgaaagcgatatgataatcccaaaatccctggcgggcccgatttcacagcacaactataggcccgggtaccatacacaaactgccggaccttggcaccttggcaagttggagctggactttaattattgcgaggggaccacagtggtcatcacggaaaactgtggaacccgtggcccaagtttacggactacaaccgtttctggtaaactcattcacgagtggtgctgtcgaagctgcactctgccccctcttagatacatgggggaagatggatgttggtatggcatggagatcaggccaatatccgaaaaggaggagaatatggtgaaatcactggtaagcgctggttctggcgaagtggacaacttcacaatgggggtcttgtgcctcgccattctgtttgaggaagtgatgcgcggaaagttcggcaagaaacatatgatcgcaggggttttctttaccttcgtgctactgctctccggacagatcacgtggcgggatatggctcacactctgattatgatcggcagtaatgccagcgacagaatgggtatgggggtcacctaccttgcattgattgccacatttaagatacagcccttcctggctttaggatttttcctcaggaaactgacctctcgcgagaaccttctgctaggcgtgggcctcgcgatggccactacactgcaattgccggaagatatcgagcagatggcaaatgggattgctctgggattaatggccctcaagctgatcacccagtttgagacatatcagctttggactgccctgatttccttgacctgttcaaacacgatcttcacactcaccgttgcttggcgaactgcaaccctgatactagccggtgtgagtctgcttcctgtctgccaaagctcgtccatgcggaaaacagactggctcccaatgactgtagcggctatgggcgtgccccctctgcccttgtttatcttctctctgaaggataccttaaagcgtagaagctggccactcaatgaaggggttatggccgtgggactggtctcaattcttgcaagttccctgttgaggaacgacgtgcctatggccggccccctcgtagctggtgggctgctaatcgcatgttacgtgattacgggaacatctgccgatctgaccgtcgagaaagcggctgacgttacttgggaagaggaagccgagcagacaggcgtgagccataaccttatgatcaccgtggacgatgacggcactatgcgcataaaggatgacgagacagaaaatattctcaccgtcctgttgaaaacggcattactgatcgtgtccgggatctttccatactcaattccggccactctcctggtttggcacacctggcagaagcagacacaacggagcggagtactttgggatgtgcctagtcccccagagacccagaaagctgaactggaggagggtgtctatagaataaagcagcagggcatcttcgggaaaacacaagtgggagttggcgtgcagaaggaaggtgtctttcatactatgtggcacgtgaccagaggggccgtattgacgtacaacggaaagcgactagagcccaattgggcatctgtcaaaaaggacctgatttcctatggcggcgggtggcgcctcagcgctcagtggcaaaaaggagaagaggtgcaggttatcgccgtggaacctggtaagaaccccaagaatttccagacaatgcccggcactttccagaccacaaccggggagattggagcgatcgccctggattttaagcctggcacttcgggttcaccgataatcaaccgggaggggaaggtcgtgggactttacggcaatggcgttgtgaccaaaaacgggggatatgtctctggtattgcacaaacaaatgctgaaccagacggccccacgcctgagttagaagaggaaatgttcaagaaaagaaacctgactatcatggatctccacccagggagtggaaagaccaggaaatacttgcccgccattgtgcgtgaggctatcaagcgccggctgagaacactcatactggcacctaccagggtagtggccgccgagatggaagaggctcttaagggcctgccgattcgatatcagactacagcgaccaaatccgaacatacgggtcgggagatcgttgacttgatgtgccacgcaacttttacaatgcgcctactgagccccgtcagagtgccaaattacaacctcatcattatggatgaagcccatttcaccgaccctgcttctatcgccgcaagggggtacataagcacccgggtgggaatgggcgaggccgctgcgatttttatgactgccacacccccaggcaccgcagatgctttccctcagtccaatgcccccatccaggacgaggaacgagacattccagagagatcatggaacagtgggaatgaatggatcacagattttgcaggaaagactgtctggttcgtaccgagcataaaagccggtaacgacattgctaactgtttacgcaagaatggcaaaaaggtgatccaactgtctaggaagacgtttgataccgagtatcagaaaacaaaacttaacgactgggatttcgttgtgactaccgacatctccgagatgggggccaattttaaagcggatcgtgtcattgaccctcggagatgcctgaagcccgtgatcctcacagatggaccagaaagggttattttggcaggccccatgcctgtgaccgccgcttcagccgctcagcgccgaggtagagtcgggcggaacccacagaaagagaatgaccaatacatattcactggccagcccctgaacaatgatgaagaccacgcacattggacggaggccaagatgctcctggacaacatcaatacccctgaaggaattatcccggctcttttcgagccagagagggaaaagagtgccgcaatcgatggcgagtatcgcctaaaaggggaaagccgtaagacatttgtggagctgatgagacggggagacttgcccgtatggttagcgcacaaagtggcctccgaaggtattaagtacactgataggaaatggtgcttcgacggccagcgcaacaatcagatactggaggagaacatggatgttgaaatctggaccaaggagggggagaagaagaagctccgacctagatggctggacgctcggacatattctgatccccttgccctgaaagagtttaaggacttcgcagctggaaggaaatcgattgccctcgatttggtcaccgaaatcggccgcgtgccaagccacctggcacatagaactaggaatgccctagacaacctggtgatgctccacacatcagagcatggtgggaaggcttaccggcacgcggtcgaggaacttcctgagacgatggaaaccctgttattgctgggcctcatgattctgcttactggaggcgccatgctgtttctcatctccgggaaaggaataggtaagacaagtatcggcttgatttgtgttatcgcatctagcgggatgctgtggatggctgagattcccttacaatggatcgcctccgccatagtgctagagttctttatgatggtactgctcattccagaacctgagaagcagcgtaccccgcaggataatcaacttgcatatgtggtcatcggcattctgaccttggctgccatcatagcggctaacgaaatgggcctgctcgagacaactaaacgcgacctgggtatgtcaaaggaacccggggtggtttctccaacgagctaccttgatgtggacctccaccctgccagtgcatggaccctgtacgccgtcgctacaactgtaatcacccccatgttgcgacatacaattgaaaattccaccgcaaacgtgagcctggccgcgatcgctaaccaggccgttgtgttaatgggcctagacaaaggatggccaatttctaagatggatctgggcgtccctctccttgcactggggtgctattcacaggtgaatcccttgactctgacggccgctgtcctcctgcttatcacacactacgccataattggaccgggcttacaggcaaaagctaccagagaggcccaaaagaggactgcggccggtatcatgaagaacccaaccgtggacgggatcatgacaattgatctggaccctgttatctatgattccaaattcgagaagcagctcggacaggtgatgttgctggtactatgtgcagtgcagctgctccttatgcggacaagttgggctctgtgcgaggccttgaccctggcaacaggccccataacgaccctctgggaaggtagcccaggcaaattttggaatactacaattgctgtctcgatggccaacatcttccgcgggtcttacctggccggagcgggcttagctttttccattatgaaaagcgttgggaccggaaaaagaggcactggttcacaaggggagacacttggagaaaagtggaagaaaaagctgaatcagctcagtaggaaagagttcgacctatataagaaatctggcatcaccgaggtggatcggacggaagcaaaggagggtctgaaacgaggcgaaataacccatcacgccgtctccagagggagcgctaagttgcagtggtttgtggagcgcaacatggtaatccccgaaggaagggtgattgacctgggctgtgggcggggaggctggtcatactattgcgccggtctcaagaaagttacagaggtgcgtgggtacactaagggaggccctggccatgaggaaccggtccccatgagtacctacgggtggaatatcgtgaaacttatgagcggaaaggatgtcttctatctgccacctgagaaatgtgacacattgctgtgcgatattggtgaatcctctcccagccctactgtggaggagtccagaaccatcagggttctcaagatggtagaaccatggttaaagaacaatcagttctgtattaaagtgctgaacccctacatgcctacagtcgtggagcaccttgaacgcctgcaacggaagcacggcgggatgctagttcgaaatccactctcaagaaactctacccatgagatgtattggatcagtaatggaactggcaacatagtggcatcggtcaatatggtgagcaggctgttgctgaaccgctttacgatgacacaccggagacccaccattgaaaaagacgtagatctcggtgccgggactcgtcatgtgaacgctgagccggagacccctaatatggacgttatcggagaaaggatcaagcggattaaagaggaacacaactccacatggcactacgacgatgagaatccatataagacgtgggcgtaccatggctcttatgaagtcaaggccaccggctcagcaagctccatgataaacggggtggtgaaacttctgactaagccctgggacgtcgttcctatggtgacacagatggctatgaccgatactacaccattcggacagcaacgcgtatttaaagagaaggtggacacccgaacacccagaagtatgccgggtactaggcgggtcatgggcatcaccgccgagtggttatggcgcacgctggggagaaataaaaagcctaggttgtgcacccgagaagagttcacaaagaaagtgcggactaacgcagccatgggagctgtttttaccgaagagaatcagtgggattctgccaaggcggcagtggaagacgaggatttctggaaactcgtcgaccgtgagagagaactgcacaagctaggcaaatgtggtagctgcgtgtacaacatgatggggaagcgcgagaagaaacttggagaatttggcaaagccaaaggctcaagggctatttggtacatgtggctgggggcccggtatctcgagttcgaggcactgggatttttgaatgaagatcattggttctccagagagaacagttacagcggtgtagaaggcgaggggctgcacaagctcggatatatccttcgcgacatttctaaaatccccggcggtgctatgtacgccgatgacacagctgggtgggacactaggataaccgaagatgacctgcataatgaggagaagatcacgcagcagatggatccagaacaccgacaattagccaacgcaatttttaaactgacatatcagaataaggttgtgaaggtccagcggcctacccccactggaacagtgatggacatcatttccagaaaagatcagaggggctcaggccaagtggggacctacggattgaacactttcaccaatatggaggcgcagctcatccgccagatggaaggtgagggcgtcctgagcaaggccgacctagaaaacccacgtcttcccgagaaaaagataacacagtggctggagacgaaaggggttgaacggctcaagagaatggctatttcgggagatgactgcgtggtaaagcctatcgatgacaggtttgccaacgcactgttggctttaaatgatatgggcaaagtgcgcaaggacatcccacaatggcagccgtctaaaggttggcacgattggcagcaggtccccttctgtagtcatcacttccatgagctgattatgaaggacgggcgaaaactcgtggttccttgccggccacaagacgaacttataggaagggccaggatctcccagggcgcaggctggagcctgcgcgagaccgcctgtctagggaaggcgtatgctcagatgtggtcactgatgtactttcacagacgggatctcaggttggcctccaacgcaatttgctctgccgtgcccgtccactgggtgcctactagccgtacaacctggagtatccatgctcaccatcaatggatgactacagaagacatgctgaccgtatggaatcgagtttggattgaggataacccatggatggaggacaagacgcccgtgacaacctgggaaaatgtcccttaccttggaaaacgcgaggatcagtggtgtggttccctgatcggcctcactagcagagccacctgggcacagaacataccgacagctatccagcaagtgcggtctttaattgggaatgaagagttcctggactatatgccatcaatgaagaggtttcgcaaagaggaagagagtgaaggagccatctggtga

SEQ ID NO: 15548 - RNA, 9873 nt, synthetic construct
  misc_feature 1..9873: note = derived and/or modified CDS sequence (opt3) from DENV-3__FJ898469__SS-prME
  source 1..9873: mol_type = other RNA
accagcctgtgcctcatgatgatccttcccgccgctctggcattccacttgacatccagggacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaagaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtacctggccggagcgggcttagctttttctatcatgaagtccgtcgggactggaaaaagaggcacaggtcttcaaggggagaccctgggagaaaagtggaagaaaaagctcaatcagctaagcaggaaagagttcgacctgtataagaaatcaggcataacggaggttgatcggaccgaagcaaaggagggtttgaaacgaggcgaaatcacacatcacgccgtgagtagagggtctgctaagctgcagtggtttgtcgagcgcaacatggtgattcccgaaggaagggtaatcgacctcggctgtgggcggggaggctggtcctactattgcgccggtcttaagaaagtgactgaggttcgtgggtacaccaagggaggccctggccatgaggaaccggtgcccatgagcacatacgggtggaatattgtcaaactgatgtcaggaaaggatgtgttctatttgccacctgagaaatgtgacactctgctctgcgatatcggtgaaagtagcccctcccctaccgtcgaggagtctagaacaattagggtgttaaagatggttgaaccatggctgaagaacaatcagttctgtatcaaagtacttaacccctacatgcctaccgtgatagagcacctggaacgcctacaacggaagcacggcgggatgctcgtccgaaatccactgagcagaaactccactcatgagatgtattggatttcaaatggaacgggcaacatcgtggcatctgttaatatggtgagtaggttgctgctcaaccgctttacaatgacccaccggagacccactatcgaaaaagacgtcgatcttggtgccgggacccgtcatgtgaacgctgagccggagacacctaatatggacgtaattggagaaaggataaagcggatcaaagaggaacacaactcgacgtggcactacgacgatgagaatccatataagacctgggcgtaccatggcagctatgaagtgaaggccactggctccgcatcttcaatgattaacggggttgtcaaactgttaacaaagccctgggacgtggtgcctatggtcacccagatggctatgactgatacaaccccattcggacagcaacgcgtttttaaagagaaggtggacacacgaactcccagaagcatgccgggtaccaggcgggtaatgggcatcacggccgagtggctgtggcgcaccttggggagaaataaaaagcctaggctctgcacacgagaagagttcactaagaaagtgcggaccaacgcagccatgggagctgtctttacagaagagaatcagtgggattccgccaaggcggcagtggaagacgaggatttctggaaactggttgaccgtgagagagaactacacaaacttggcaaatgtggtagttgcgtgtacaacatgatggggaagcgcgagaaaaagctgggagaatttggcaaggccaaaggctctagggctatttggtacatgtggctcggggcccggtatctggagttcgaggcattgggatttctgaatgaagatcattggttcagcagagagaactcatactccggtgtcgaaggcgaggggctccacaaacttggatatatcctgcgcgacataagtaaaatccccggcggtgctatgtacgccgatgacactgctgggtgggacaccaggattacggaagatgacttacataatgaggagaagatcacacagcagatggatccagaacaccgacaactggccaacgcaatttttaaattgacctatcagaataaggtggtaaaggttcagcggcctactcccacaggaaccgtgatggacatcataagcagaaaagatcagaggggctctggccaagtcgggacttacggactcaacaccttcacaaatatggaggcgcagctgattcgccagatggaaggtgagggcgtgctatccaaggccgaccttgaaaacccacatctgccagagaaaaagatcacgcagtggctcgagaccaaaggggtggaacgtctgaagcggatggctatctcaggagatgactgcgtcgttaagcctattgatgacagatttgccaacgcattgttagctctgaatgatatgggcaaagtgaggaaggacataccacaatggcagccgagcaaaggttggcacgattggcagcaggtacccttctgttcgcaccatttccacgagctcatcatgaaggacgggcgcaaacttgtggtcccttgccgaccacaagacgaactgattggacgggccagaatctctcagggcgcaggctggagtctaagggagactgcctgtctggggaaggcgtatgctcagatgtggtccctcatgtactttcaccgcagagatttgcggctggccagcaacgcaatttgctcagccgtgcccgttcattgggtgcctacatccaggaccacttggtctatccacgctcatcaccaatggatgacaaccgaagacatgcttacggtctggaatcgtgtgtggatagaggataacccatggatggaggacaagacacccgtaaccacttgggaaaatgttccttacctgggaaaacgagaggatcagtggtgtggtagcctcatcggcttaaccagtcgcgccacatgggcacagaacattccgactgctatccagcaagtgagatccctgattgggaatgaagagttcttggactatatgccaagcatgaagcggtttaggaaagaggaagagtctgaaggagccatctggtga

SEQ ID NO: 15549 - RNA, 9873 nt, synthetic construct
  misc_feature 1..9873: note = derived and/or modified CDS sequence (opt3) from DENV-3__FJ898470__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttacggcaatggcgtggttaccaaaaacgggggatatgtgtctggtatcgcacaaacaaatgctgaaccagacggccccacgcctgagttagaagaggaaatgttcaagaaaagaaacctgactattatggatctccacccagggagtggaaagaccaggaaatacttgcccgccatcgtccgtgaggctataaagcgccggctgagaacactcattctggcacctaccagggtggtagccgccgagatggaagaggctcttaagggcctgccgatccgatatcagactacagcgaccaaatccgaacatacgggtcgggagatcgtggacttgatgtgccacgcaacttttacaatgcgcctactgagccccgttagagtcccaaattacaacctcattatcatggatgaagcccatttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtatcagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatacatcttcactggccagcccctgaacaatgatgaagaccacgcacattggacggaggccaagatgctcctggacaacattaatacccctgaaggaatcatcccggctcttttcgagccagagagggaaaagagtgccgcaattgatggcgagtatcgcctaaaaggggaaagccgtaagacatttgtcgagctgatgagacggggagacttgcccgtgtggttagcgcacaaagtagcctccgaaggtataaagtacactgataggaaatggtgcttcgacggccagcgcaacaatcagatcctggaggagaacatggatgtggaaatttggaccaaggagggggagaaaaagaagctccgacctagatggctggacgctcggacatattctgatccccttgccctgaaagagtttaaggacttcgcagctggaaggaaatcgatcgccctcgatttggttaccgaaattggccgcgtcccaactcacctggcacatagaacaaggaatgccctagacaacctggtgatgctccacacgagcgagcatggtgggaaggcttaccggcacgcggtggaggaacttcctgagaccatggaaactctgttattgctgggcctcatgatcctgcttacaggaggcgccatgctgtttctcatatcagggaaaggaatcggtaagacctccattggcttgatctgtgtcattgcaagttctgggatgctgtggatggctgagatccccttacaatggatagccagcgccattgttctagagttctttatgatggtgctgctcatcccagaacctgagaagcagcgtaccccgcaggataatcaacttgcatatgtagtgattggaatcctgacattggctgccataatcgcggctaacgaaatgggcctgctcgagactacgaaacgcgacctgggtatgtccaaggaacccggggtcgtgtcaccaacctcttaccttgatgttgacctccaccctgccagcgcatggacactgtacgccgtggctactaccgtcattacacccatgttgcgacataccatcgagaatagtactgcaaacgtatccctggccgcgattgctaaccaggccgtggttttaatgggcctagacaaaggatggccaatcagcaagatggatctgggcgtgcctctccttgcactggggtgctattctcaggtcaatcccttgacgctgacagccgctgtgctcctgcttataacccactacgccattatcggaccgggcttacaggcaaaagctactagagaggcccaaaagaggaccgcggccggtatcatgaagaacccaacagtcgacgggattatgactatcgatctggaccctgtgatatatgattcaaaattcgaaaagcagctcggacaggttatgttgctggtgctatgtgcagtacagctgctccttatgcggacctcctgggctctgtgcgaggccttgacactggcaacgggccccattaccactctctgggaaggtagtccaggcaaattttggaatacaaccatcgctgtgagcatggccaacattttccgcgggtcgtacctggccggagcgggcttagctttttctatcatgaagtccgtcgggactggaaaaagaggcacaggtagccaaggggagacccttggagaaaagtggaagaaaaagctgaatcagctctcaaggaaagagttcgacctatataagaaaagtggcataacggaggttgatcggaccgaagcaaaggagggtctgaaacgaggcgaaatcacacatcacgccgtgtctagagggtccgctaagttgcagtggtttgtcgagcgcaacatggtgattcccgaaggaagggtaatcgacctgggctgtgggcggggaggctggagctactattgcgccggtctcaagaaagtgactgaggttcgtgggtacaccaagggaggccctggccatgaggaaccggtgcccatgtcaacatacgggtggaatattgtcaaacttatgagtggaaaggatgtgttctatctgccacctgagaaatgtgacactttgctgtgcgatatcggtgaaagctccccctctcctaccgtcgaggagagcagaacaattagggtgctcaagatggttgaaccatggttaaagaacaatcagttctgtatcaaagtactgaacccctacatgcctaccgtgatagagcaccttgaacgcctgcaacggaagcacggcgggatgctagtccgaaatccactctccagaaactcaactcatgagatgtattggatttctaatggaacgggcaacatcgtggcaagtgttaatatggtgtcgaggctgttgctgaaccgctttacaatgacccaccggagacccactatcgaaaaagacgtcgatctcggtgccgggacccgtcatgtgaacgctgagccggagacacctaatatggacgtaattggagaaaggataaagcggatcaaagaggaacacaacagcacgtggcactacgacgatgagaatccatataagacctgggcgtaccatggctcctatgaagtgaaggccactggctctgcatcaagcatgattaacggggttgtcaaacttctgacaaagccctgggacgtggtgcctatggtcacccagatggctatgactgatacaaccccattcggacagcaacgcgtttttaaagagaaggtggacacacgaactcccagatccatgccgggtaccaggcgggtaatgggcatcacggccgagtggttatggcgcaccctggggagaaataaaaagcctaggttgtgcacacgagaagagttcactaagaaagtgcggaccaacgcagccatgggagctgtctttacagaagagaatcagtgggatagtgccaaggcggcagtggaagacgaggatttctggaaactcgttgaccgtgagagagaactgcacaagctaggcaaatgtggttcttgcgtgtacaacatgatggggaagcgcgagaagaaacttggagaatttggcaaagccaaaggcagcagggctatttggtacatgtggctgggggcccggtatctcgagttcgaggcactgggatttttgaatgaagatcattggttctcaagagagaactcctacagtggtgtcgaaggcgaggggctgcacaagctcggatatatccttcgcgacataagcaaaatccccggcggtgctatgtacgccgatgacactgctgggtgggacaccaggattacggaagatgacctgcataatgaggagaagatcacacagcagatggatccagaacaccgacaattagccaacgcaatttttaaactgacctatcagaataaggtggtaaaggttcagcggcctactcccgcgggaacagtgatggacatcatatctagaaaagatcagaggggctccggccaagtcgggacctacggattgaacactttcaccaatatggaggcccagctcattcgccagatggaaggtgagggcgtgctgtcaaaggctgacctagaaaacccacaccttcccgagaaaaagatcacacagtggctggagacgaaaggggtggaacgtctcaagcggatggccatcagcggagatgactgcgtcgttaagcctattgatgacagatttgcaaacgctctgttggccttaaatgatatgggcaaagtgaggaaggacataccacaatggcagccgtcgaaaggttggcatgattggcagcaggtacccttctgttctcaccatttccacgagctgatcatgaaggacgggcgcaaactcgtggtcccttgccgaccacaagacgaacttattggacgggcaagaatcagtcagggcgccggctggtccctgagggagaccgcgtgtctagggaaggcttatgcccagatgtggagcctgatgtactttcaccgcagagatctccggttggcatcaaacgccatttgctccgctgtgcccgttcattgggtgcctacttctaggacaacctggagcatccacgcccatcaccaatggatgactacagaagacatgctgaccgtctggaatcgtgtgtggatagaggataacccatggatggaggacaagacgcccgtaacaacctgggaaaatgttccttaccttggaaaacgagaggatcagtggtgtggtagtctgatcggcctcacttcccgcgcaacctgggctcagaacattccgacagccatccagcaagtgaggagcttaattgggaatgaagagttcctggactatatgccatctatgaagcggtttaggaaagaggaagagtcagaaggagcgatctggtga

SEQ ID NO: 15550 - RNA, 9873 nt, synthetic construct
  misc_feature 1..9873: note = derived and/or modified CDS sequence (opt3) from DENV-3__FJ898471__SS-prME
  source 1..9873: mol_type = other RNA
accagcctgtgcctcatgatgatccttccagcagctctggcattccacttgacttccagggacggcgaacctaggatgattgtggggaagaacgaacggggaaagtctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcatacagaaggttgtgatcttcattttactgatgcttgtcactccatcgatgaccatgcgctgtgtgggcgtagggaacagagactttgttgaaggattgtcaggtgccacatgggtggatgtcgtgctggagcacggcgggtgcgtgaccacgatggcgaagaataaacccactctagacatcgagctccagaagacagaagcaacccaactggccactcttaggaaactgtgtattgagggaaagatcacaaacataaccacggatagccggtgccctacccagggcgaagctgtcttgccagaggaacaggaccagaattatgtttgtaaacacacatacgtggatcgcggttgggggaacggatgcggcctcttcggcaaggggagtctggtaacttgcgccaagtttcaatgtttagagcccattgagggaaaagtggtccagtatgaaaatctgaagtacaccgtgatcattacagttcatactggtgaccagcaccaggtgggcaacgagacccaaggggtcacagcagaaatcacccctcaggcttccactacggaggccatcctcccagaatatggaacacttggcctggagtgctctccgcgaaccggtttggacttcaatgagatgattctactgactatgaaaaacaaggcgtggatggtgcatagacagtggtttttcgatctccccctgccttggaccagcggggccacaaccgaaactccaacatggaataggaaagagcttctggtaacgtttaagaacgcacacgctaaaaagcaagaagttgtggtcttgggctcccaggagggagccatgcacaccgctctcactggcgccacagaaatacaaaattcagggggaaccagtatcttcgcaggtcatctgaagtgtcggttaaaaatggacaagctggagctaaaaggcatgagctacgccatgtgcacaaacacttttgtgctcaagaaagaggtctctgaaacccagcacgggacgattctgatcaaggtggagtacaagggagaagatgttccctgtaaaatacctttctccaccgaggacggccaaggtaaggctcataacgggcgtcttattacagcgaatccagtggtaactaaaaaggaggaacccgtcaacatcgaggcagaaccgcctttcggcgagtcaaatatcgtgattggaatcggcgataacgccttgaaaattaattggtataagaaggggagcagtataggaaaaatgtttgaagctaccgcccgcggtgcaagaaggatggccatcctgggcgacacagcttgggatttcgggtctgttggaggcgtgctcaactccctgggtaagatggtccaccagatttttgggagcgcctacactgcacttttctcgggcgtgtcttgggtaatgaaaatcggaatcggcgtgctgttgacctggattgggctcaattccaagaacacgtcaatgagttttagctgcatagttatcggaattatcacactgtatttaggcgcggtcgtgcaggctgacatgggttgtgtgattaattggaaagggaaggagctgaagtgcggatccggcatcttcgtcaccaacgaggttcatacttggacagaacagtacaaatttcaagccgattctcccaagcggctagcaaccgccatagctggtgcctgggagaatggcgtgtgtgggatccgaagcactacccgcatggaaaacctcctgtggaaacagattgcaaatgagcttaactatatcttgtgggaaaataacattaagctgacagtggtagtcggagacatcataggcgtgctcgagcaggggaaaagaacgctgaccccacagcctatggagttaaagtactcatggaaaacttggggaaaggctaagattgttacagccgaaacccaaaacagttccttcatcattgatggccccaatacaccagagtgccccagcgcgtctagggcctggaacgtgtgggaagtcgaggactatggttttggggtgttcactaccaatatctggctgaaacttcgggaagtttacacgcagttgtgtgaccaccgcctcatgtcagctgcagtgaaggatgagagagccgtacacgctgacatgggatactggatagagagtcagaaaaacggcagctggaagctggaaaaagcctccctaatcgaggtcaagacatgcacctggcctaagtctcatactctgtggtcgaatggtgtgctcgaaagcgatatgattatcccaaaatccctggcaggcccgatttcacagcacaactataggcccgggtaccatacccaaacagcgggaccttggcaccttggcaagttggagctggactttaattattgcgaggggactaccgtggtcatcacagaaaactgtggaacgcgtggcccaagtttacggaccactacagtttctggtaaactcatacacgagtggtgctgtcgaagctgcaccctgccccctcttagatacatgggggaagatggatgttggtatggcatggagattaggccaatctccgaaaaggaggagaatatggtgaaatcactggtaagcgccggttctggcgaagtggacaacttcactatgggggtcttgtgcctcgctatcctgtttgaggaagtgatgcgcggaaagttcggcaagaaacatatgattgccggggttttctttacattcgtgctactgctctccggacagatcacctggcgggatatggcacacacgctgattatgataggcagtaatgctagcgacagaatgggtatgggggtcacttaccttgccttgatcgcaacctttaagattcagcccttcctggccttaggatttttcctcaggaaactgacatctcgcgagaaccttctgctaggcgtgggcctcgctatggcgaccactctgcaattgccggaagatatcgagcagatggccaatgggattgcactgggattaatggctctcaagctgatcacacagtttgagacctatcagctttggacagccctggtttccttgacttgttcaaacaccatattcacgctcacagtggcctggcgaaccgctactctgatcctagccggtgtcagtctgcttcctgtatgccaaagctcgtccatgcggaaaaccgactggctcccaatgacagtggccgcgatgggcgttccccctctgcccttgtttattttctctctgaaggatactttaaagcgtagaagctggccactcaatgaaggggtgatggctgtcggactggtgtcaatccttgccagttccctgttgaggaacgacgtacctatggcaggccccctcgtggccggtgggctgctaattgcttgttacgtcatcaccggaacgtctgcagatctgacagttgagaaagccgcggacgtgacctgggaagaggaagctgagcagactggcgtgagccataaccttatgataacagtcgacgatgacggcaccatgcgcattaaggatgacgagactgaaaatatcctcacagtgctgttgaaaaccgccttactgatcgtttccgggatttttccatactcaataccggcaacgctcctggtatggcacacttggcagaagcagacccaacggagcggagtgctttgggatgtccctagtcccccagagacacagaaagccgaactggaggagggtgtgtatagaatcaagcagcagggcattttcgggaaaacccaagttggagtgggcgtccagaaggaaggtgtgtttcatacaatgtggcacgtaactagaggggctgtcttgacctacaacggaaagcgactagagcccaattgggcctctgtgaaaaaggacctgatctcctatggcggcgggtggcgcctcagcgcacagtggcaaaaaggagaagaggttcaggtgattgctgtcgaacctggtaagaaccccaagaatttccagacgatgcccggcacattccagactaccacaggggagatcggagccatagcgctggattttaagcctggcacctcgggttcaccgatcattaaccgggaggggaaggtggttggactttacggcaatggcgtggtcactaaaaacgggggatatgtgtctggtatcgcccaaaccaatgcagaaccagacggccccacacctgagttagaagaggaaatgttcaagaaaagaaacctgacgattatggatctccacccagggagtggaaagactaggaaatacttgcccgctatcgtacgtgaggccataaagcgccggctgagaaccctcattctggctcctacaagggtggttgcagccgagatggaagaggcccttaagggcctgccgatccgatatcagaccactgctacaaaatccgaacataccggtcgggagatcgtcgacttgatgtgccacgcgacgtttactatgcgcctactgagccccgtgagagtgccaaattacaacctcattatcatggatgaagcacatttcacagaccctgcctctatagctgccagggggtacattagcacccgggtcggaatgggcgaggcagccgctatctttatgaccgcgactcccccaggcacagccgatgcattccctcagtccaatgctcccattcaggacgaggaacgagacatcccagagagatcatggaacagtgggaatgaatggataaccgattttgccggaaagacagtatggttcgtgccgagcattaaagcaggtaacgacatcgccaactgtttacgcaagaatggcaaaaaggttatccaactgtctaggaagacttttgatacggagtatcagaaaaccaaacttaacgactgggatttcgtggtcacaactgacatttccgagatgggggctaattttaaagccgatcgtgtgatcgaccctcggagatgcctgaagcccgttattctcaccgatggaccagaaagggtgatattggcgggccccatgcctgtcacagcagcctcagctgcccagcgccgaggtagagtggggcggaacccacagaaagagaatgaccaatacatcttcaccggccagcccctgaacaatgatgaagaccacgctcattggactgaggcaaagatgctcctggacaacattaatacgcctgaaggaatcatcccggcccttttcgagccagagagggaaaagagtgctgccattgatggcgagtatcgcctaaaaggggaaagccgtaagacctttgtagagctgatgagacggggagacttgcccgtgtggttagcatacaaagttgcgtccgaaggtataaagtatacagataggaaatggtgcttcgacggccagcgcaacaatcagatcctggaggagaacatggatgtcgaaatttggactaaggagggggagaagaagaagctccgacctagatggctggacgcccggacctactctgatccccttgctctgaaagagtttaaggacttcgccgcaggaaggaaatcgatcgctctcgatttggtgacagaaattggccgcgtgccaagccacctggcccacagaaccaggaatgcactagacaacctggtcatgctccatacttcagagcacggtgggaaggcctatcggcatgctgttgaggaacttcctgagacaatggaaacgctgttattgctgggcctcatgatcctgcttaccggaggcgcgatgctgtttctcatatccgggaaaggaatcggtaagacaagtattggcttgatctgtgtgattgcctctagcgggatgctgtggatggcagagatccccttacaatggatagcttccgccattgtactagagttctttatgatggtgctgctcatcccagaacctgagaagcagcgtacaccgcaggataatcaacttgcctacgtcgtgattggaatcctgaccttggcagctataatcgccgcgaacgaaatgggcctgctcgagaccacaaaacgcgacctgggtatgtcaaaggaacccggggttgtgtctccaactagctaccttgatgtcgacctccaccctgctagtgcctggacgctgtatgcagtagccaccacagtgattactcccatgttgcgacacaccatcgaaaattccacagctaacgttagcctggcagccattgcgaaccaggctgtggtcttaatgggcctagacaaaggatggccaatctctaagatggatctgggcgtgcctctccttgccctggggtgctactcacaggtcaatcccttgaccctgactgcagccgtgctcctgcttataacgcattatgctattatcggaccgggcttacaggccaaagcaacaagagaggctcaaaagaggaccgccgcgggtatcatgaagaacccaactgttgacgggattatgaccatcgatctggaccctgtgatatacgattccaaattcgagaagcagctcggacaggtaatgttgctggtgctatgtgccgtccagctgctccttatgcggacaagttgggcactgtgcgaggctttgactctggccaccggccccattacaacgctctgggaaggtagcccaggcaaattttggaataccactatcgcagtttcgatggctaacattttccgcgggtcttatctggccggagccggcttagcgttttccatcatgaaaagcgtggggacaggaaaaagaggcaccggttcacaaggggagactcttggagaaaagtggaagaaaaagctgaatcagctcagtaggaaagagttcgacctatacaagaaatctggcataacagaggtcgatcggaccgaagctaaggagggtctgaaacgaggcgaaatcacgcaccatgcagtgtccagagggagcgccaagttgcagtggtttgtagagcgcaacatggtgattcccgaaggaagggttatcgacctgggctgtgggcggggaggctggtcatattactgcgctggtctcaagaaagtgaccgaggtccgtgggtacacaaagggaggccctggccacgaggaaccggtgcccatgagtacttatgggtggaatattgtcaaacttatgagcggaaaggatgtgttctacctgccacctgagaaatgtgacaccttgctgtgcgatatcggtgaatcctctcccagccctacagttgaggagtccagaactattagggtactcaagatggtggaaccatggttaaagaacaatcagttctgtatcaaagtcctgaacccctatatgcctaccgtgatagagcatcttgaacgcctgcaacggaagcacggcgggatgctagttcgaaatccactctcaagaaactctacacacgagatgtactggattagtaatggaaccggcaacatcgtggcctcggtcaatatggtgagcaggctgttgctgaaccgctttactatgacgcatcggagacccacaatcgaaaaagacgtagatctcggtgcagggacccgtcacgtgaacgccgagccggagactcctaatatggacgttattggagaaaggataaagcggatcaaagaggaacataactccacctggcactatgacgatgagaatccatacaagacatgggcttatcacggctcttacgaagtcaaggcgacgggctcagccagctccatgattaacggggtggtgaaacttctgaccaagccctgggacgtcgttcctatggtgactcagatggcaatgacagataccactccattcggacagcaacgcgtatttaaagagaaggtggacacacgaacccccagaagtatgccgggtacaaggcgggtcatgggcatcactgctgagtggttatggcgcaccctggggagaaataaaaagcctaggttgtgcacgcgagaagagttcaccaagaaagtgcggacaaacgccgcaatgggagccgtttttactgaagagaatcagtgggattctgctaaggccgcggtggaagacgaggatttctggaaactcgtcgaccgtgagagagaactgcataagctaggcaaatgtggtagctgcgtgtacaacatgatggggaagcgcgagaagaaacttggagaatttggcaaagcaaaaggctcaagggccatttggtatatgtggctgggggctcggtacctcgagttcgaggccctgggatttttgaatgaagatcactggttctccagagagaacagttatagcggtgtagaaggcgaggggctgcataagctcggatacatccttcgcgacatatctaaaatccccggcggtgcaatgtatgctgatgacaccgccgggtgggacacaaggattactgaagatgacctgcacaatgaggagaagatcacccagcagatggatccagaacatcgacaattagctaacgccatttttaaactgacgtaccagaataaggttgtgaaggtccagcggcctacacccaccggaactgtgatggacatcatatccagaaaagatcagaggggctcaggccaagtggggacatatggattgaacaccttcactaatatggaggcacagctcattcgccagatggaaggtgagggcgtcctgagcaaggcggacctagaaaacccacaccttcccgagaaaaagatcacccagtggctggagacaaaaggggttgaacgtctcaagcggatggccatctcgggagatgactgcgtggtaaagcctattgatgacagatttgctaacgccctgttggcattaaatgatatgggcaaagtgaggaaggacataccacaatggcagccgtctaaaggttggcacgattggcagcaggtccccttctgtagtcatcacttccatgagctgatcatgaaggacgggcgcaaactcgtggttccttgccgaccacaagacgaacttattggacgggctagaatctcccagggcgccggctggagcctgagggagacggcatgtctagggaaggcctacgcgcagatgtggtcactgatgtactttcaccgcagagatctccggttggcttccaacgccatttgctctgcagtgcccgtccactgggtgcctaccagcaggactacatggagtatccatgcccaccatcaatggatgaccactgaagacatgctgacagtatggaatcgtgtttggatagaggataacccatggatggaggacaagacccccgtgacgacatgggaaaatgtcccttatcttggaaaacgagaggatcagtggtgtggttccctgatcggcctcaccagccgcgctacttgggcccagaacattccgaccgcaatccagcaagtgagatctttaattgggaatgaagagttcctggactacatgccatcaatgaagcggtttaggaaagaggaagagagtgaaggagctatctggtga

SEQ ID NO: 15551 - RNA, 9873 nt, synthetic construct
  misc_feature 1..9873: note = derived and/or modified CDS sequence (opt3) from DENV-3__FJ898472__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttcctaacctttgttctgctcctgtccggacagattacgtggcgggatatggctcacactcttatcatgattggcagtaatgccagcgacagaatgggtatgggggtgacctacttggcactgatagccacattcaagatccagccctttttagctctcggattctttctgaggaaacttacctctcgcgagaacctgctactcggcgtcggcctggcgatggccactacattgcaactgccggaagatattgagcagatggcaaatgggatcgctttaggactcatggccctgaagcttattacccagttcgagacatatcagctgtggactgccttgatctccctcacctgttcaaacacgatatttacactgaccgtggcttggcgaactgcaaccctaatcctggccggtgttagtcttctccctgtgtgccaaagctcgtccatgcggaaaacagactggctgccaatgactgtcgcggctatgggcgtaccccctttgcccctgttcatttttaatttaaaggataccctcaagcgtagatcttggccactgaacgaaggggtgatggccgttggacttgtgagcatcctggcatcaagtttgctcaggaacgacgtccctatggccggccccctggtggctggtgggctactgattgcatgttacgtaatcacgggaacatccgccgatcttaccgtggagaaagcggctgacgtcacttgggaagaggaagccgagcagacaggcgtttctcataatctcatgataaccgtggacgatgacggcactatgcgcattaaggatgacgagacagaaaacatcctgaccgtgttgttaaaaacggcactgctcatcgtcagcgggattttcccatactccataccggccactctgcttgtgtggcacacctggcagaagcagacacaacggtcaggagttctgtgggatgtacctagccccccagagacccagaaagctgaattggaggagggtgtgtatagaatcaagcagcagggcatttttgggaaaacacaagtcggagtgggcgttcagaaggaaggtgtgttccatactatgtggcacgtcaccaggggggccgtgctaacgtacaatggaaagcgactggagcccaactgggcaagtgtaaaaaaggacctcatctcttatggcggcgggtggcgcctgtccgctcagtggcaaaaaggagaagaggtccaggtgattgccgttgaacctggtaagaatccaaaaaactttcagacaatgcccggcactttccagaccacaaccggggagatcggagcgatagcccttgatttcaagcctggcactagcggttcgccgatcattaatcgggaggggaaggtggtcggattatacggcaacggcgtggttaccaaaaatgggggatatgtgtcaggtatcgcacaaacaaacgctgaaccagacggccccacgcctgagctggaagaggaaatgtttaagaaaagaaatctcactattatggatttgcacccagggtctggaaagaccaggaaatacctgcccgccatcgtccgtgaggctataaagcgccggctcagaacactgattcttgcacctaccagggtggtagccgccgagatggaagaggctctgaagggcttgccgatccgatatcagactacagcgaccaaaagtgaacatacgggtcgggagatcgtggacctaatgtgccacgcaactttcacaatgcgcctgctctcccccgttagagtcccaaactacaatttaattatcatggatgaagcccattttaccgaccctgctagcatagccgcaagggggtacatttctacccgggtgggaatgggcgaggccgctgcgatcttcatgactgccacacccccaggcaccgcagatgcttttcctcagagcaacgcccccattcaggacgaggaacgagacatcccagagagatcctggaattcagggaacgaatggataacagatttcgcaggaaagactgtgtggtttgtcccgagtattaaagccggtaacgacatcgctaattgtctgcgcaagaacggcaaaaaggtaatccaacttagcaggaagacgttcgataccgagtatcagaaaacaaagctgaatgactgggattttgtggttactaccgacatttctgagatgggggccaacttcaaagcggatcgtgtgatcgaccctcggagatgcctcaagcccgtcattttgacagatggaccagaaagggtgatactggcaggccccatgcctgttaccgccgcttccgccgctcagcgccgaggtagagtggggcggaatccacagaaagagaacgaccaatacatctttactggccagcccctcaataacgatgaagaccacgcacattggacggaggccaagatgctgcttgacaatattaacacccctgaaggaatcatcccggctctattcgagccagagagggaaaagtcagccgcaattgatggcgagtatcgcctgaaaggggaaagtcgtaagacattcgtcgagttgatgagacggggagacttacccgtgtggctggcgcacaaagtagccagcgaaggtataaagtacactgataggaaatggtgctttgacggccagcgcaataaccagatcctcgaggagaatatggatgtggaaatttggaccaaggagggggaaaaaaagaagctgcgacctagatggcttgacgctcggacatattccgatcccctggccctcaaagagttcaaggactttgcagctggaaggaaatctatcgccttggatctggttaccgaaattggccgcgtcccaactcacctagcacatagaacaaggaacgccctggacaatctcgtgatgcttcacacgtcggagcatggtgggaaggcttaccggcacgcggtggaggaactgcctgagaccatggaaactttattgctgctcggcctgatgatccttctgacaggaggcgccatgctcttcttgataagcgggaaaggaatcggtaagacctcaattggcctgatctgtgtcattgcatccagtgggatgttatggatggctgagatccccctacaatggatagcctctgccattgttctggagtttttcatgatggtgctccttatcccagaacctgagaagcagcgtaccccgcaggataaccaactggcatatgtagtgattggaatcttgacactggctgccataatcgcggctaatgaaatgggcctcctggagactacgaaacgcgaccttggtatgagcaaggaacccggggtcgtgtccccaacctcatacctcgatgttgacctgcaccctgcctctgcatggacattgtacgccgtggctactaccgtcattacacccatgctgcgacataccatcgagaacagcactgcaaacgtaagtttagccgcgattgctaatcaggccgtggttctaatgggcctggacaaaggatggccaatctccaagatggatctcggcgtgcctcttctggcattggggtgctatagccaggtcaaccccctgacgctcacagccgctgtgctgcttttaataacccactacgccattatcggaccgggcctgcaggcaaaagctactagagaggcccaaaagaggaccgcggccggtatcatgaagaatccaacagtcgacgggattatgactatcgatctcgaccctgtgatatatgattctaaatttgaaaagcagttgggacaggttatgctgctagtgctgtgtgcagtacagctccttctgatgcggacctcatgggctttgtgcgaggccctgacactcgcaacgggccccattaccactctgtgggaaggttccccaggcaaattctggaacacaaccatcgctgtgagtatggccaatatttttcgcgggagctacttagccggagcgggccttgctttctcgatcatgaagtctgtcgggactggaaaaagaggcacaggttcccaaggggagaccctgggagaaaagtggaagaaaaagctcaaccagctaagcaggaaagagtttgacctgtataagaaatcaggcataacggaggttgatcggaccgaagcaaaggagggtttgaaacgaggcgaaatcacacatcacgccgtgagtagagggtctgctaagctgcagtggttcgtcgagcgcaatatggtgattcccgaaggaagggtaatcgacctcggctgtgggcggggaggctggtcctactattgcgccggtcttaagaaagtgactgaggttcgtgggtacaccaagggaggccctggccatgaggaaccggtgcccatgagcacatacgggtggaacattgtcaaactgatgtcaggaaaggatgtgttttatttgccacctgagaaatgtgacactctgctctgcgatatcggtgaaagtagcccctcccctaccgtcgaggagtctagaacaattagggtgttaaagatggttgaaccatggctgaagaataaccagttctgtatcaaagtacttaatccctacatgcctaccgtgatagagcacctggaacgcctacaacggaagcacggcgggatgctcgtccgaaacccactgagcagaaattccactcatgagatgtattggatttcaaacggaacgggcaatatcgtggcatctgttaacatggtgagtaggttgctgctcaaccgcttcacaatgacccaccggagacccactatcgaaaaagacgtcgatcttggtgccgggacccgtcatgtgaatgctgagccggagacacctaacatggacgtaattggagaaaggataaagcggatcaaagaggaacacaattcgacgtggcactacgacgatgagaacccatataagacctgggcgtaccatggcagctatgaagtgaaggccactggctccgcatcttcaatgattaatggggttgtcaaactgttaacaaagccctgggacgtggtgcctatggtcacccagatggctatgactgatacaaccccatttggacagcaacgcgttttcaaagagaaggtggacacacgaactcccagaagcatgccgggtaccaggcgggtaatgggcatcacggccgagtggctgtggcgcaccttggggagaaacaaaaagcctaggctctgcacacgagaagagtttactaagaaagtgcggaccaatgcagccatgggagctgtcttcacagaagagaaccagtgggattccgccaaggcggcagtggaagacgaggatttttggaaactggttgaccgtgagagagaactacacaagcttggcaaatgtggtagttgcgtgtacaatatgatggggaagcgcgagaaaaagctgggagaattcggcaaggccaaaggctctagggctatttggtacatgtggctcggggcccggtatctggagtttgaggcattgggattcctgaacgaagatcattggtttagcagagagaattcatactccggtgtcgaaggcgaggggctccacaagcttggatatatcctgcgcgacataagtaaaatccccggcggtgctatgtacgccgatgacactgctgggtgggacaccaggattacggaagatgacttacataacgaggagaagatcacacagcagatggatccagaacaccgacaactggccaatgcaattttcaaattgacctatcagaacaaggtggtaaaggttcagcggcctactcccacaggaaccgtgatggacatcataagcagaaaagatcagaggggctctggccaagtcgggacttacggactcaatacctttacaaacatggaggcgcagctgattcgccagatggaaggtgagggcgtgctatccaaggccgaccttgaaaacccacacctgcccgagaaaaagatcacgcagtggctcgagaccaaaggggtggaacgtctgaagcggatggctatctcaggagatgactgcgtcgttaagcctattgatgacagattcgccaatgcattgttagctctgaacgatatgggcaaagtgaggaaggacataccacaatggcagccgagcaaaggttggcatgattggcagcaggtacccttttgttcgcaccatttccacgagctcatcatgaaggacgggcgcaaacttgtggtcccttgccgaccacaagacgaactgattggacgggccagaatctctcagggcgcaggctggagtctaagggagactgcctgtctggggaaggcgtatgctcagatgtggtccctcatgtacttccaccgcagagatttgcggctggccagcaatgcaatttgctcagccgtgcccgttcattgggtgcctacatccaggaccacttggtctatccacgctcatcaccaatggatgacaaccgaagacatgcttacggtctggaaccgtgtgtggatagaggataatccatggatggaggacaagacacccgtaaccacttgggaaaacgttccttacctgggaaaacgagaggatcagtggtgtggtagcctcatcggcttaaccagtcgcgccacatgggcacagaatattccgactgctatccagcaagtgagatccctgattgggaacgaagagtttttggactatatgccaagcatgaagcggttcaggaaagaggaagagtctgaaggagccatctggtga

SEQ ID NO: 15552 - RNA, 9873 nt, synthetic construct
  misc_feature 1..9873: note = derived and/or modified CDS sequence (opt3) from DENV-3__FJ898474__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgccttgccagaggaacaggaccagaattatgtctgtaaacacacttacgttgatcgcggttgggggaacggatgcggcctcttcggcaaggggagtctggtgacctgcgcaaagtttcaatgtttagagcccatagagggaaaagtagtgcagtatgaaaatctgaagtacacagtcattatcactgtgcataccggtgaccagcaccaggttggcaacgagacacaaggggtgaccgctgaaattactcctcaggcctccacgacagaggcgatcctcccagaatatggaacccttggcctggagtgctctccgcgaactggtttggacttcaatgagatgatcctactgaccatgaaaaacaaggcctggatggtccatagacagtggtttttcgatctccccctgccttggacaagcggggcaaccactgaaacaccaacgtggaataggaaagagcttctggtgacctttaagaacgctcacgccaaaaagcaagaagtagttgtgttgggctcccaggagggagctatgcacactgccctcacaggcgcaaccgaaattcagaattcagggggaacaagtatattcgccggtcatctgaagtgtcggttaaaaatggacaagctggagctaaaaggcatgagctacgctatgtgcactaacacctttgtcctcaagaaagaggtgtctgaaacgcagcacgggaccatcctgattaaggtcgagtacaagggagaagatgtgccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacattatcggcgtactcgagcaggggaaaagaaccctgactccacagcctatggagttaaagtactcatggaaaacatggggaaaggcgaagataatgaccgccgaaacacaaaacagttccttcattatcgatggccccaatactccagagtgccccagcgcttctagggcatggaacgtctgggaagtggaggactatggttttggggttttcaccacgaatatttggctgaaacttcgggaagtgtacacacagttgtgtgaccaccgcctcatgtcagccgctatcaaggatgagagagccgtccacgcagacatgggatactggatagagagtcagaaaaacggcagctggaagctggaaaaagcgtccctaatcgaggtgaagacctgcacttggcctaagtctcataccctgtggtcgaatggtgttctcgaaagcgatatgattatcccaaaaggcctggccgggccgatttcccagcacaaccataggcccggatatcacacacaaactgctggcccttggcaccttgggaagttggagctggactttaattactgcgagggaaccacagtggtaatcacggaaaactgtggcacccgtggtccatcattacggactacaaccgtcagtgggaaactcatacatgagtggtgctgtcgatcttgcactctgccccctcttagatatattggagaagatggctgttggtacggtatggagatcaggccaatcagcgaaaaggaggagaatatggtgaaatccctggtgtcagccggcagcgggaaggtcgacaacttcacaatgggagttttgtgcctcgcaattctgtttgaagaggtgatgcgcggcaagttcgggaaaaagcacatgatcgctggagtattctttaccttcgtgctactgctctctggccagattacgtggcgggatatggcccatactctgataatgatcggttccaatgcaagtgacagaatggggatgggagtcacctatcttgccttgattgctacatttaaaatccagcccttcctggcgttaggctttttcctcaggaagctgaccagccgcgaaaaccttctgctaggcgtggggctcgccatggcaactacactgcaattgccggaggatattgaacagatggctaatggaatcgccctgggtttaatggccctcaaactgataacccagtttgagacataccagctttggactgctctgatctctttgacctgttccaacacgattttcacactcaccgttgcatggcgaactgccaccctgatcctagcgggcgtgtcactgcttcctgtctgccaaagtagctcgatgcggaagacagactggctcccaatggctgtggccgcaatgggggttccccctctgcccttgtttattttctccctgaaggatactttaaaacgtagatcttggccactcaatgagggagtgatggccgtcggcctggtaagcatccttgcttcaagtctgttgaggaacgacgtgcctatggcaggtcccctcgttgccgggggactgctaatagcgtgttatgtgattaccggcacgtccgctgatctgacagtcgaaaaggccgcagacatcacctgggaggaagaggccgaacagactggcgtgtctcacaaccttatgatcacagtagacgatgacgggaccatgcgcattaaagatgacgagactgagaatatactcacagtgctgttgaagaccgctttactgatcgtcagcggaatttttccatactccatcccggccacgctcctggtttggcatacttggcagaaacagacccaacggtcaggtgtgctttgggatgtgcctagccccccagaaacacagaaggcagagctggaagagggcgtctacagaattaaacagcaggggatcttcggaaagacccaagtgggcgttggtgtacagaaggagggggtgtttcacacaatgtggcacgtcactaggggagctgtgttgacctataacggcaaacgactagaacccaattgggccagtgttaagaaagacctgatatcttacggcgggggatggcgcctctccgcgcagtggcaaaagggtgaggaagtgcaggtcatcgccgtggagcctggcaaaaacccaaagaatttccagacgatgcccgggacattccagactattaccggagaaatcggcgcaattgctctggattttaagcctggtacaagcgggtcgccgatcataaaccgggagggaaaagtagtcggcctttatggcaatggggtggttaccaagaacggaggttacgtgtcaggcattgcccaaactaatgctgagccagacgggcccacccctgaattagaggaagagatgttcaaaaagagaaacctgacaatcatggatctccatccaggatctggcaaaacgaggaagtatttgcccgcaatcgtccgtgaagccattaagcgccggctgagaactctcatcctggcccctaccagggtggttgctgcggagatggaggaagcacttaaaggtctgccgatacgataccagacaaccgccactaagagtgagcacacagggcgggaaattgtggacttgatgtgccatgctacctttacgatgcgcctactgtcccccgtcagagtgccaaattataacctcatcattatggatgaggcccacttcactgaccctgcaagcatcgccgctaggggatacatatctacacgggtaggcatgggcgaagcggccgcaatttttatgaccgctacccccccagggactgccgatgcattccctcagagcaatgcccccatccaggacgaggagcgagacatcccagaaagatcctggaactcaggaaatgagtggattacagattttgctggtaaaaccgtgtggttcgttccgagtatcaaggccggcaacgacattgcgaactgtttacgcaaaaatgggaagaaggtcatacaactgagcaggaaaacatttgatactgaataccagaagacgaaacttaacgactgggatttcgtggtgaccacagacatctctgagatgggagcaaattttaaggccgatcgtgtcattgaccctcggagatgcctgaaacccgtaatcctcactgatggcccagagagggtgatcttggctggtcccatgcctgttaccgccgcttccgcagcccagcgccgagggagagtgggccggaacccacagaaggaaaatgaccaatatattttcacaggacagcccctgaacaatgatgaggaccatgctcactggaccgaagccaagatgctcctggacaacataaatactcctgagggcatcattccggcacttttcgaaccagagagggagaaatcagcggccatcgatggggaataccgcctaaagggagagagtcgtaaaacgtttgtcgaactgatgagacggggtgacttgcccgtgtggttagctcacaaggttgccagcgagggcattaaatataccgataggaagtggtgcttcgacgggcagcgcaacaatcagatcctggaagagaacatggatgtggagatatggacaaaagaaggagagaagaagaaactccgacctagatggctggacgcacggacttactccgatccccttgctctgaaggaatttaaagacttcgccgcaggcaggaagtctatcgccctcgatttggtcaccgagattggtcgcgtgccatcgcatctggctcacagaacaaggaatgcgctagacaacctggtaatgctccataccagcgaacacgggggccgggcctatcgtcacgcagtggaggagcttcctgaaactatggagacactgttattgctgggactcatgatcctgcttacgggcggggctatgctgtttctcatttcaggaaaaggtatcggcaagacctccatagggttgatttgtgttatcgccagttctggaatgctgtggatggccgaaattcccttacaatggatcgcaagcgctatagtcctagagttctttatgatggtgctgctcatcccagagcctgaaaagcagcgcactccgcaggataatcaacttgcctacgtggtcattggcatcctgacattggcggctattatcgccgcaaacgagatgggtctgctcgaaaccaccaaacgagacctggggatgtccaaggagcccggcgttgtgtcaccaacatcttatcttgatgtagacctccatcctgccagcgcttggactctgtacgcagtggccacgaccgtcataacacccatgttgagacacactattgaaaatagtaccgcgaacgtgtccctggctgccatcgcaaaccaggccgttgtgttaatgggactagacaaaggctggccaatcagcaagatggatctgggggtccctctccttgctctgggatgctactctcaggtaaatcccttgacactgaccgccgcagtgctcctgcttattactcattatgctatcataggcccgggtttacaggccaaagcgacgagggaggcccaaaagcggacagcagctgggattatgaagaacccaaccgttgacggaatcatgactattgatctggaccctgtgatctacgattcaaaattcgagaagcagctcggccaggtcatgttgctggtgctatgtgccgtccagctgctccttatgcgcacctcctgggcactgtgcgaagctttgacactggccactggtcccataaccacactctgggagggcagtccagggaaattttggaatacgaccatcgccgtgagcatggcgaacattttcagaggatcgtatctggctggcgcagggttagccttttctatcatgaagtccgttggaactggcaaaaggggtacagggagccaaggagaaacccttggcgagaagtggaagaaaaagctgaatcagctctcacggaaagaattcgacctatacaagaaaagtggtattactgaggtggatcgaacagaggctaaggaaggcctgaaaagaggggagaccacgcaccatgccgtatctcgcggatccgcaaagttgcagtggtttgtggaaaggaacatggtcatccccgagggccgggttattgacctggggtgtggacgtggcggttggagctattactgcgccgggctcaagaaagtgaccgaagtcagaggatatacaaagggcggccctgggcacgaggagccggtgcccatgtcaacttacggatggaatatcgtaaaacttatgagtggtaaggatgtgttctacctgccacctgaaaaatgtgacaccttgctgtgcgatataggcgagagctccccctctcctacagttgaagagagcaggactattcgcgtgctcaagatggtcgagccatggttaaagaacaatcagttctgtatcaaagtgctgaacccctatatgcctaccgtcatcgaacaccttgagcggctgcaacgaaagcatgggggaatgctagtgagaaatccactctccaggaactcaacacacgaaatgtactggatttctaatggcaccggtaacatagttgctagtgtaaatatggtgtcgcgcctgttgctgaaccggtttactatgacgcatagacgtcccacaatcgagaaagacgtcgatctcggggcgggaaccaggcacgtgaacgccgaaccggagactcctaatatggacgttattggcgagcggatcaagcgcattaaagaagagcacaacagcacctggcattatgacgatgaaaatccatacaagacatgggcatatcacggctcctacgaggtgaaggctacggggtctgcctcaagcatgatcaacggagtcgtgaaacttctgaccaagccctgggacgtagtgcctatggttactcagatggcaatgacagataccactccattcggtcagcaacgagtctttaaagaaaaggtggacacaagaacccccaggtccatgccgggcacacggcgcgtgatggggataactgccgagtggttatggagaaccctgggaaggaataaaaagcctcgattgtgcacgcgggaggaattcaccaagaaagtccgtacaaacgctgccatgggcgcggtttttactgaggaaaatcagtgggatagtgcaaaggccgctgtggaggacgaagatttctggaaactcgtagacagagagcgcgagctgcataagctaggtaaatgtgggtcttgcgtgtataacatgatgggaaagagggaaaaaaagcttggcgagtttggcaaggccaaagggagccgggcaatctggtacatgtggctgggagctagatacctcgaattcgaggccctgggttttttgaatgaggatcactggttctcacgcgaaaactcctatagtggcgtcgagggggaaggactgcataagctcggctacattcttagggacatcagcaaaattcccggtggggctatgtatgccgatgacaccgcaggatgggacacacgaatcactgaggatgacctgcacaatgaagagaagataacccagcagatggatccagagcaccggcaattagcgaacgccatttttaaactgacgtaccagaataaggtggttaaggtgcagagacctacacccaccggcactgtcatggacatcatctctaggaaagatcagcgcggctccgggcaagtgggaacatatggtttgaacaccttcactaatatggaagctcagctcattcgtcagatggagggcgaaggggtactgtcaaaggccgacctagagagcccacatcttcccgaaaaaaagataacccagtggctggagacaaaaggagttgagcggctcaagagaatggcaatctcgggcgatgactgcgtggtcaagcctattgatgacaggtttgctaacgccctgttggcattaaacgatatgggtaaagtgcgcaaggacatcccacaatggcagccgtctaaagggtggcacgattggcagcaggtgcccttctgtagtcatcacttccacgaactgattatgaaggacggacgaaaactcgtcgttccttgccggccacaagacgagcttatcggcagagccaggatatcccagggcgcggggtggagcctgcgcgaaacggcttgtctaggaaaggcctacgcacagatgtggtcactgatgtattttcatagacgggatctcaggttggcctccaatgctatctgctctgccgtgcccgtacactgggtgcctaccagccgtactacatggagtattcatgcacaccatcaatggatgaccactgaggacatgctgacagtctggaaccgagtgtggatcgaagataatccatggatggaggacaagacccccgttacgacatgggagaacgtgccttaccttggtaaacgcgaagatcagtggtgtggctccctgattgggctcaccagcagagctacttgggcccagaatatcccgaccgcgattcagcaagtccggtctttaataggaaacgaggaattcctggactacatgccatcaatgaagaggtttcgcaaagaggaggaaagtgagggcgctatctggtga

SEQ ID NO: 15553 - RNA, 9873 nt, synthetic construct
  misc_feature 1..9873: note = derived and/or modified CDS sequence (opt3) from DENV-3__EU529688__SS-prME
  source 1..9873: mol_type = other RNA
accagcctgtgcctcatgatgatccttcccgccgctctggcattccacttgacctccagggacggagaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaagatacagcccttcctggctttaggatttttcctcaggaaactgacttctcgcgagaaccttctgctaggcgtcggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaaaactgactggctcccaatgaccgtcgcggctatgggcgtaccccctctgcccttgtttatcttctctctgaaggatacgttaaagcgtagaagctggccactcaatgaaggggtgatggccgttggactggtgtcaattcttgcaagttccctgttgaggaacgacgtccctatggccggccccctcgtggctggtgggctgctaatcgcatgttacgtaattacaggaacctctgccgatctgactgtggagaaagcggctgacgtcacatgggaagaggaagccgagcagaccggcgttagccataaccttatgatcactgtggacgatgacggcacaatgcgcataaaggatgacgagaccgaaaatattctcacggtgctgttgaaaactgcattactgatcgtctccgggatctttccatactcaattccggccaccctcctggtgtggcacacatggcagaagcagacccaacggagcggagttctttgggatgtacctagtcccccagagacacagaaagctgaactggaggagggtgtgtatagaataaagcagcagggcatcttcgggaaaactcaagtcggagtgggcgttcagaaggaaggtgtgtttcataccatgtggcacgtcacgagaggggccgtgttgacatacaacggaaagcgactagagcccaattgggcatctgtcaagaaggacctgatttcctatggcggcgggtggcgcctcagcgctcagtggcaaaaaggagaagaggtccaggtgatcgccgttgaacctggtaagaaccccaagaatttccagactatgcccggcaccttccagacaaccactggggagattggagcgatcgccctggattttaagcctggcacctcgggttcaccgataatcaaccgggaggggaaggtggtcggactttacggcaatggcgtggttaccaagaacgggggatatgtgtctggtattgcacaaacgaatgctgaaccagacggccccactcctgagttagaagaggaaatgttcaagaaaagaaacctgaccatcatggatctccacccagggagtggaaagacaaggaaatacttgcccgccattgtccgtgaggctatcaagcgccggctgagaaccctcatactggcacctactagggtggtagccgccgagatggaagaggctcttaagggcctgccgattcgatatcagacaaccgcgacgaaatccgaacatactggtcgggagatcgtggacttgatgtgccacgcaacatttaccatgcgcctactgagccccgttagagtcccaaattacaacctcatcattatggatgaagcccatttcaccgaccctgcttctatcgccgcaagggggtacataagcactcgggtgggaatgggcgaggccgctgcgatttttatgacagccacaccaccaggcacagcagatgctttccctcagtccaatgcccccatccaggacgaggaacgagacattccagagagatcatggaacagtgggaatgaatggatcactgattttgcaggaaagacggtgtggttcgtcccgagcataaaagccggtaacgacattgctaactgtttacgcaagaatggcaaaaaggtaatccaactgtctaggaagacctttgatacagagtatcagaaaactaaacttaacgactgggatttcgtggttaccacagacatctccgagatgggggccaattttaaagcggatcgtgtgattgaccctcggagatgcctgaagcccgtcatcctcaccgatggaccagaaagggtgattttggcaggccccatgcctgttactgccgcttcagccgctcagcgccgaggtagagtggggcggaacccacagaaagagaatgaccaatacatattcacgggccagcccctgaacaatgatgaagaccacgcacattggaccgaggccaagatgctcctggacaacatcaatacacctgaaggaattatcccggctcttttcgagccagagagggaaaagagtgccgcaatcgatggcgagtatcgcctaaaaggggaaagccgtaagacttttgtcgagctgatgagacggggagacttgcccgtgtggttagcgcacaaagtagcctccgaaggtattaagtacaccgataggaaatggtgcttcgacggccagcgcaacaatcagatactggaggagaacatggatgtggaaatctggacaaaggagggggagaaaaagaagctccgacctagatggctggacgctcggacctattctgatccccttgccctgaaagagtttaaggacttcgcagctggaaggaaatcgattgccctcgatttggttactgaaatcggccgcgtcccaagccacctggcacatagaacaaggaatgccctagacaacctggtgatgctccacacgtcagagcatggtgggaaggcttaccggcacgcggtggaggaacttcctgagaccatggaaactctgttattgctgggcctcatgattctgcttacaggaggcgccatgctgtttctcatctccgggaaaggaataggtaagaccagtatcggcttgatttgtgtcatcgcatctagcgggatgctgtggatggctgagattcccttacaatggatcgcctccgccatagttctagagttctttatgatggtgctgctcattccagaacctgagaagcagcgtaccccgcaggataatcaacttgcatatgtagtgatcggcattctgacattggctgccatcatagcggctaacgaaatgggcctgctcgagactacgaaacgcgacctgggtatgtcaaaggaacccggggtcgtgtctccaaccagctaccttgatgttgacctccaccctgccagtgcatggacactgtacgccgtggctactaccgtcatcacacccatgttgcgacataccattgaaaattccactgcaaacgtaagcctggccgcgatcgctaaccaggccgtggttttaatgggcctagacaaaggatggccaatttctaagatggatctgggcgtgcctctccttgcactggggtgctattcacaggtcaatcccttgacgctgacagccgctgtgctcctgcttatcacccactacgccataattggaccgggcttacaggcaaaagctactagagaggcccaaaagaggaccgcggccggtatcatgaagaacccaacagtcgacgggatcatgactattgatctggaccctgtgatctatgattccaaattcgagaagcagctcggacaggttatgttgctggtgctatgtgcagtacagctgctccttatgcggaccagttgggctctgtgcgaggccttgacactggcaacgggccccataaccactctctgggaaggtagcccaggcaaattttggaatacaaccattgctgtgtcgatggccaacatcttccgcgggtcttacctggccggagcgggcttagctttttccattatgaaaagcgtcgggactggaaaaagaggcacaggttcacaaggggagacccttggagaaaagtggaagaaaaagctgaatcagctcagtaggaaagagttcgacctatataagaaatctggcatcacggaggttgatcggaccgaagcaaaggagggtctgaaacgaggcgaaataacacatcacgccgtgtccagagggagcgctaagttgcagtggtttgtcgagcgcaacatggtgatccccgaaggaagggtaattgacctgggctgtgggcggggaggctggtcatactattgcgccggtctcaagaaagtgactgaggttcgtgggtacaccaagggaggccctggccatgaggaaccggtgcccatgagtacatacgggtggaatatcgtcaaacttatgagcggaaaggatgtgttctatctgccacctgagaaatgtgacactttgctgtgcgatattggtgaatcctctcccagccctaccgtcgaggagtccagaacaatcagggtgctcaagatggttgaaccatggttaaagaacaatcagttctgtattaaagtactgaacccctacatgcctaccgtgatcgagcaccttgaacgcctgcaacggaagcacggcgggatgctagtccgaaatccactctcaagaaactctactcatgagatgtattggataagtaatggaacgggcaacattgtggcatcggttaatatggtgagcaggctgttgctgaaccgctttacaatgacccaccggagacccactatcgaaaaagacgtcgatctcggtgccgggacccgtcatgtgaacgctgagccggagacacctaatatggacgtaatcggagaaaggattaagcggataaaagaggaacacaactccacgtggcactacgacgatgagaatccatataagacctgggcgtaccatggctcttatgaagtgaaggccactggctcagcaagctccatgatcaacggggttgtcaaacttctgacaaagccctgggacgtggtgcctatggtcacccagatggctatgactgatacaaccccattcggacagcaacgcgtttttaaagagaaggtggacacacgaactcccagaagtatgccgggtaccaggcgggtaatgggcattacggccgagtggttatggcgcaccctggggagaaataaaaagcctaggttgtgcacacgagaagagttcactaagaaagtgcggaccaacgcagccatgggagctgtctttacagaagagaatcagtgggattctgccaaggcggcagtggaagacgaggatttctggaaactcgttgaccgtgagagagaactgcacaagctaggcaaatgtggtagctgcgtgtacaacatgatggggaagcgcgagaagaaacttggagaatttggcaaagccaaaggctcaagggctatctggtacatgtggctgggggcccggtatctcgagttcgaggcactgggatttttgaatgaagatcattggttctccagagagaacagttacagcggtgtcgaaggcgaggggctgcacaagctcggatatattcttcgcgacatctctaaaatacccggcggtgctatgtacgccgatgacactgctgggtgggacaccaggatcacggaagatgacctgcataatgaggagaagattacacagcagatggatccagaacaccgacaattagccaacgcaatctttaaactgacctatcagaataaggtggtaaaggttcagcggcctactcccacaggaaccgtgatggacattatctccagaaaagatcagaggggctcaggccaagtcgggacttacggattgaacaccttcacaaatatggaggcgcagctcatacgccagatggaaggtgagggcgtgctgagcaaggccgacctagaaaacccacaccttcccgagaaaaagattacgcagtggctggagaccaaaggggtggaacgtctcaagcggatggctatctcgggagatgactgcgtcgttaagcctatcgatgacagatttgccaacgcactgttggctttaaatgatatgggcaaagtgaggaaggacattccacaatggcagccgtctaaaggttggcatgattggcagcaggtacccttctgtagtcaccatttccacgagctgataatgaaggacgggcgcaaactcgtggtcccttgccgaccacaagacgaacttatcggacgggccagaatttcccagggcgcaggctggagcctgagggagactgcctgtctagggaaggcgtatgctcagatgtggtcactgatgtactttcaccgcagagatctccggttggcctccaacgcaatctgctctgccgtgcccgttcattgggtgcctacaagcaggaccacttggagtattcacgctcatcaccaatggatgacaaccgaagacatgctgacggtctggaatcgtgtgtggatcgaggataacccatggatggaggacaagacacccgtaaccacttgggaaaatgttccttaccttggaaaacgagaggatcagtggtgtggttccctgataggcctcaccagccgcgccacatgggcacagaacatcccgactgctattcagcaagtgagatctttaatcgggaatgaagagttcctggactatatgccatcaatgaagcggtttaggaaagaggaagagagtgaaggagccatttggtga

SEQ ID NO: 15554 - RNA, 9873 nt, synthetic construct
  misc_feature 1..9873: note = derived and/or modified CDS sequence (opt3) from DENV-3__EU482613__SS-prME
  source 1..9873: mol_type = other RNA
accagcctgtgcctcatgatgatccttccagccgctctggcattccacttgacatccagagacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgtacaacggaaagcgactagagcccaattgggcatctgtcaagaaggacctgatctcctatggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaagatcgtgggactttacggcaatggcgtcgtgaccaaaaacgggggatatgtttctggtattgcacaaacaaatgctgaaccagacggccccacgcctgagttagaagaggaaatgttcaagaaaagaaacctgactatcatggatctccacccagggagtggaaagaccaggaaatacttgcccgccatagtgcgtgaggctattaagcgccggctgagaacactcatcctggcacctaccagggtcgtggccgccgagatggaagaggctcttaagggcctgccgatccgatatcagactacagcgaccaaatccgaacatacgggtcgggagattgtagacttgatgtgccacgcaacttttacaatgcgcctactgagccccgtgagagttccaaattacaacctcatcataatggatgaagcccatttcaccgaccctgcttctattgccgcaagggggtacatcagcacccgggtcggaatgggcgaggccgctgcgatttttatgactgccacacccccaggcaccgcagatgctttccctcagtccaatgcccccatccaggacgaggaacgagacataccagagagatcatggaacagtgggaatgaatggattacagattttgcaggaaagactgtgtggttcgtgccgagcatcaaagccggtaacgacatcgctaactgtttacgcaagaatggcaaaaaggtcattcaactgtctaggaagacgtttgataccgagtatcagaaaacaaaacttaacgactgggatttcgtagtgactaccgacatctccgagatgggggccaattttaaagcggatcgtgttattgaccctcggagatgcctgaagcccgtgatactcacagatggaccagaaagggtcatcttggcaggccccatgcctgtgaccgccgcttcagccgctcagcgccgaggtagagttgggcggaacccacagaaagagaatgaccaatacattttcactggccagcccctgaacaatgatgaagaccacgcacattggacggaggccaagatgctcctggacaacatcaatacccctgaaggaatcattccggctcttttcgagccagagagggaaaagagtgccgcaatagatggcgagtatcgcctaaaaggggaaagccgtaagacatttgtggagctgatgagacggggagacttgcccgtctggttagcgcacaaagtggcctccgaaggtatcaagtacactgataggaaatggtgcttcgacggccagcgcaacaatcagattctggaggagaacatggatgtagaaatctggaccaaggagggggagaaaaagaagctccgacctagatggctggacgctcggacatattctgatccccttgccctgaaagagtttaaggacttcgcagctggaaggaaatcgattgccctcgatttggtgaccgaaatcggccgcgttccaactcacctggcacatagaacaaggaatgccctagacaacctggtcatgctccacacgagcgagcatggtgggaaggcttaccggcacgcggtggaggaacttcctgagaccatggaaactctgttattgctgggcctcatgatactgcttacaggaggcgccatgctgtttctcatctcagggaaaggaattggtaagacctccatcggcttgatttgtgtgatcgcaagttctgggatgctgtggatggctgagatacccttacaatggattgccagcgccatcgtcctagagttctttatgatggttctgctcattccagaacctgagaagcagcgtaccccgcaggataatcaacttgcatatgtggtaatcggaatactgacattggctgccatcattgcggctaacgaaatgggcctgctcgagactacgaaacgcgacctgggtatgtccaaggaacccggggtggtctcaccaacctcttaccttgatgtggacctccaccctgccagcgcatggacactgtacgccgttgctactaccgtgatcacacccatgttgcgacataccattgagaatagtactgcaaacgtctccctggccgcgatcgctaaccaggccgtagtgttaatgggcctagacaaaggatggccaataagcaagatggatctgggcgttcctctccttgcactggggtgctattctcaggtgaatcccttgacgctgacagccgctgtcctcctgcttattacccactacgccatcatcggaccgggcttacaggcaaaagctactagagaggcccaaaagaggaccgcggccggtattatgaagaacccaacagtggacgggatcatgactatagatctggaccctgtcatttatgattcaaaattcgaaaagcagctcggacaggtgatgttgctggttctatgtgcagtgcagctgctccttatgcggacctcctgggctctgtgcgaggccttgacactggcaacgggccccatcaccactctctgggaaggtagtccaggcaaattttggaatacaaccattgctgtaagcatggccaacatcttccgcgggtcgtacctggccggagcgggcttagctttttctataatgaagtccgtggggactggaaaaagaggcacaggtagccaaggggagacccttggagaaaagtggaagaaaaagctgaatcagctctcaaggaaagagttcgacctatataagaaaagtggcatcacggaggtcgatcggaccgaagcaaaggagggtctgaaacgaggcgaaattacacatcacgccgtttctagagggtccgctaagttgcagtggtttgtggagcgcaacatggtcatccccgaaggaagggtgattgacctgggctgtgggcggggaggctggagctactattgcgccggtctcaagaaagtaactgaggtgcgtgggtacaccaagggaggccctggccatgaggaaccggttcccatgtcaacatacgggtggaatatcgtgaaacttatgagtggaaaggatgtcttctatctgccacctgagaaatgtgacactttgctgtgcgatattggtgaaagctccccctctcctaccgtggaggagagcagaacaatcagggtcctcaagatggtggaaccatggttaaagaacaatcagttctgtataaaagttctgaacccctacatgcctaccgtaattgagcaccttgaacgcctgcaacggaagcacggcgggatgctagtgcgaaatccactctccagaaactcaactcatgagatgtattggatctctaatggaacgggcaacatcgtcgcaagtgtgaatatggtttcgaggctgttgctgaaccgctttacaatgacccaccggagacccactattgaaaaagacgtggatctcggtgccgggacccgtcatgtcaacgctgagccggagacacctaatatggacgtgataggagaaaggatcaagcggattaaagaggaacacaacagcacgtggcactacgacgatgagaatccatataagacctgggcgtaccatggctcctatgaagtaaaggccactggctctgcatcaagcatgatcaacggggtggttaaacttctgacaaagccctgggacgtcgtgcctatggtgacccagatggctatgactgatacaaccccattcggacagcaacgcgtctttaaagagaaggttgacacacgaactcccagatccatgccgggtaccaggcgggtgatgggcattacggccgagtggttatggcgcaccctggggagaaataaaaagcctaggttgtgcacacgagaagagttcactaagaaagtacggaccaacgcagccatgggagctgtgtttacagaagagaatcagtgggatagtgccaaggcggcagtcgaagacgaggatttctggaaactcgtggaccgtgagagagaactgcacaagctaggcaaatgtggttcttgcgtttacaacatgatggggaagcgcgagaagaaacttggagaatttggcaaagccaaaggcagcagggctatctggtacatgtggctgggggcccggtatctcgagttcgaggcactgggatttttgaatgaagatcattggttctcaagagagaactcctacagtggtgtggaaggcgaggggctgcacaagctcggatatatacttcgcgacatcagcaaaattcccggcggtgctatgtacgccgatgacactgctgggtgggacaccaggatcacggaagatgacctgcataatgaggagaagattacacagcagatggatccagaacaccgacaattagccaacgcaatctttaaactgacctatcagaataaggtcgtgaaggtacagcggcctactcccacaggaaccgttatggacataatttctagaaaagatcagaggggctccggccaagtggggacttacggattgaacaccttcacaaatatggaggcgcagctcatccgccagatggaaggtgagggcgtcctgtcaaaggccgacctagaaaacccacaccttcccgagaaaaagatcacgcagtggctggagaccaaaggggtggaacgtctcaagcggatggctattagcggagatgactgcgtggtcaagcctatagatgacagatttgccaacgcactgttggctttaaatgatatgggcaaagttaggaaggacatcccacaatggcagccgtcgaaaggttggcatgattggcaacaggtgcccttctgttctcaccatttccacgagctgattatgaaggacgggcgcaaactcgtagtgccttgccgaccacaagacgaacttatcggacgggccagaattagtcagggcgcaggctggtccctgagggagactgcctgtctagggaaggcgtatgctcagatgtggagcctgatgtactttcaccgcagagatctccggttggcctcaaacgcaatctgctccgccgtccccgtgcattgggttcctacatctaggaccacttggagcatacacgctcatcaccaatggatgacaaccgaagacatgctgacggtgtggaatcgtgtctggatcgaggataacccatggatggaggacaagacacccgtgaccacttgggaaaatgtaccttaccttggaaaacgagaggatcagtggtgtggtagtctgattggcctcacctcccgcgccacatgggcacagaacatcccgactgctattcagcaagttaggagcttaatcgggaatgaagagttcctggactatatgccatctatgaagcggtttaggaaagaggaagagtcagaaggagccatttggtga

SEQ ID NO: 15555 - RNA, 9873 nt, synthetic construct
  misc_feature 1..9873: note = derived and/or modified CDS sequence (opt3) from DENV-3__EU529690__SS-prME
  source 1..9873: mol_type = other RNA
accagcctgtgcctcatgatgatccttcccgccgctctggcattccacttgacctccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacactggttgtgtgatcaattggaaagggaaggagctgaagtgcggatccggcattttcgtgacaaacgaggtccatacctggactgaacagtacaaatttcaagcagattctcccaagcggctagccaccgctatcgccggtgcatgggagaatggcgtttgtgggatacgaagcacaacgcgcatggaaaacctcctgtggaaacagatcgctaatgagcttaactatattttgtgggaaaataacatcaagctgaccgtggtggtaggagacattatcggcgtcctcgagcaggggaaaagaactctgacaccacagcctatggagttaaagtactcatggaaaacctggggaaaggccaagatagtgacagcggaaactcaaaacagttccttcattatcgatggccccaataccccagagtgccccagcgcctctagggcttggaacgtttgggaagtggaggactatggttttggggtcttcacgacaaatatttggctgaaacttcgggaagtgtacacccagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacttgcacctggcctaagtctcatacactgtggtcgaatggtgtcctcgaaagcgatatgatcattccaaaatccctggcgggcccgatctcacagcacaactataggcccgggtaccatactcaaaccgccggaccttggcaccttggcaagttggagctggactttaattattgcgaggggacaacggtggtgattaccgaaaactgtggaactcgtggcccaagtttacggacaaccactgtctctggtaaactcatccacgagtggtgctgtcgaagctgcacactgccccctcttagatacatgggggaagatggatgttggtatggcatggagataaggccaatttccgaaaaggaggagaatatggttaaatcactggtgagcgctggttctggcgaagtagacaacttcaccatgggggtgttgtgcctcgccatcctgtttgaggaagtcatgcgcggaaagttcggcaagaaacatatgatcgcaggggtgttctttacgttcgttctactgctctccggacagattacttggcgggatatggctcacaccctgatcatgattggcagtaatgccagcgacagaatgggtatgggggtgacataccttgcattgatagccacctttaagatccagcccttcctggctttaggatttttcctcaggaaactgacttctcgcgagaaccttctgctaggcgtcggcctcgcgatggccacaaccctgcaattgccggaagatattgagcagatggcaaatgggatcgctctgggattaatggccctcaagctgattacacagtttgagacttatcagctttggaccgccctgatctccttgacgtgttcaaacacaatattcaccctcactgtggcttggcgaaccgcaacactgatcctagccggtgttagtctgcttcctgtgtgccaaagctcgtccatgcggaaaactgactggctcccaatgaccgtcgcggctatgggcgtaccccctctgcccttgtttattttcaatctgaaggatacgttaaagcgtagatcttggccactcaacgaaggggtgatggccgttggactggtgagcatccttgcatcaagtctgttgaggaacgacgtccctatggccggccccctcgtggctggtgggctgctaattgcatgttacgtaatcacaggaacctccgccgatctgactgtggagaaagcggctgacgtcacatgggaagaggaagccgagcagaccggcgtttctcataatcttatgataactgtggacgatgacggcacaatgcgcattaaggatgacgagaccgaaaacatcctcacggtgctgttgaaaactgcattactgatcgtcagcgggatttttccatactccataccggccaccctcctggtgtggcacacatggcagaagcagacccaacggtcaggagttctttgggatgtacctagcccaccagagacacagaaagctgaactggaggagggtgtgtatagaatcaagcagcagggcattttcgggaaaactcaagtcggagtgggcgttcagaaggaaggtgtgtttcataccatgtggcacgtcacgagaggggccgtgttgacatacaatggaaagcgactagagcccaactgggcaagtgtcaagaaggacctgatctcttatggcggcgggtggcgcctctccgctcagtggcaaaaaggagaagaggtccaggtgattgccgttgaacctggtaagaatcccaagaatttccagactatgcccggcaccttccagacaaccactggggagatcggagcgatagccctggattttaagcctggcaccagcggttcgccgatcattaatcgggaggggaaggtggtcggactttacggcaacggcgtggttaccaaaaatgggggatatgtgtcaggtatcgcacaaacgaacgctgaaccagacggccccactcctgagttagaagaggaaatgttcaagaaaagaaatctgaccattatggatctccacccagggtctggaaagacaaggaaatacttgcccgccatcgtccgtgaggctataaagcgccggctgagaaccctcattctggcacctactagggtggtagccgccgagatggaagaggctcttaagggcctgccgatccgatatcagacaaccgcgacgaaaagtgaacatactggtcgggagatcgtggacttgatgtgccacgcaacatttaccatgcgcctactgtcccccgttagagtcccaaactacaatctcattatcatggatgaagcccatttcaccgaccctgctagcatagccgcaagggggtacatttctactcgggtgggaatgggcgaggccgctgcgatctttatgacagccacacccccaggcacagcagatgctttccctcagagcaacgcccccattcaggacgaggaacgagacatcccagagagatcctggaactcagggaacgaatggataactgattttgcaggaaagacggtgtggttcgtcccgagtattaaagccggtaacgacatcgctaattgtttacgcaagaacggcaaaaaggtaatccaactgagcaggaagacctttgatacagagtatcagaaaactaaacttaatgactgggatttcgtggttaccacagacatttctgagatgggggccaactttaaagcggatcgtgtgatcgaccctcggagatgcctgaagcccgtcattctcaccgatggaccagaaagggtgatattggcaggccccatgcctgttactgccgcttccgccgctcagcgccgaggtagagtggggcggaatccacagaaagagaacgaccaatacatcttcacgggccagcccctgaataacgatgaagaccacgcacattggaccgaggccaagatgctcctggacaatattaacacacctgaaggaatcatcccggctcttttcgagccagagagggaaaagtcagccgcaattgatggcgagtatcgcctaaaaggggaaagtcgtaagacttttgtcgagctgatgagacggggagacttgcccgtgtggttagcgcacaaagtagccagcgaaggtataaagtacaccgataggaaatggtgcttcgacggccagcgcaataaccagatcctggaggagaatatggatgtggaaatttggacaaaggagggggagaaaaagaagctccgacctagatggctggacgctcggacctattccgatccccttgccctgaaagagtttaaggacttcgcagctggaaggaaatctatcgccctcgatttggttactgaaattggccgcgtcccaacacacctggcacatagaacgaggaacgccctagacaatctggtgatgctccacacctcggagcatggtgggaaggcttaccggcacgcggtggaggaacttcctgagactatggaaacactgttattgctgggcctcatgatcctgcttaccggaggcgccatgctgtttctcataagcgggaaaggaatcggtaagacctcaattggcttgatctgtgtcattgcatccagtgggatgctgtggatggctgagatccccttacaatggatagcctctgccattgttctagagttctttatgatggtgctgctcatcccagaacctgagaagcagcgtacaccgcaggataaccaacttgcatatgtagtgattggaatcctgactttggctgccataatcgcggctaatgaaatgggcctgctcgagacgaccaaacgcgacctgggtatgagcaaggaacccggggtcgtgtccccaacatcataccttgatgttgacctccaccctgcctctgcatggactctgtacgccgtggctaccacagtcattacccccatgttgcgacatactatcgagaacagcacggcaaacgtaagtctggccgcgattgctaatcaggccgtggttttaatgggcctagacaaaggatggccaatctccaagatggatctgggcgtgcctctccttgcactggggtgctatagccaggtcaaccccttgacactgaccgccgctgtgctcctgcttataactcactacgccattatcggaccgggcttacaggcaaaagctaccagagaggcccaaaagaggacagcggccggtatcatgaagaatccaactgtcgacgggattatgaccatcgatctggaccctgtgatatatgattctaaattcgaaaagcagctcggacaggttatgttgctggtgctatgtgcagtacagctgctccttatgcggacatcatgggctctgtgcgaggccttgacgctggcaaccggccccattactacactctgggaaggttccccaggcaaattttggaacaccactatcgctgtgagtatggccaatattttccgcgggagctacctggccggagcgggcttagctttttcgatcatgaagtctgtcgggacaggaaaaagaggcaccggttcccaaggggagacgcttggagaaaagtggaagaaaaagctgaaccagctcagcaggaaagagttcgacctatataagaaatcaggcataaccgaggttgatcggacagaagcaaaggagggtctgaaacgaggcgaaatcactcatcacgccgtgagtagagggtctgctaagttgcagtggtttgtcgagcgcaatatggtgattcccgaaggaagggtaatcgacctgggctgtgggcggggaggctggtcctactattgcgccggtctcaagaaagtgaccgaggttcgtgggtacacaaagggaggccctggccatgaggaaccggtgcccatgagcacttacgggtggaacattgtcaaacttatgtcaggaaaggatgtgttctatctgccacctgagaaatgtgacaccttgctgtgcgatatcggtgaaagtagcccctcccctacagtcgaggagtctagaaccattagggtgctcaagatggttgaaccatggttaaagaataaccagttctgtatcaaagtactgaatccctacatgcctactgtgatagagcaccttgaacgcctgcaacggaagcacggcgggatgctagtccgaaacccactcagcagaaattccacgcatgagatgtattggatttcaaacggaacaggcaatatcgtggcatctgttaacatggtgagtaggctgttgctgaaccgctttaccatgactcaccggagacccaccatcgaaaaagacgtcgatctcggtgccgggacacgtcatgtgaatgctgagccggagacgcctaacatggacgtaattggagaaaggataaagcggatcaaagaggaacacaattcgacctggcactacgacgatgagaacccatataagacttgggcgtaccatggcagctatgaagtgaaggccacaggctccgcatcttcaatgattaatggggttgtcaaacttctgaccaagccctgggacgtggtgcctatggtcactcagatggctatgacagataccacaccattcggacagcaacgcgtttttaaagagaaggtggacactcgaacccccagaagcatgccgggtacgaggcgggtaatgggcatcaccgccgagtggttatggcgcacactggggagaaacaaaaagcctaggttgtgcactcgagaagagttcaccaagaaagtgcggacaaatgcagccatgggagctgtctttactgaagagaaccagtgggattccgccaaggcggcagtggaagacgaggatttctggaaactcgttgaccgtgagagagaactgcacaagctaggcaaatgtggtagttgcgtgtacaatatgatggggaagcgcgagaagaaacttggagaatttggcaaagccaaaggctctagggctatttggtacatgtggctgggggcccggtatctcgagttcgaggcactgggatttttgaacgaagatcattggttcagcagagaaaattcatactccggtgtcgagggcgaggggctgcacaagctcggatatatccttcgcgacataagtaaaatccccggcggtgctatgtacgccgatgacaccgctgggtgggacacgaggattacagaagatgacctgcataacgaggagaagatcacccagcagatggatccagaacaccgacaattagccaatgcaatttttaaactgacttatcagaacaaggtggtaaaggttcagcggcctacacccaccggaactgtgatggacatcataagcagaaaagatcagaggggctctggccaagtcgggacctacggattgaatacattcacgaacatggaggcgcagctcattcgccagatggaaggtgagggcgtgctgtccaaggccgacctagaaaacccacaccttcccgagaaaaagatcacccagtggctggagactaaaggggtggaacgtctcaagcggatggctatctcaggagatgactgcgtcgttaagcctattgatgacagatttgccaatgcactgttggctttaaacgatatgggcaaagtgaggaaggacataccacaatggcagccgagcaaaggttggcatgattggcagcaggtacccttctgttcgcaccatttccacgagctgatcatgaaggacgggcgcaaactcgtggtcccttgccgaccacaagacgaacttattggacgggccagaatctctcagggcgcaggctggagtctgagggagacagcctgtctagggaaggcgtatgctcagatgtggtccctgatgtactttcaccgcagagatctccggttggccagcaatgcaatttgctcagccgtgcccgttcattgggtgcctacctccaggactacatggtctatccacgctcatcaccaatggatgaccacggaagacatgctgacagtctggaaccgtgtgtggatagaggataatccatggatggaggacaagacccccgtaactacctgggaaaacgttccttaccttggaaaacgagaggatcagtggtgtggtagcctgatcggcctcacaagtcgcgccacttgggcacagaatattccgaccgctatccagcaagtgagatccttaattgggaacgaagagttcctggactatatgccaagcatgaagcggtttaggaaagaggaagagtctgaaggagccatctggtga

SEQ ID NO: 15556 - RNA, 9873 nt, synthetic construct
  misc_feature 1..9873: note = derived and/or modified CDS sequence (opt3) from DENV-3__EU529691__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcattcagggcgtcttataactgcaaacccagttgtgaccaaaaaggaggaacccgtaaatattgaggccgaaccgcctttcggcgagagcaacatcgtcatcggaattggcgataatgctttgaaaatcaactggtataagaaggggagttctattggaaaaatgtttgaagccacagcacgcggtgccagaaggatggctatactgggcgacactgcctgggatttcgggtccgtgggaggcgttctcaatagcctgggtaagatggtgcaccagatctttgggtcggcatacaccgcgcttttctctggcgtctcctgggtgatgaaaattggaatcggcgtactgttgacgtggatcgggctcaactcaaagaatacaagtatgagcttttcctgcattgctgtgggaataatcaccctgtatttaggcgccgttgtccaggcagacatgggttgtgtgattaactggaaagggaaggagctgaagtgcggatctggcatcttcgtgactaatgaggtccatacatggaccgaacagtacaaatttcaagccgatagccccaagcggctagctactgccattgcaggtgcttgggagaacggcgtttgtgggatccgatcaaccacacgcatggaaaatctcctgtggaaacagatagccaacgagcttaattatatcttgtgggaaaacaatattaagctgacggtggtggtaggagacatcattggcgtcctcgagcaggggaaaagaaccctgactccacagcctatggagttaaagtacagttggaaaacatggggaaaggcgaagatcgtgaccgccgaaacacaaaactccagcttcataattgatggccccaacactccagagtgcccctctgcttcaagggcatggaatgtttgggaagtggaggactatggttttggggtcttcaccacgaacatctggctgaaacttcgggaagtgtacacacagttgtgtgaccaccgcctcatgagtgccgctgttaaggatgagagagccgtgcacgcagacatgggatactggattgagagccagaaaaatggctcctggaagctggaaaaagcgtctctaatcgaggtaaagacctgcacttggcctaagtcgcataccctgtggagcaacggtgtcctcgaatccgatatgataatcccaaaatcactggccggcccgattagtcagcacaatcataggcccgggtatcacacacaaactgctggaccttggcaccttggcaagttggagctggactttaactactgcgaggggaccacagtggtgatcacggaaaattgtggaacccgtggcccatctttacggactacaaccgtcagcggtaaactcattcatgagtggtgctgtcgatcctgcactctgccccctcttagatatatgggggaagatggatgttggtacggcatggagatcaggccaatatcagaaaaggaggagaacatggttaaaagcctggtgtctgccggttccggcaaggtagacaatttcacaatgggggtgttgtgcctcgcaattctgtttgaagaggtcatgcgcggaaagttcggcaaaaagcacatgatcgctggggtgttctttaccttcgttctactgctcagtggacagatcacgtggcgggatatggcccatactctgattatgatcggcagcaacgcatctgacagaatgggtatgggggtgacctatcttgccttgattgctacatttaaaatacagcccttcctggcgttaggatttttcctcaggaagctgacctcccgcgaaaatcttctgctaggcgtcggcctcgccatggcaactacactgcaattgccggaggatatcgaacagatggctaacgggattgccctgggattaatggccctcaaactgatcacccagtttgagacataccagctttggactgctctgatttcattgacctgtagtaatacgatgttcacactcaccgtggcatggcgaactgccaccctgatcctagcgggtgttagcctgcttcctgtgtgccaatcgtcctctatgcggaagacagactggctcccaatggctgtcgccgcaatgggcgtaccccctctgcccttgtttatattcagcctgaaggatactttaaaacgtagatcatggccactcaacgagggggtgatggccgttggactggtgagtatccttgcttcctctctgttgaggaatgacgtccctatggcaggccccctcgtggccggtgggctgctaattgcgtgttatgtaatcaccggaacgagcgctgatctgacagtggaaaaggccgcagacattacctgggaggaagaggccgaacagactggcgtctcccacaaccttatgatcacagttgacgatgacggcaccatgcgcataaaagatgacgagactgagaacattctcacagtgctgttgaagaccgctttactgatcgtgtcaggggtctttccatacagcatcccggccacgctcctggtgtggcatacttggcagaaacagacccaacggagtggagttctttgggatgtaccttctcccccagaaacacagaaggcagagctggaagagggtgtgtacagaattaaacagcagggcatattcgggaagacccaagtcggagtgggcgttcagaaggagggtgtgtttcacacaatgtggcacgtcactaggggggctgtgttgacctataatggaaaacgactagaacccaactgggcctccgtaaagaaagacctgatcagctacggcggcgggtggcgcctctcggcgcagtggcaaaagggagaggaagtccaggtgattgccgttgagcctggtaaaaatccaaagaacttccagacgatgcccggcacattccagactaccacaggggaaatcggagcaattgctctggattttaagcctggcacctcaggttctccgatcataaatcgggaggggaaagtggtcggactttatggcaacggcgtggttactaagaatgggggatacgtgagtggtatcgcccaaaccaacgctgagccagacggccccacacctgaattagaggaagagatgttcaaaaagagaaatctgacgattatggatctccatccagggtccggaaaaactaggaagtatttgcccgcaatcgtccgtgaagccattaagcgccggctgagaaccctcatcctggcccctacaagggtggtagctgcggagatggaggaagcacttaaaggcctgccgatacgataccagaccactgccacaaagagcgagcacaccggtcgggaaattgtggacttgatgtgccatgctacgtttactatgcgcctactgtctcccgttagagtcccaaactataatctcatcatcatggatgaggcccacttcacagaccctgcaagcattgccgctagggggtacatctccacccgggtgggaatgggcgaagcggccgcaatatttatgaccgctactcccccaggcacagccgatgcattccctcagtcaaacgcccccattcaggacgaggagcgagacatcccagaaagaagttggaatagcgggaacgagtggattaccgattttgctggaaaaacagtgtggttcgtcccgtctatcaaggccggtaatgacatagcgaactgtttacgcaaaaacggcaagaaggtaattcaactgtccaggaaaacttttgatacggaataccagaagaccaaacttaatgactgggatttcgtggttacaactgacatctcagagatgggggcaaactttaaggccgatcgtgtgatcgaccctcggagatgcctgaaacccgtcattctcaccgatggaccagagagggtgatcttggctggccccatgcctgttacagccgctagtgcagcccagcgccgaggtagagtggggcggaatccacagaaggaaaacgaccaatatattttcaccggccagcccctgaataacgatgaggaccatgctcactggactgaagccaagatgctcctggacaatataaacacgcctgagggaatcattccggcacttttcgaaccagagagggagaaaagcgcggccatcgatggcgaataccgcctaaagggggagtcccgtaaaacctttgtcgaactgatgagacggggagacttgcccgtgtggttagctcacaaggtagcctctgagggtatcaaatatacagataggaagtggtgcttcgacggccagcgcaataaccagattctggaagagaatatggatgtggagatatggactaaagaaggggagaagaagaaactccgacctagatggctggacgcacggacctactcggatccccttgctctgaaggaatttaaagacttcgccgcaggaaggaagagcatcgccctcgatttggttacagagattggccgcgtcccatcacatctggctcacagaaccaggaacgcgctagacaatctggtgatgctccatacttccgaacacggtgggcgggcctatcgtcacgcagtggaggagcttcctgaaacaatggagacgctgttattgctgggcctcatgatcctgcttaccggaggcgctatgctgtttctcattagtgggaaaggaatcggtaagacttctataggcttgatctgtgtcattgccagctccgggatgctgtggatggccgaaatccccttacaatggattgcatcagctatcgttctagagttctttatgatggtgctgctcataccagagcctgaaaagcagcgcacaccgcaggataaccaacttgcctacgtagtgattggaatcctgaccttggcggctattatcgccgcaaatgagatgggcctgctcgaaaccacaaaacgagacctgggtatgtctaaggagcccggggtcgtgagcccaactagttatcttgatgttgacctccatcctgcctccgcttggacgctgtacgcagtggccaccacagtcataactcccatgttgagacacaccatcgaaaacagcacagcgaatgtatctctggctgccattgcaaaccaggccgtggttttaatgggcctagacaaaggatggccaatctcaaagatggatctgggcgtgcctctccttgctctggggtgctactcccaggtcaaccccttgaccctgactgccgcagtgctcctgcttattacgcattatgctatcataggaccgggcttacaggccaaagcgacaagggaggcccaaaagcggaccgcagctggtattatgaagaatccaactgtcgacgggatcatgaccatcgatctggaccctgtgatttacgatagtaaattcgagaagcagctcggacaggttatgttgctggtgctatgtgccgtacagctgctccttatgcgcacaagctgggcactgtgcgaagctttgactctggccaccggccccatcacaacgctctgggagggttcgccaggcaaattttggaacaccactatagccgtgtctatggcgaatattttcagagggtcctatctggctggagcaggcttagcctttagcatcatgaagtcagtcgggacaggaaaaaggggcaccggtagtcaaggggaaactcttggagagaagtggaagaaaaagctgaaccagctctctcggaaagaattcgacctatacaagaaatccggcattacagaggttgatcgaaccgaggctaaggaaggtctgaaaagaggcgagacgacccaccatgccgtgagccgcgggtcagcaaagttgcagtggtttgtcgaaaggaatatggtgatccccgagggacgggtaatagacctgggctgtgggcgtggaggctggagttattactgcgccggtctcaagaaagtgacagaagttagagggtatactaagggaggccctggccacgaggagccggtgcccatgagcacctacgggtggaacatcgtcaaacttatgtccggaaaggatgtgttctacctgccacctgaaaaatgtgacacattgctgtgcgatattggtgagtctagcccctcccctactgtcgaagagtcaaggaccatccgcgtgctcaagatggttgagccatggttaaagaataaccagttctgtattaaagtactgaatccctatatgcctacagtgatcgaacaccttgagcggctgcaacgaaagcatggcgggatgctagtcagaaacccactctctaggaatagtacccacgaaatgtactggatttcgaacggaactggcaatatcgtggctagcgttaacatggtgtcccgcctgttgctgaatcggtttacgatgacacatagacgtcccaccatagagaaagacgtcgatctcggtgcggggactaggcacgtgaacgccgaaccggagacccctaacatggacgtaattggagagcggatcaagcgcatcaaagaagagcacaattctacatggcattatgacgatgaaaacccatacaagacgtgggcatatcacggctcatacgaggtgaaggctaccggcagcgcctccagtatgattaatggggttgtcaaacttctgactaagccctgggacgtggtgcctatggtcacacagatggcaatgaccgatactacaccattcggacagcaacgagtttttaaagaaaaggtggacaccagaacacccaggtctatgccgggtactcggcgcgtaatgggcataaccgccgagtggttatggagaacgctggggaggaacaaaaagcctcgattgtgcacccgggaggaattcacaaagaaagtgcgtactaatgctgccatgggagcggtctttaccgaggaaaaccagtgggatagcgcaaaggccgctgtggaggacgaagatttctggaaactcgttgacagagagcgcgagctgcataagctaggcaaatgtggttcatgcgtgtataatatgatggggaagagggaaaaaaagcttggagagtttggcaaggccaaaggctcccgggcaatctggtacatgtggctgggggctagatacctcgaattcgaggccctgggatttttgaacgaggatcactggttcagtcgcgaaaatagctattctggtgtcgagggcgaagggctgcataagctcggatacattcttagggacatctccaaaattcccggcggtgctatgtatgccgatgacacagcagggtgggacactcgaatcaccgaggatgacctgcacaacgaagagaagataacgcagcagatggatccagagcaccggcaattagcgaatgccatctttaaactgacataccagaacaaggtggtaaaggttcagagacctacccccactggaacagtgatggacattatctcaaggaaagatcagcgcggcagcggccaagtcgggacctatggattgaatactttcaccaacatggaagctcagctcattcgtcagatggagggtgaaggcgtgctgtcgaaggccgacctagagaatccacatcttcccgaaaaaaagatcacacagtggctggagacgaaaggggtggagcggctcaagagaatggcaatatctggagatgactgcgtcgttaagcctattgatgacaggtttgctaacgccctgttggcattaaacgatatgggcaaagtgcgcaaggacatcccacaatggcagccgagtaaaggttggcacgattggcagcaggtacccttctgttcccatcacttccacgaactgatcatgaaggacgggcgaaaactcgtggtcccttgccggccacaagacgagcttattggaagagccaggataagccagggcgcgggctggtcactgcgcgaaaccgcttgtctagggaaggcctacgcacagatgtggtccctgatgtattttcatagacgggatctcaggttggcctctaatgctatctgcagcgccgtgcccgttcactgggtgcctactagtcgtacaacctggtccattcatgcacaccatcaatggatgactacagaggacatgctgaccgtctggaaccgagtgtggatcgaagataatccatggatggaggacaagacgcccgtaacaacctgggagaacgttccttaccttggaaaacgcgaagatcagtggtgtggtagcctgattggcctcacttctagagctacctgggcccagaatatcccgacagcgatacagcaagtgcggtcattaatcgggaacgaggaattcctggactacatgccaagtatgaagaggtttcgcaaagaggaggaatccgagggagctatttggtga

SEQ ID NO: 15557 - RNA, 9873 nt, synthetic construct
  misc_feature 1..9873: note = derived and/or modified CDS sequence (opt3) from DENV-3__EU569689__SS-prME
  source 1..9873: mol_type = other RNA
accagcctgtgcctcatgatgatccttcccgcagctctggcattccacttgacatccagggacggcgagcctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaagcctggggaaaggcgaagatagtgacagccgaaacccaaaacagttccttcattatcgatggccccaatacaccagagtgccccagcgcttctagggcatggaacgtttgggaagtggaggactatggttttggggtcttcactaccaatatttggctgaaacttcgggaagtgtacacgcagttgtgtgaccaccgcctcatgtcagccgctgttaaggatgagagagccgtgcacgcagacatgggatactggatcgagagtcagaaaaacggcagctggaagctggaaaaagcgtccctaatagaggtaaagacatgcacctggcctaagtctcatactctgtggtcgaatggtgtcctcgaaagcgatatgatcattccaaaatccctggccggcccgatctcacagcacaactataggcccgggtaccatacccaaacagctggaccttggcaccttggcaagttggagctggactttaattattgcgaggggactaccgtggtgattacagaaaactgtggaacgcgtggcccaagtttacggaccactacagtctctggtaaactcatccacgagtggtgctgtcgaagctgcaccctgccccctcttagatacatgggggaagatggatgttggtatggcatggagataaggccaatttccgaaaaggaggagaatatggttaaatcactggtgagcgccggttctggcgaagtagacaacttcactatgggggtgttgtgcctcgcaatcctgtttgaggaagtcatgcgcggaaagttcggcaagaaacatatgatcgctggggtgttctttacattcgttctactgctctccggacagattacctggcgggatctggcccacacgcttatcatgattggcagtaatgcaagcgacagaatgggtatgggggtgacttacttggccctgatagctacctttaagatccagcccttcttagcgctcggatttttcctgaggaaacttacatctcgcgagaacctgctactcggcgtcggcctggccatggcaaccactttgcaactgccggaagatattgagcagatggctaatgggatcgccttaggactcatggccctgaaacttattacacagtttgagacctatcagctgtggacagctttgatctccctcacttgttcaaacaccatattcacgctgacagtggcatggcgaaccgccactctaatcctggcgggtgttagtcttctccctgtgtgccaaagctcgtccatgcggaaaaccgactggctgccaatgacagtcgctgccatgggcgtaccccctttgcccctgtttattttctctttaaaggatactctcaagcgtagaagctggccactgaatgaaggggtgatggcagttggacttgtgtcaatcctggccagttccttgctcaggaacgacgtccctatggctggccccctggtggccggtgggctactgattgcctgttacgtaatcaccggaacgtctgcggatcttacagtggagaaagctgccgacgtcacctgggaagaggaagcagagcagactggcgttagccataacctcatgataacagtggacgatgacggcaccatgcgcattaaggatgacgagactgaaaatatcctgacagtgttgttaaaaaccgccctgctcatcgtctccgggatttttccatactcaataccggctacgctgcttgtgtggcacacttggcagaagcagacccaacggagcggagttctgtgggatgtacctagtcccccagagacacagaaagccgaattggaggagggtgtgtatagaatcaagcagcagggcattttcgggaaaacccaagtcggagtgggcgttcagaaggaaggtgtgtttcatacaatgtggcacgtcactagaggggcagtgctaacctacaacggaaagcgactggagcccaattgggcttctgtcaagaaggacctcatctcctatggcggcgggtggcgcctgagcgcccagtggcaaaaaggagaagaggtccaggtgattgcggttgaacctggtaagaaccccaagaatttccagacgatgcccggcacattccagactaccacaggggagatcggagccatagcacttgattttaagcctggcacctcgggttcaccgatcattaaccgggaggggaaggtggtcggattatacggcaatggcgtggttactaaaaacgggggatatgtgtctggtatcgctcaaaccaatgccgaaccagacggccccacacctgagctggaagaggaaatgttcaagaaaagaaacctcacgattatggatttgcacccagggagtggaaagactaggaaatacctgcccgctatcgtccgtgaggcaataaagcgccggctcagaaccctgattcttgcccctacaagggtggtagccgctgagatggaagaggcgctgaagggcttgccgatccgatatcagaccactgcaacaaaatccgaacataccggtcgggagatcgtggacctaatgtgccacgccacgtttactatgcgcctgctcagccccgttagagtcccaaattacaacttaattatcatggatgaagctcatttcacagaccctgcctctatagcagccagggggtacattagcacccgggtgggaatgggcgaggctgcggccatctttatgaccgcaactcccccaggcacagctgatgccttccctcagtccaatgcacccattcaggacgaggaacgagacatcccagagagatcatggaacagtgggaatgaatggataaccgattttgccggaaagacagtgtggttcgtcccgagcattaaagctggtaacgacatcgccaactgtctgcgcaagaatggcaaaaaggtaatccaactttctaggaagacttttgatacggagtatcagaaaaccaagctgaacgactgggatttcgtggttacaactgacatttccgagatgggggcgaattttaaagcagatcgtgtgatcgaccctcggagatgcctcaagcccgtcattttgaccgatggaccagaaagggtgatactggccggccccatgcctgttacagctgcctcagctgcacagcgccgaggtagagtggggcggaacccacagaaagagaatgaccaatacatcttcaccggccagcccctcaacaatgatgaagaccacgcccattggactgaggctaagatgctgcttgacaacattaatacgcctgaaggaatcatcccggccctattcgagccagagagggaaaagagtgcagcgattgatggcgagtatcgcctgaaaggggaaagccgtaagacctttgtcgagttgatgagacggggagacttacccgtgtggctggcccacaaagtagcttccgaaggtataaagtacacagataggaaatggtgcttcgacggccagcgcaacaatcagatcctcgaggagaacatggatgtggaaatttggactaaggagggggagaagaagaagctgcgacctagatggcttgacgcccggacctattctgatcccctggcactcaaagagtttaaggacttcgctgccggaaggaaatcgatcgcattggatctggttacagaaattggccgcgtcccaacccacctagcccatagaactaggaatgctctggacaacctcgtgatgcttcacacaagcgagcatggtgggaaggcgtaccggcacgccgtggaggaactgcctgagacgatggaaaccttattgctgctcggcctgatgatccttctgactggaggcgcaatgctctttttgatatcagggaaaggaatcggtaagacatccattggcctgatctgtgtcattgctagttctgggatgttatggatggccgagatccccctacaatggatagccagcgcaattgttctggagttctttatgatggtgctccttatcccagaacctgagaagcagcgtaccccgcaggataatcaactggcttatgtagtgattggaatcttgaccctggccgcgataatcgctgccaacgaaatgggcctcctggagacaactaaacgcgaccttggtatgtccaaggaacccggggtcgtgtcaccaacgtcttacctcgatgttgacctgcaccctgcaagcgcctggaccttgtacgctgtggcaacaactgtcattacccccatgctgcgacatacaatcgagaatagtaccgccaacgtatccttagcggctattgccaaccaggcagtggttctaatgggcctggacaaaggatggccaatcagcaagatggatctcggcgtgcctcttctggccttggggtgctattctcaggtcaatcccctgactctcacggctgccgtgctgcttttaataacacactacgcaattatcggaccgggcctgcaggctaaagccaccagagaggcgcaaaagaggactgccgcaggtatcatgaagaacccaaccgtcgacgggattatgacaatcgatctcgaccctgtgatatatgattcaaaattcgaaaagcagttgggacaggttatgctgctagtgctgtgtgctgtacagctccttctgatgcggacttcctgggccttgtgcgaggcactgaccctcgctacaggccccattacgaccctgtgggaaggtagtccaggcaaattttggaatactacaatcgccgtgagcatggccaacattttccgcgggtcgtacttagcgggagctggccttgcattttctatcatgaagtccgtcgggaccggaaaaagaggcactggtagccaaggggagacactgggagaaaagtggaagaaaaagctcaatcagctatcaaggaaagagttcgacctgtataagaaaagtggcataaccgaggttgatcggacggaagccaaggagggtttgaaacgaggcgaaatcacccatcacgctgtgtctagagggtccgccaagctgcagtggtttgtcgagcgcaacatggtgattcccgaaggaagggtaatcgacctcggctgtgggcggggaggctggagctactattgcgcaggtcttaagaaagtgacagaggttcgtgggtacactaagggaggccctggccatgaggaaccggtgcccatgtcaacctacgggtggaatattgtcaaactgatgagtggaaaggatgtgttctatttgccacctgagaaatgtgacacactgctctgcgatatcggtgaaagctccccctctcctactgtcgaggagagcagaaccattagggtgttaaagatggttgaaccatggctgaagaacaatcagttctgtatcaaagtacttaacccctacatgcctacagtgatagagcacctggaacgcctacaacggaagcacggcgggatgctcgtccgaaatccactgtccagaaactcaacccatgagatgtattggatttctaatggaactggcaacatcgtggccagtgttaatatggtgtcgaggttgctgctcaaccgctttacgatgacacaccggagacccaccatcgaaaaagacgtcgatcttggtgctgggactcgtcatgtgaacgcggagccggagacccctaatatggacgtaattggagaaaggataaagcggatcaaagaggaacacaacagcacatggcactacgacgatgagaatccatataagacgtgggcctaccatggctcctatgaagtgaaggcaaccggctctgcttcaagcatgattaacggggttgtcaaactgttaactaagccctgggacgtggtgcctatggtcacacagatggccatgaccgatactacaccattcggacagcaacgcgtttttaaagagaaggtggacacccgaacacccagatccatgccgggtactaggcgggtaatgggcatcaccgcagagtggctgtggcgcacgttggggagaaataaaaagcctaggctctgcacccgagaagagttcacaaagaaagtgcggactaacgccgctatgggagccgtctttaccgaagagaatcagtgggatagtgcgaaggcagccgtggaagacgaggatttctggaaactggttgaccgtgagagagaactacacaaacttggcaaatgtggttcttgcgtgtacaacatgatggggaagcgcgagaaaaagctgggagaatttggcaaggctaaaggcagcagggccatttggtacatgtggctcggggcacggtatctggagttcgaggctttgggatttctgaatgaagatcattggttctcaagagagaactcctacagtggtgtcgaaggcgaggggctccacaaacttggatatatcctgcgcgacataagcaaaatccccggcggtgccatgtacgctgatgacacagccgggtgggacactaggattaccgaagatgacttacataatgaggagaagatcacgcagcagatggatccagaacaccgacaactggcaaacgcgatttttaaattgacatatcagaataaggtggtaaaggttcagcggcctacccccactggaacagtgatggacatcatatctagaaaagatcagaggggctccggccaagtcgggacctacggactcaacactttcaccaatatggaggcccagctgattcgccagatggaaggtgagggcgtgctatcaaaggctgaccttgaaaacccacatctgccagagaaaaagatcacacagtggctcgagacgaaaggggtggaacgtctgaagcggatggccatcagcggagatgactgcgtcgttaagcctattgatgacagatttgcaaacgctttgttagccctgaatgatatgggcaaagtgaggaaggacataccacaatggcagccgtcgaaaggttggcacgattggcagcaggtacccttctgttctcaccatttccacgagctcatcatgaaggacgggcgcaaacttgtggtcccttgccgaccacaagacgaactgattggacgggcaagaatcagtcagggcgccggctggtccctaagggagaccgcgtgtctggggaaggcttatgcccagatgtggagcctcatgtactttcaccgcagagatttgcggctggcatcaaacgccatttgctccgctgtgcccgttcattgggtgcctacttctaggacaacctggagcatccacgcccatcaccaatggatgactacagaagacatgcttaccgtctggaatcgtgtgtggatagaggataacccatggatggaggacaagacgcccgtaacaacctgggaaaatgttccttacctgggaaaacgagaggatcagtggtgtggtagtctcatcggcttaacttcccgcgcaacctgggctcagaacattccgacagccatccagcaagtgagaagcctgattgggaatgaagagttcttggactatatgccatctatgaagcggtttaggaaagaggaagagtcagaaggagcgatctggtga

SEQ ID NO: 15558 - RNA, 9873 nt, synthetic construct
  misc_feature 1..9873: note = derived and/or modified CDS sequence (opt3) from DENV-3__EU482614__SS-prME
  source 1..9873: mol_type = other RNA
accagcctgtgcctcatgatgatccttccagccgctctggcattccacttgacttccagggacggcgaacctaggatgattgtggggaagaacgaacggggaaaatctttactgtttaagactgcctcaggtataaatatgtgtacgctaatcgcgatggatctcggcgagatgtgcgacgataccgtaacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgttccctgtaaaatccctttctccacagaggacggccaaggtaaggctcataacgggcgtcttataactgcgaatccagtggtaaccaaaaaggaggaacccgtcaacattgaggcagaaccgcctttcggcgagtcaaatatcgtgatcggaattggcgataacgccttgaaaatcaattggtataagaaggggagcagtattggaaaaatgtttgaagctacagcccgcggtgcaagaaggatggccatactgggcgacactgcttgggatttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgacatgggttgtgtgatcaattggaaagggaaggagctgaagtgcggatccggcattttcgtgactaacgaggtccatacatggaccgaacagtacaaatttcaagcagattctcccaagcggctagccactgctatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacattatcggcgtcctcgagcaggggaaaagaaccctgactccacagcctatggagttaaagtactcatggaaaacatggggaaaggccaagatagtgaccgcggaaacacaaaacagttccttcattatcgatggccccaatactccagagtgccccagcgcctctagggcttggaacgtttgggaagtggaggactatggttttggggtcttcaccacgaatatttggctgaaacttcgggaagtgtacacacagttgtgtgaccaccgcctcatgtcagcagccgttaaggatgagagagctgtgcacgccgacatgggatactggatcgagagtcagaaaaacggcagctggaagctggaaaaagcatccctaatagaggtaaagacctgcacttggcctaagtctcataccctgtggtcgaatggtgtcctcgaaagcgatatgatcattccaaaatccctggcgggcccgatctcacagcacaactataggcccgggtaccatacacaaactgccggaccttggcaccttggcaagttggagctggactttaattattgcgaggggaccacagtggtgattacggaaaactgtggaacccgtggcccaagtttacggactacaaccgtctctggtaaactcatccacgagtggtgctgtcgaagctgcactctgccccctcttagatacatgggggaagatggatgttggtatggcatggagataaggccaatttccgaaaaggaggagaatatggttaaatcactggtgagcgctggttctggcgaagtagacaacttcacaatgggggtgttgtgcctcgccatcctgtttgaggaagtcatgcgcggaaagttcggcaagaaacatatgatcgcaggggtgttctttaccttcgttctactgctctccggacagattacgtggcgggatatggctcacactctgatcatgattggcagtaatgccagcgacagaatgggtatgggggtgacctaccttgcattgatagccacatttaagatccagcccttcctggctttaggatttttcctcaggaaactgacctctcgcgagaaccttctgctaggcgtcggcctcgcgatggccactacactgcaattgccggaagatattgagcagatggcaaatgggatcgctctgggattaatggccctcaagctgattacccagtttgagacatatcagctttggactgccctgatctccttgacctgttcaaacacgatattcacactcaccgtggcttggcgaactgcaaccctgatcctagccggtgttagtctgcttcctgtgtgccaaagctcgtccatgcggaaaacagactggctcccaatgactgtcgcggctatgggcgtaccccctctgcccttgtttattttctctctgaaggataccttaaagcgtagaagctggccactcaatgaaggggtgatggccgttggactggtgtcaatccttgcaagttccctgttgaggaacgacgtccctatggccggccccctcgtggctggtgggctgctaattgcatgttacgtaatcacgggaacatctgccgatctgaccgtggagaaagcggctgacgtcacttgggaagaggaagccgagcagacaggcgttagccataaccttatgataaccgtggacgatgacggcactatgcgcattaaggatgacgagacagaaaatatcctcaccgtgctgttgaaaacggcattactgatcgtctccgggatttttccatactcaataccggccactctcctggtgtggcacacctggcagaagcagacacaacggagcggagttctttgggatgtacctagtcccccagagacccagaaagctgaactggaggagggtgtgtatagaatcaagcagcagggcattttcgggaaaacacaagtcggagtgggcgttcagaaggaaggtgtgtttcatactatgtggcacgtcaccagaggggccgtgttgacgcacaacggaaagcgactagagcccaattgggcatctgtcaagaaggacctgatctcctacggcggcgggtggcgcctcagcgctcagtggcaaaaaggagaagaggtccaggtgattgccgttgaacctggtaagaaccccaagaatttccagacaatgcccggcactttccagaccacaaccggggagatcggagcgatagccctggattttaagcctggcacttcgggttcaccgatcattaaccgggaggggaaggtggtcggactttatggcaatggcgtggttaccaaaaacgggggatacgtgtctggtatcgcacaaacaaatgctgaaccagacggccccacgcctgagttagaagaggaaatgttcaagaaaagaaacctgactattatggatctccatccagggagtggaaagaccaggaaatatttgcccgccatcgtccgtgaggctataaagcgccggctgagaacactcattctggcacctaccagggtggtagccgccgagatggaagaggctcttaagggcctgccgatccgataccagactacagcgaccaaatccgaacacacgggtcgggagatcgtggacttgatgtgccatgcaacttttacaatgcgcctactgagccccgttagagtcccaaattataacctcattatcatggatgaagcccacttcaccgaccctgcttctatagccgcaagggggtacattagcacccgggtgggaatgggcgaggccgctgcgatctttatgactgccacacccccaggcaccgcagatgctttccctcagtccaatgcccccattcaggacgaggaacgagacatcccagagagatcatggaacagtgggaatgaatggataacagattttgcaggaaagactgtgtggttcgtcccgagcattaaagccggtaacgacatcgctaactgtttacgcaagaatggcaaaaaggtaatccaactgtctaggaagacgtttgataccgagtaccagaaaacaaaacttaacgactgggatttcgtggttactaccgacatttccgagatgggggccaattttaaagcggatcgtgtgatcgaccctcggagatgcctgaagcccgtcattctcacagatggaccagaaagggtgatattggcaggccccatgcctgttaccgccgcttcagccgctcagcgccgaggtagagtggggcggaacccacagaaagagaatgaccaatatatcttcactggccagcccctgaacaatgatgaagaccatgcacactggacggaggccaagatgctcctggacaacattaatacccctgaaggaatcatcccggctcttttcgagccagagagggaaaagagtgccgcaattgatggcgagtaccgcctaaaaggggaaagccgtaagacatttgtcgagctgatgagacggggagacttgcccgtgtggttagcgcacaaagtagcctccgaaggtataaagtatactgataggaaatggtgcttcgacggccagcgcaacaatcagatcctggaggagaacatggatgtggaaatttggaccaaggagggggagaagaagaagctccgacctagatggctggacgctcggacatactctgatccccttgccctgaaagagtttaaggacttcgcagctggaaggaaatcgatcgccctcgatttggttaccgaaattggccgcgtcccaagccatctggcacacagaactaggaatgccctagacaacctggtgatgctccatacatcagagcacggtgggaaggcttatcggcacgcggtggaggaacttcctgagacgatggaaaccctgttattgctgggcctcatgatcctgcttactggaggcgccatgctgtttctcatatccgggaaaggaatcggtaagacaagtattggcttgatctgtgtcattgcatctagcgggatgctgtggatggctgagatccccttacaatggatagcctccgccattgttctagagttctttatgatggtgctgctcatcccagaacctgagaagcagcgtaccccgcaggataatcaacttgcatacgtagtgattggaatcctgaccttggctgccataatcgcggctaacgaaatgggcctgctcgagacaactaaacgcgacctgggtatgtcaaaggaacccggggtcgtgtctccaacgagctatcttgatgttgacctccatcctgccagtgcatggaccctgtacgccgtggctacaactgtcattacccccatgttgcgacacacaatcgaaaattccaccgcaaacgtaagcctggccgcgattgctaaccaggccgtggttttaatgggcctagacaaaggatggccaatctctaagatggatctgggcgtgcctctccttgcactggggtgctactcacaggtcaatcccttgactctgacggccgctgtgctcctgcttataacacattatgccattatcggaccgggcttacaggcaaaagctaccagagaggcccaaaagaggactgcggccggtatcatgaagaacccaaccgtcgacgggattatgacaatcgatctggaccctgtgatatacgattccaaattcgagaagcagctcggacaggttatgttgctggtgctatgtgcagtacagctgctccttatgcggacaagttgggctctgtgcgaggccttgaccctggcaacaggccccattacgaccctctgggaaggtagcccaggcaaattttggaatactacaatcgctgtgtcgatggccaacattttccgcgggtcttatctggccggagcgggcttagctttttccatcatgaaaagcgtcgggaccggaaaaagaggcactggttcacaaggggagacacttggagaaaagtggaagaaaaagctgaatcagctcagtaggaaagagttcgacctatacaagaaatctggcataaccgaggttgatcggacggaagcaaaggagggtctgaaacgaggcgaaatcacccaccatgccgtgtccagagggagcgctaagttgcagtggtttgtcgagcgcaacatggtgattcccgaaggaagggtaatcgacctgggctgtgggcggggaggctggtcatattactgcgccggtctcaagaaagtgacagaggttcgtgggtatactaagggaggccctggccacgaggaaccggtgcccatgagtacctacgggtggaatattgtcaaacttatgagcggaaaggatgtgttctacctgccacctgagaaatgtgacacattgctgtgcgatatcggtgaatcctctcccagccctactgtcgaggagtccagaaccattagggtgctcaagatggttgaaccatggttaaagaacaatcagttctgtatcaaagtactgaacccctatatgcctacagtgatagagcaccttgaacgcctgcaacggaagcatggcgggatgctagtccgaaatccactctcaagaaactctacccacgagatgtactggattagtaatggaactggcaacatcgtggcatcggttaatatggtgagcaggctgttgctgaaccgctttacgatgacacatcggagacccaccatcgaaaaagacgtcgatctcggtgccgggactcgtcacgtgaacgctgagccggagacccctaatatggacgtaattggagaaaggataaagcggatcaaagaggaacacaactccacatggcattatgacgatgagaatccatacaagacgtgggcgtatcacggctcttacgaagtgaaggccaccggctcagcaagctccatgattaacggggttgtcaaacttctgactaagccctgggacgtggtgcctatggtcacacagatggctatgaccgatactacaccattcggacagcaacgcgtttttaaagagaaggtggacacccgaacacccagaagtatgccgggtactaggcgggtaatgggcatcaccgccgagtggttatggcgcacgctggggagaaataaaaagcctaggttgtgcacccgagaagagttcacaaagaaagtgcggactaacgcagccatgggagctgtctttaccgaagagaatcagtgggattctgccaaggcggcagtggaagacgaggatttctggaaactcgttgaccgtgagagagaactgcataagctaggcaaatgtggtagctgcgtgtataacatgatggggaagcgcgagaagaaacttggagaatttggcaaagccaaaggctcaagggctatttggtacatgtggctgggggcccggtacctcgagttcgaggcactgggatttttgaatgaagatcactggttctccagagagaacagttatagcggtgtcgaaggcgaggggctgcataagctcggatacatccttcgcgacatatctaaaatccccggcggtgctatgtatgccgatgacacagctgggtgggacactaggattaccgaagatgacctgcacaatgaggagaagatcacgcagcagatggatccagaacaccgacaattagccaacgcaatttttaaactgacataccagaataaggtggtaaaggttcagcggcctacccccactggaacagtgatggacatcatatccagaaaagatcagaggggctcaggccaagtcgggacctatggattgaacactttcaccaatatggaggcgcagctcattcgccagatggaaggtgagggcgtgctgagcaaggccgacctagaaaacccacatcttcccgagaaaaagatcacacagtggctggagacgaaaggggtggaacgtctcaagcggatggctatctcgggagatgactgcgtcgttaagcctattgatgacagatttgccaacgcactgttggctttaaatgatatgggcaaagtgaggaaggacataccacaatggcagccgtctaaaggttggcacgattggcagcaggtacccttctgtagtcatcacttccacgagctgatcatgaaggacgggcgcaaactcgtggtcccttgccgaccacaagacgaacttattggacgggccagaatctcccagggcgcaggctggagcctgagggagaccgcctgtctagggaaggcgtacgctcagatgtggtcactgatgtattttcatcgcagagatctccggttggcctccaacgcaatttgctctgccgtgcccgttcactgggtgcctactagcaggacaacctggagtatccatgctcaccatcaatggatgactacagaagacatgctgaccgtctggaatcgtgtgtggatagaggataacccatggatggaggacaagacgcccgtaacaacctgggaaaatgttccttaccttggaaaacgagaggatcagtggtgtggttccctgatcggcctcactagccgcgccacctgggcacagaacattccgacagctatccagcaagtgagatctttaattgggaatgaagagttcctggactacatgccatcaatgaagcggtttaggaaagaggaagagagtgaaggagccatctggtga

SEQ ID NO: 15559 - RNA, 9873 nt, synthetic construct
  misc_feature 1..9873: note = derived and/or modified CDS sequence (opt3) from DENV-3__EU569690__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggtccaggaaagagcttctggtaacctttaagaatgcacacgctaaaaagcaagaagttgtggtcttgggctcacaggagggagccatgcacactgctctcacaggcgccaccgaaattcagaacagtgggggaacaagcatattcgcaggtcatctgaagtgtcggttaaaaatggacaagctggagctaaaaggcatgtcttacgccatgtgcactaatacctttgtgctcaagaaagaggtctccgaaacgcagcacgggaccatcctgattaaggtggagtacaagggagaagatgttccctgtaaaatccctttctcaacagaggacgagcaaggcaaggctcataacggtcgtcttataactgcgaacccagtggtaaccaaaaaggaagagcccgtcaatattgaagcagagccgcctttcggggaaagcaacatcgtgatcggcattggagataatgccttgaaaatcaactggtataagaagggcagttctattgggaaaatgtttgaggctacagcccgcggagcaagaaggatggccatactgggtgacactgcttgggatttcggctccgttgggggagtgctcaatagcctgggcaagatggtccaccagatctttggttcggcctacaccgcacttttctctggggtgtcctgggtaatgaaaattggcatcggagtgctgttgacgtggatcggcctcaactcaaagaatacaagtatgagcttttcctgcattgcgatagggatcattaccctgtatttaggagctgttgtccaggccgacatgggctgtgtgatcaactggaaaggtaaggagctgaagtgcgggtctggaattttcgtgactaatgaagtccatacatggaccgagcagtacaaatttcaagcagatagccccaagcggctagccactgctatcgccggcgcatgggaaaacggtgtttgtggcatacgatcaaccacacgcatggagaatctcctgtggaaacagatcgctaacgaacttaattatattttgtgggagaacaatatcaagctgacggtggtggtaggggacattatcggagtcctcgagcagggcaaaagaaccctgataccacagcctatggaattaaagtacagttggaaaacttgggggaaggccaagattgtgacagcggagacccaaaactccagcttcatcattgatggacccaacacaccagaatgcccctctgcctcaagggcttggaatgtttgggaggtggaagactatggctttggtgtcttcactaccaacatctggctgaaacttcgggaggtgtacacgcagttgtgtgaccaccgcctcatgagtgcagccgttaaggatgagagagctgtgcacgccgacatggggtactggatagaaagccagaaaaatggatcctggaagctggagaaagcatctctaatcgaagtaaagacatgcacctggcctaagtcgcatactctgtggagcaacggcgtcctcgagtccgatatgattatcccaaaatcactggcgggtccgattagtcagcacaattataggcccggctaccatacccaaacagccgggccttggcaccttggaaagttggagctggactttaactattgcgaaggcactaccgtggtgatcacagagaattgtgggacgcgtggaccatctttacggaccactacagtcagcggcaaactcatacacgaatggtgctgtcgatcctgcaccctgccccctcttagatacatgggtgaggatgggtgttggtatggaatggaaattaggccaatctcagagaaggaggaaaacatggttaaaagcctggtgtctgctggctccggtgaggtagacaatttcactatgggcgtgttgtgcctcgccatcctgtttgaagaggtcatgcgcgggaagttcggaaagaaacatatgattgcaggcgtgttctttacattcgttctactgctcagtgggcagatcacctggcgggatatggctcacacgctgattatgataggaagcaacgcctctgacagaatgggcatgggtgtgacttaccttgcattgatcgccacctttaagattcagcccttcctggctttagggtttttcctcaggaaactgacatcccgcgaaaatcttctgctaggagtcggcctcgcgatggccaccactctgcaattgccggaggatatcgagcagatggcaaacggcattgctctggggttaatggccctcaagctgatcacacagtttgaaacctatcagctttggacagccctgatatcattgacttgtagtaataccatcttcacgctcacagtggcttggcgaaccgcaactctgattctagccggagttagcctgcttcctgtgtgccaatcgtcctctatgcggaaaaccgactggctcccaatgacagtcgcggctatgggtgtaccccctctgcccttgtttatcttcagcctgaaggatactttaaagcgtagatcatggccactcaacgagggcgtgatggccgttgggctggtgagtattcttgcatcctctctgttgaggaatgacgtccctatggccggacccctcgtggctggcggtctgctaatcgcatgttacgtaataaccgggacgagcgccgatctgacagtggaaaaagcggctgacgtcacctgggaggaagaggccgagcagactggagtttcccataaccttatgattacagtggacgatgacggcaccatgcgcatcaaggatgacgaaactgagaacatcctcacagtgctgttgaaaaccgcattactgattgtctcaggcatatttccatacagcatcccggccacgctcctggtgtggcacacttggcagaagcagacccaacggagtggggttctttgggatgtaccttctcccccagaaacacagaaagctgagctggaggaaggagtgtatagaattaagcagcagggtatcttcggcaaaacccaagtcggggtgggagttcagaaggagggcgtgtttcatacaatgtggcacgtcactaggggtgccgtgttgacctacaatgggaagcgactagaacccaactgggcatccgtaaaaaaggacctgattagctatggaggcggctggcgcctctcggctcagtggcaaaaaggggaggaagtccaggtgatcgccgttgagcctggaaagaatccaaaaaacttccagacgatgcccggtacattccagactaccacaggcgagataggggcgatcgccctggattttaagcctggaacctcaggctctccgattatcaatcgggaaggtaaggtggtcgggctttacggaaacggcgtggttactaaaaatggcgggtatgtgagtggaattgcacaaaccaacgctgagccagacggtcccacacctgaattagaggaagagatgttcaagaaaagaaatctgacgatcatggatctccacccaggctccgggaagactaggaaatacttgcccgccatagtccgtgaggctattaagcgccggctgagaaccctcatcctggcacctacaagggtggtagccgccgaaatggaggaagctcttaagggactgccgatccgatatcagaccactgcgacaaaaagcgagcataccggccgggaaattgtggacttgatgtgccacgcaacgtttactatgcgcctactgtctcccgttagagtcccaaactacaatctcatcataatggatgaggcccatttcacagaccctgctagcattgccgcaaggggttacatctccacccgggtggggatgggagaggccgctgcgatttttatgaccgccactcccccaggcacagcagatgctttccctcagtcaaacgcccccatccaggacgaagagcgagacataccagaaagaagttggaatagcggcaacgagtggattaccgattttgcagggaagacagtgtggttcgtcccgtctatcaaagccggaaatgacatcgctaactgtttacgcaagaacggtaaaaaggtaattcaactgtccaggaagacttttgatacggagtatcagaaaaccaagcttaatgactgggatttcgtggttacaactgacatctcagaaatgggcgccaactttaaagcggatcgtgtgattgaccctcggagatgcctgaagcccgtcatactcaccgatgggccagagagggtgatcttggcaggacccatgcctgttacagccgctagtgccgctcagcgccgaggcagagtgggtcggaatccacagaaagaaaacgaccaatacattttcaccgggcagcccctgaataacgatgaggaccacgcacattggactgaagccaagatgctcctggacaatatcaacacgcctgagggcatcattccggctcttttcgagccagaaagggagaagagcgccgcaatagatggagaatatcgcctaaaaggcgagtcccgtaagacctttgtcgaactgatgagacggggggacttgcccgtgtggttagcgcacaaagtagcctctgagggaatcaagtacacagataggaaatggtgcttcgacggtcagcgcaataaccagattctggaggaaaatatggatgtggagatctggactaaggaaggcgagaaaaagaagctccgacctagatggctggacgctcggacctattcggatccccttgccctgaaagaatttaaggacttcgcagctgggaggaaaagcattgccctcgatttggttacagagatcggacgcgtcccaacccacctggcacatagaactaggaacgccctagacaatctggtgatgctccacacatcagagcatggcggtaaggcttaccggcacgcggtggaagagcttcctgaaacgatggagaccctgttattgctggggctcatgatactgcttactggcggagccatgctgtttctcatctccggcaaagggattggaaagacaagtatcggtttgatttgtgtcatcgcatctagcggcatgctgtggatggctgagatacccttacaatggattgcctccgccatcgttctagaattctttatgatggtgctgctcattccagagcctgaaaagcagcgtaccccgcaggataaccaacttgcatatgtagtgatcgggatactgaccttggctgccatcattgcggctaatgagatgggactgctcgaaacaactaaacgcgacctgggcatgtcaaaggagcccggtgtcgtgtctccaacgagctaccttgatgttgacctccaccctgccagtgcatggaccctgtacgccgtggctacaactgtcatcacccccatgttgcgacatacaattgagaactccaccgcaaatgtaagcctggccgcgatcgctaaccaggccgtggttttaatggggctagacaaaggctggccaatatctaagatggatctgggagtgcctctccttgcactgggctgctattcacaggtcaaccccttgactctgacggccgctgtgctcctgcttattacacactacgccatcatcgggccgggattacaggcaaaagctaccagagaagcccaaaagaggactgcggccggcattatgaagaatccaaccgtcgacggtatcatgacaatagatctggaccctgtgatttatgattccaaattcgagaagcagctcgggcaggttatgttgctggtgctatgtgcagtacagctgctccttatgcggactagttgggctctgtgcgaagccttgaccctggcaacaggacccatcacgaccctctgggagggcagcccaggtaaattttggaacactacaattgctgtgtcgatggccaatatcttccgcggctcttacctggccggggcgggattagctttttccataatgaagagcgtcggcaccgggaaaagaggaactggctcacaaggtgaaacacttggggagaagtggaagaaaaagctgaaccagctcagtaggaaagagttcgacctatataagaaatctggaatcaccgaagttgatcggacggaggcaaaggaaggcctgaaacgaggtgagattacccatcacgccgtgtccagaggcagcgctaagttgcagtggtttgtcgaacgcaatatggtgatccccgaggggagggtaattgacctgggatgtggccgggggggatggtcatactattgcgccggcctcaagaaagtgacagaggttcgtggttacactaaggggggacctggccatgaagagccggtgcccatgagtacctacggctggaacatcgtcaaacttatgagcgggaaggatgtgttctatctgccacctgaaaaatgtgacacattgctgtgcgatattggagagtcctctcccagccctactgtcgaggaatccagaaccatcagggtgctcaagatggttgagccatggttaaagaataaccagttctgtataaaagtactgaatccctacatgcctacagtgattgaacaccttgagcgcctgcaacggaagcacggtggcatgctagtccgaaacccactctcaagaaattctacccatgaaatgtattggatcagtaacgggactggaaatatcgtggcatcggttaacatggtgagcaggctgttgctgaatcgctttacgatgacacaccggagacccaccattgagaaagacgtcgatctcggcgccggtactcgtcatgtgaacgctgagccggaaacccctaacatggacgtaataggggagaggatcaagcggattaaagaagagcacaattccacatggcactacgacgatgaaaacccatataagacgtgggcgtaccatggatcttatgaggtgaaggccaccggctcagcaagctccatgatcaatggcgttgtcaaacttctgactaagccctgggacgtggtgcctatggtcacacagatggctatgaccgatactacaccattcgggcagcaacgcgtttttaaagagaaggtggacacccgaacacccagaagtatgccgggaactaggcgggtaatgggtattaccgccgaatggttatggcgcacgctgggcagaaacaaaaagcctaggttgtgcacccgagaggaattcacaaagaaagtgcggactaatgcagccatgggggctgtctttaccgaggaaaaccagtgggattctgccaaggcggcagtggaggacgaggatttctggaaactcgttgaccgtgaaagagagctgcacaagctaggaaaatgtggcagctgcgtgtacaatatgatgggtaagcgcgaaaaaaagcttggggagtttggaaaggccaaaggctcaagggctatctggtacatgtggctgggcgcccggtatctcgagttcgaagcactggggtttttgaacgaggatcattggttctccagagaaaatagttacagcggagtcgagggtgaaggcctgcacaagctcgggtatatacttcgcgacatctctaaaattcccggaggcgctatgtacgccgatgacacagctggttgggacactaggatcaccgaggatgacctgcataacgaggaaaagattacgcagcagatggatccagagcaccgacaattagccaatgcaatctttaaactgacatatcagaacaaggtggtaaaggttcagcggcctacccccactgggacagtgatggacataatttccagaaaagatcagaggggatcaggccaagtcggcacctacgggttgaatactttcaccaacatggaagcgcagctcatccgccagatggagggagaaggtgtgctgagcaaggccgacctagagaatccacaccttcccgagaaaaagatcacacagtggctggaaacgaaaggcgtggagcgtctcaagcggatggctatttcgggggatgactgcgtcgttaagcctatagatgacagatttgccaacgcactgttggctttaaacgatatgggaaaagtgaggaaggacatcccacaatggcagccgtctaaaggctggcatgattggcagcaggtacccttctgtagtcaccatttccacgaactgattatgaaggacggtcgcaaactcgtggtcccttgccgaccacaagacgagcttatcgggcgggccagaatttcccagggagcaggctggagcctgagggaaaccgcctgtctaggcaaggcgtatgctcagatgtggtcactgatgtactttcaccgcagagatctccggttggcctccaatgcaatctgctctgccgtgcccgttcattgggtgcctactagcaggacaacctggagtatacacgctcatcaccaatggatgactacagaggacatgctgaccgtctggaaccgtgtgtggatcgaggataatccatggatggaagacaagacgcccgtaacaacctgggagaacgttccttaccttgggaaacgagaagatcagtggtgtggatccctgattggtctcactagccgcgccacctgggcacagaatatcccgacagctattcagcaagtgagatctttaatcggcaacgaggagttcctggactatatgccatcaatgaagcggtttaggaaagaagaggaaagtgagggggccatttggtga

SEQ ID NO: 15560 - RNA, 9873 nt, synthetic construct
  misc_feature 1..9873: note = derived and/or modified CDS sequence (opt3) from DENV-3__EU569691__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtacgaatatgtgtaccctaatagcgatggatctcggcgagatgtgcgacgatacagtcacttacaaatgtccacatatcaccgaagttgagccggaagacattgattgctggtgtaacctgacaagtacctgggtgacttatgggacatgcaatcaggctggagagcaccgccgagacaagcgtagcgtagcccttgcaccccatgtgggcatgggtctggataccagaacgcaaacttggatgtccgccgagggggcttggaggcaggtcgaaaaagtggagacctgggcattgcggcaccctggattcacaatcctcgccctgtttctggctcattacattggcacttctctcacccagaaggttgtgatcttcatattactgatgcttgtcacaccatcgatgaccatgcgctgtgtgggcgtagggaacagagactttgttgaaggattgtcaggtgccacgtgggtggatgtcgtgctggagcacggcgggtgcgtgactacaatggcgaagaataaacccaccctagacatcgagctccagaagactgaagcaacacaactggccacccttaggaaactgtgtattgagggaaagatcacgaacattaccacagatagccggtgccctactcagggcgaagctgtcttgccagaggaacaggaccagaattatgtttgtaaacacacctacgtggatcgcggttgggggaacggatgcggcctcttcggcaaggggagtctggtaacatgcgccaagtttcaatgtttagagcccatcgagggaaaagtggtccagtatgaaaatctgaagtacactgtgataattaccgttcatacaggtgaccagcaccaggtgggcaacgagacccaaggggtcactgcagaaatcacgcctcaggcttccacaaccgaggccattctcccagaatatggaactcttggcctggagtgctctccgcgaaccggtttggacttcaatgagatgatcctactgacaatgaaaaacaaggcgtggatggtgcatagacagtggtttttcgatctccccctgccttggaccagcggggccactacagaaacgccaacctggaataggaaagagcttctggtaacttttaagaacgcacacgctaaaaagcaagaagttgtggtcttgggctcccaggagggagccatgcacacagctctcaccggcgccacagaaatccagaattcagggggaactagtattttcgcaggtcatctgaagtgtcggttaaaaatggacaagctggagctaaaaggcatgagctacgccatgtgcaccaacacgtttgtgctcaagaaagaggtctctgaaacccagcacgggacaatactgatcaaggtggagtacaagggagaagatgttccctgtaaaattcctttctccactgaggacggccaaggtaaggctcataacgggcgtcttatcaccgcgaatccagtggtaacaaaaaaggaggaacccgtcaacatagaggcagaaccgcctttcggcgagtcaaatattgtgatcggaatcggcgataacgccttgaaaattaattggtataagaaggggagcagtatcggaaaaatgtttgaagctactgcccgcggtgcaagaaggatggccattctgggcgacaccgcttgggatttcgggtctgttggaggcgtgctcaactccctgggtaagatggtccaccagatatttgggagcgcctacacggcacttttctcgggcgtgtcttgggtaatgaaaatcggaattggcgtgctgttgacatggatcgggctcaattccaagaacacctcaatgagttttagctgcatcgcgattggaataatcactctgtatttaggcgctgttgtccaggccgacatgggttgtgtgattaattggaaagggaaggagctgaagtgcggatccggcatcttcgtgacaaacgaggtccatacctggactgaacagtacaaatttcaagcagattctcccaagcggctagccaccgctattgccggtgcatgggagaatggcgtttgtgggatccgaagcacaacgcgcatggaaaacctcctgtggaaacagatagctaatgagcttaactatatcttgtgggaaaataacattaagctgaccgtggtggtaggagacatcattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagttgtgtgaccaccgcctcatgtcagcagccgttaaggatgagagagctgtgcacgccgacatgggatactggattgagagtcagaaaaacggcagctggaagctggaaaaagcatccctaatcgaggtaaagacttgcacctggcctaagtctcatacactgtggtcgaatggtgtcctcgaaagcgatatgataatcccaaaatccctggcgggcccgatttcacagcacaactataggcccgggtaccatactcaaaccgccggaccttggcaccttggcaagttggagctggactttaattattgcgaggggacaacggtggtgatcaccgaaaactgtggaactcgtggcccaagtttacggacaaccactgtctctggtaaactcattcacgagtggtgctgtcgaagctgcacactgccccctcttagatacatgggggaagatggatgttggtatggcatggagatcaggccaatatccgaaaaggaggagaatatggttaaatcactggtgagcgctggttctggcgaagtagacaacttcaccatgggggtgttgtgcctcgccattctgtttgaggaagtcatgcgcggaaagttcggcaagaaacatatgatcgcaggggtgttctttacgttcgttctactgctctccggacagatcacttggcgggatatggctcacaccctgattatgatcggcagtaatgccagcgacagaatgggtatgggggtgacataccttgcattgattgccacctttaagatacagcccttcctggctttaggatttttcctcaggaaactgacttctcgcgagaaccttctgctaggcgtcggcctcgcgatggccacaaccctgcaattgccggaagatatcgagcagatggcaaatgggattgctctgggattaatggccctcaagctgatcacacagtttgagacttatcagctttggaccgccctgatttccttgacgtgttcaaacacaatcttcaccctcactgtggcttggcgaaccgcaacactgatactagccggtgttagtctgcttcctgtgtgccaaagctcgtccatgcggaaaactgactggctcccaatgaccgtcgcggctatgggcgtaccccctctgcccttgtttatcttcacgctgaaggatacattaaagcgtagatcttggccactcaatgaaggggtgatggccgttggactggtgagcattcttgcatcaagtctgttgaggaacgacgtccctatggccggccccctcgtggctggtgggctgctaatcgcatgttacgtaattaccggaacttccgccgatctgacagtggagaaagcggctgacgtcacctgggaagaggaagccgagcagactggcgtttctcataaccttatgatcacagtggacgatgacggcaccatgcgcataaaggatgacgagacggaaaatattctcactgtgctgttgaaaaccgcattactgatcgtcagcgggatctttccatactccattccggccacactcctggtgtggcacacctggcagaagcagacacaacggtcaggagttctttgggatgtacctagccccccagagactcagaaagctgaactggaggagggtgtgtatagaataaagcagcagggcatcttcgggaaaacccaagtcggagtgggcgttcagaaggaaggtgtgtttcatacgatgtggcacgtcacaaggggggccgtgttgactcacaacggaaagcgactagagcccaattgggcaagtgtaaaaaaggacctgatttcttacggcggcgggtggcgcctctccgctcagtggcaaaaaggagaagaggtccaggtgatcgccgttgaacctggtaagaacccaaaaaatttccagaccatgcccggcacattccagaccactaccggggagattggagcgatcgccctggattttaagcctggcacaagcggttcgccgataatcaaccgggaggggaaggtggtcggactttatggcaatggcgtggttacgaaaaacgggggatacgtgtcaggtattgcacaaactaatgctgaaccagacggccccacccctgagttagaagaggaaatgttcaagaaaagaaacctgacaatcatggatctccatccagggtctggaaagaccaggaaatatttgcccgccattgtccgtgaggctatcaagcgccggctgagaactctcatactggcacctacaagggtggtagccgccgagatggaagaggctcttaagggcctgccgattcgataccagaccacggcgactaaaagtgaacacacaggtcgggagatcgtggacttgatgtgccatgcaacctttaccatgcgcctactgtcccccgttagagtcccaaattataacctcatcattatggatgaagcccacttcactgaccctgctagcatcgccgcaagggggtacatatctacacgggtgggaatgggcgaggccgctgcgatttttatgaccgccacacccccaggcactgcagatgctttccctcagagcaatgcccccatccaggacgaggaacgagacattccagagagatcctggaactcagggaatgaatggatcacggattttgcaggaaagaccgtgtggttcgtcccgagtataaaagccggtaacgacattgctaactgtttacgcaagaatggcaaaaaggtaatccaactgagcaggaagacatttgatactgagtaccagaaaaccaagcttaacgactgggatttcgtggttacaaccgacatctctgagatgggggccaattttaaagcggatcgtgtgattgaccctcggagatgcctgaagcccgtcatcctcactgatggaccagaaagggtgattttggcaggccccatgcctgttacggccgcttccgccgctcagcgccgaggtagagtggggcggaacccacagaaagagaatgaccaatatatattcaccggccagcccctgaacaatgatgaagaccatgcacactggacagaggccaagatgctcctggacaacatcaatactcctgaaggaattatcccggctcttttcgagccagagagggaaaagtcagccgcaatcgatggcgagtaccgcctaaaaggggaaagtcgtaagacctttgtcgagctgatgagacggggagacttgcccgtgtggttagcgcacaaagtagccagcgaaggtattaagtatacagataggaaatggtgcttcgacggccagcgcaacaatcagatactggaggagaacatggatgtggaaatctggaccaaggagggggaaaaaaagaagctccgacctagatggctggacgctcggacttactccgatccccttgccctgaaagagtttaaggacttcgcagctggaaggaaatctattgccctcgatttggttacagaaatcggccgcgtcccaacgcatctggcacacagaaccaggaatgccctagacaacctggtgatgctccatacttcggagcacggtgggaaggcttatcggcacgcggtggaggaacttcctgagacaatggaaaccctgttattgctgggcctcatgattctgcttaccggaggcgccatgctgtttctcatcagcgggaaaggaataggtaagacatcaatcggcttgatttgtgtcatcgcatccagtgggatgctgtggatggctgagattcccttacaatggatcgcctctgccatagttctagagttctttatgatggtgctgctcattccagaacctgagaagcagcgtactccgcaggataatcaacttgcatacgtagtgatcggaattctgacgttggctgccatcatagcggctaacgaaatgggcctgctcgagaccacaaaacgcgacctgggtatgagcaaggaacccggggtcgtgtccccaacttcatatcttgatgttgacctccatcctgcctctgcatggaccctgtacgccgtggctacaaccgtcatcactcccatgttgcgacacacgattgagaatagcacagcaaacgtaagtctggccgcgatcgctaaccaggccgtggttttaatgggcctagacaaaggatggccaatttccaagatggatctgggcgtgcctctccttgcactggggtgctacagccaggtcaatcccttgaccctgactgccgctgtgctcctgcttatcacccattatgccataattggaccgggcttacaggcaaaagctacaagagaggcccaaaagaggactgcggccggtatcatgaagaacccaaccgtcgacgggatcatgacaattgatctggaccctgtgatctacgattctaaattcgaaaagcagctcggacaggttatgttgctggtgctatgtgcagtacagctgctccttatgcggacgtcatgggctctgtgcgaggccttgaccctggcaactggccccataacaaccctctgggaaggttccccaggcaaattttggaatactacaattgctgtgagtatggccaacatcttccgcgggagctatctggccggagcgggcttagctttttcgattatgaagtctgtcgggaccggaaaaagaggcacgggttcccaaggggagacccttggagaaaagtggaagaaaaagctgaatcagctcagcaggaaagagttcgacctatacaagaaatcaggcatcacagaggttgatcggactgaagcaaaggagggtctgaaacgaggcgaaataacccaccatgccgtgagtagagggtctgctaagttgcagtggtttgtcgagcgcaacatggtgatccccgaaggaagggtaattgacctgggctgtgggcggggaggctggtcctattactgcgccggtctcaagaaagtgacagaggttcgtgggtatactaagggaggccctggccacgaggaaccggtgcccatgagcacctacgggtggaatatcgtcaaacttatgtcaggaaaggatgtgttctacctgccacctgagaaatgtgacacattgctgtgcgatattggtgaaagtagcccctcccctaccgtcgaggagtctagaactatcagggtgctcaagatggttgaaccatggttaaagaacaatcagttctgtattaaagtactgaacccctatatgcctacggtgatcgagcaccttgaacgcctgcaacggaagcatggcgggatgctagtccgaaatccactcagcagaaactccacacacgagatgtactggatatcaaatggaaccggcaacattgtggcatctgttaatatggtgagtaggctgttgctgaaccgctttactatgacccatcggagacccacaatcgaaaaagacgtcgatctcggtgccgggacgcgtcacgtgaacgctgagccggagacccctaatatggacgtaatcggagaaaggattaagcggataaaagaggaacacaactcgacttggcattatgacgatgagaatccataccgcacatgggcgtatcacggcagctacgaagtgaaggccaccggctccgcatcttcaatgatcaacggggttgtcaagcttctgactaaaccctgggacgtggtgcctatggtcacacagatggctatgaccgatacaactccattcggacagcaacgagtttttaaggagaaagtggacaccagaacgcccaggagcatgccgggtacccggcgcgtaatgggcattacagccgagtggttatggagaactctggggaggaataagaaacctcgattgtgcacccgggaagagttcacaaagaaggtgcgtactaacgcagccatgggagctgtctttaccgaagagaatcagtgggattccgccaaagcggcagtggaagacgaggatttctggaagctcgttgacagagagcgcgaactgcataaactaggcaagtgtggtagttgcgtgtataacatgatggggaaaagggagaagaaacttggagaatttggcaaggccaagggctctcgggctatctggtacatgtggctgggggccagatacctcgagttcgaggcactgggatttttgaatgaagatcactggttcagccgcgagaactcatattccggtgtcgaaggcgaggggctgcataaactcggatacattcttagggacatcagtaagatacccggcggtgctatgtatgccgatgacacggctgggtgggacacacgaatcaccgaagatgacctgcacaatgaggagaaaattactcagcagatggatccagaacaccggcaattagccaacgcaatctttaagctgacataccagaataaagtggtaaaggttcagagacctacccccactggaaccgtgatggacattatcagcaggaaggatcagcgcggctctggccaagtcgggacatatggattgaacacgttcaccaatatggaggcgcagctcatacgtcagatggaaggtgagggcgtgctgtccaaagccgacctagaaaacccacatcttcccgagaagaaaattactcagtggctggagacaaagggggtggaacggctcaaaagaatggctatctcaggagatgactgcgtcgttaagcctatcgatgacaggtttgccaacgcactgttggctttaaatgatatgggcaaggtgcgcaaagacattccacaatggcagccgagcaagggttggcacgattggcagcaggtacccttctgttcgcatcacttccacgagctgataatgaaagacgggcgaaagctcgtggtcccttgccggccacaagacgaacttatcggaagagccaggatttctcagggcgcaggctggagtctgcgcgagaccgcctgtctagggaaagcgtacgctcagatgtggtccctgatgtattttcatagacgggatctcaggttggccagcaacgcaatctgctcagccgtgcccgttcactgggtgcctacttcccgtacaacctggtctattcatgctcaccatcaatggatgacgacagaagacatgctgaccgtctggaatcgagtgtggatcgaggataacccatggatggaggacaagactcccgtaaccacatgggaaaatgttccttaccttggaaagcgcgaggatcagtggtgtggtagcctgataggcctcactagtagagccacctgggcacagaacatcccgacagctattcagcaagtgcggtccttaatcgggaatgaagagttcctggactacatgccaagcatgaaaaggtttcgcaaggaggaagagtctgaaggagccatttggtga

SEQ ID NO: 15561 - RNA, 9873 nt, synthetic construct
  misc_feature 1..9873: note = derived and/or modified CDS sequence (opt3) from DENV-3__EU482452__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctggacacatttgtgcttaagaaagaggtttctgagactcagcatgggaccatattgatcaaggtggaatacaagggagaggatgccccctgtaaaattcctttctccacggaagacggccaaggtaaggctcacaacgggcgtctgatcaccgcgaacccagtagtcacaaaaaaggaggagcccgtgaatatagaagcagagccgcctttcggcgaatcaaacattgttatcggaatcggcgataaagccctcaagattaattggtataagaaagggagcagtatcggaaagatgtttgaggctactgcccgcggtgcaagaaggatggccattctgggcgacaccgcttgggatttcgggtctgtgggaggcgtccttaactccctgggtaaaatggtgcatcagatatttgggagcgcctacacagcattgttctcgggcgtatcttggatcatgaagattggaatcggcgtgctcctgacttggatcgggttaaattccaaaaacacctcaatgagttttagctgcattgttataggaatcattacgctgtatctaggcgcggtcgtgcaggctgacatgggttgtgtgatcaattggaaggggaaggaactcaaatgcggatccggcattttcgtcacaaacgaggttcacacctggactgagcagtacaagtttcaagccgattctcccaaacggctggcaacagccatcgctggtgcctgggaaaatggcgtgtgtgggatacgaagcaccactcgcatggagaaccttttgtggaagcagatcgcaaatgaactgaactatattctctgggagaataacatcaaactgaccgtggtagtcggagacgtgattggcgttttagaacaggggaagagaacactgacgccacagcctatggagcttaaatactcatggaagacctggggaaaggctaaaatcgtgactgccgagacacaaaatagttccttcataattgacggcttgaacacccccgaatgcccaagcgcgtctagggcctggaacgtctgggaggtggaagattatggttttggggttttcacaactaatatctggctcaagctgcgggaggtgtacacccagtcatgtgaccatcgcctaatgagtgctgcaattaaagatgaaagagccgtacacgctgacatgggatactggatcgagagccagaagaacggctcctggaaactggagaaggcctcttttatagaagtcaagacgtgcacatggcccaaatcgcacaccctctggagcaatggtgtgctggagtccgatatgatcattcctaagtcacttgcaggcccaatcagtcagcataaccacaggccggggtatcatactcaaaccgcgggaccctggcacttgggcaaactggaattagacttcaattactgcgaggggacaactgtggtcattaccgagaactgtggaacacgtggcccttctctccggacgaccactgttagcggtaagctgatccacgaatggtgctgtcgatcctgcacacttccacccctgagatatatgggggaggatggatgttggtacggcatggaaataaggcctattaatgagaaagaagagaacatggtgaagtcattggtaagcgccggttctggcaaggtggacaattttaccatgggggtcctctgcctggctatcctattcgaggaagtgatgcgcggaaaattcggcaagaaacatatgatcgccggggttctgtttactttcgtgctcctgctttccggacagattacatggcgggatatggcacacaccttgatcatgattggcagtaacgctagcgacagaatgggtatgggggtcacgtatctggccttaatagcaacttttaagatccagccattcctcgccctgggatttttccttaggaaactgacctctcgcgagaatctactcctgggcgtgggcttggctatggcgacaaccctgcaattacccgaagatattgagcagatggccaacgggatcgcactcggactgatgactcttaagctgattacacagtttgaaacctaccagttgtggacagctctcgtttccctgacttgttcaaataccatcttcacgctaacagtggcctggcgaaccgccactctgatacttgctggtgtcagtctcctgccgttgtgccaaagctcgtccatgcggaagaccgactggctgcctatgacagtagcagccatgggcgtgtctccattacccctctttatcttcagcctgaaagatactcctaagcgtagatcatggccccttaacgagggggttatggcggtgggactggtcagtattttggcttcctctctcctgaggaatgacgtgccaatggccggccctctagtagcaggtgggctgcttatcgcctgttatgtgattaccggaacgagcgctgacctcacagtcgagaaagcagccgatgttacctgggaagaggaagcggagcagactggcgtgtcccataacctgatgatcacagtggacgatgacggcaccatgcgcataaaggatgacgaaactgagaacattttgacagtcttactgaaaaccgctctcctgatcgtgtcagggatctttccctacagcattccagccacgcttctggtttggcacacttggcagaagcagacccaacggagtggagtattgtgggatgtgccgtctcctcccgagacacagaaagcagaactagaggaaggtgtctacagaataaagcagcagggcatcttcgggaagacccaagtgggagttggcgtgcagaaagagggtgtctttcatacaatgtggcacgtgactaggggggccgtactgacccacaatggaaagcgactcgagccaaactgggcttccgtcaaaaaggacctgattagctatggcggcgggtggcgcctttcggcccagtggcaaaaaggagaagaggtgcaggttatcgcagtggaacccggtaagaatcctaagaacttccagacgatgccaggcattttccagacaactaccggggagatcggagctatagccttagattttaaacccggcacatcaggttctcctatcattaatcgggaagggaaggtcgtgggactgtacggcaacggcgttgtgaccaaaaatgggggatatgtcagtggtatcgcgcaaactaacgccgagccggacggcccaacccccgagctcgaagaggaaatgttcaagaaaagaaatttgacaattatggatctgcatcctgggtccggaaagacgaggaagtacctcccagcaatcgtgcgtgaggctataaaacgccggctgagaactcttattctggcccccaccagggtagtggctgcagaaatggaggaggccttgaagggcctacctatccgatatcagacaaccgccactaaaagcgaacacacaggtcgggagatcgttgacctgatgtgccatgctacctttacgatgcgcctcttatctccggtcagagtgcccaactacaatctgattatcatggatgaagcgcacttcactgacccagcaagcatagccgctagggggtatatttccacacgggtgggaatgggcgaggccgcagccatctttatgaccgctacccctcccggcactgcggaagccttcccacagtcaaacgcacctattcaggacgaggagcgagatatccccgaaagaagttggaatagcgggaacgagtggataacagactttgtcggaaagaccgtatggttcgtgccatctattaaagctggtaatgatatcgccaactgtcttcgcaagaacggcaagaaagttatccaactgtccaggaagacatttgacactgaataccagaaaacgcgtctcaatgattgggacttcgtggtcaccacagatatttcagagatgggggcaaactttaaggccgaccgggtgatcgatccgagaaggtgcttgaaacctgttattctgactgacggacccgagcgcgtgatactcgctggcccaatgcccgtcaccgccgcgagtgcagcccagcgaagaggtcgggtggggaggaatcctcagaaggaaaacgatcaatacatcttcacaggccagccactgaataacgacgaggaccatgctcactggaccgaagccaagatgcttctagataatattaacactcccgagggaatcatccctgctctgttcgaaccggagcgcgagaaaagcgcagccattgacggcgaatatcgtttgaagggggagtccagaaaaacgtttgtagaattaatgcggaggggagatctgccagtgtggctcgctcacaaggttgcctctgagggtataaaatacaccgaccgcaagtggtgcttcgatggcgaacgaaataaccagatcctggaggagaatatggacgtcgaaatttggacaaaagagggggaaagaaagaagcttcggcccaggtggctggatgcacgcacttattcggaccctctcgcgttgaaagagtttaaggatttcgccgctggaagaaaaagcatcgccctggacctagtgaccgaaattggcagggtgccctcacatctggcataccggacacgtaacgctctcgataatcttgtcatgctgcacacctccgagcatggtgggcgcgcctatcgacacgcagttgaggaattaccagagactatggaaacattgctgctcctgggccttatgatcctgctcacgggaggcgccatgttgtttctgataagtgggaagggaatcggtaaaacctctattggcttaatctgtgtgattgtaagctccgggatgctatggatggctgacatccctctgcagtggatagcgtcagccattgtgctcgagttctttatgatggtccttctgatccccgagccagaaaagcaaagaactcctcaggataaccagttggcatacgtggttattggaatcctgacactcgctgccatagtggccgcaaatgagatgggcctgcttgaaaccaccaagagggacctcggtatgtctaaagagccgggggtcgtaagccccacaagttatctggacgtggatttgcacccagcttccgcctggactctgtacgcggttgctacgaccgtgatcacacctatgttacggcatactattgaaaacagcaccgccaatgtctctctagcagccatcgctaaccaagcagtggtcctgatgggcctcgacaagggatggcccatttcaaaaatggatcttggcgtgccactgttggccctggggtgctactcccaggttaaccctctcacactgaccgcggctgtgcttttactggtaactcactatgccatcataggacccggcctccaggcaaaggccacgcgcgaggctcagaaaagaacagccgcaggtattatgaagaatccgaccgtggacgggatcatgactatcgatttggacccagtcatttacgatagtaagttcgagaaacaactgggacaggttatgctactggtgctctgtgctgtccagcttctgttgatgaggaccagctgggccctgtgcgaagcgctcacactggccactggccctatcaccacattatgggagggttcgcccggcaagttttggaacacgaccatagcagtgtctatggctaatattttccgggggtcctatcttgccggagcaggcctggcttttagcatcatgaaatcagtagggactggacgaagaggcacaggtagtcagggggaaaccctcggagagaagtggaaaaagaagctaaaccaactgtctcgcaaagaattcgacttgtacaagaaatccggcattactgaggtggataggacagaggccaaggaaggtctgaaacggggcgagaccacgcatcacgccgttagccgtgggtcagcgaagctccagtggtttgtggaaagaaatatggtcatcccagagggaagggtgatagaccttggctgtgggcgcggaggctggagttattactgcgctggtctgaaaaaggtcaccgaagtgcgggggtatacaaagggaggccccggccatgaggagcctgttccgatgagcacttacgggtggaacatcgtaaaattgatgtccggaaaggatgtgttctacctgcccccagaaaaatgtgacaccctcttatgcgatattggtgagtctagcccttcccccacagtcgaagagtcacgaactatcagagtgctgaagatggttgagccttggcttaaaaataaccagttctgtattaaggtgctgaatccatatatgcccaccgtcatcgaacacctagagaggctccagcgcaagtacggcgggatgctggtgcggaaccctttgtctagaaatagtacacacgaaatgtattggatttcgaacggaaccggcaatatcgtaagctccgtgaacatggtttctcgtctgctccttaataggtttactatgacgcatcggcgcccaacaatagagaaagacgtcgacctgggtgcagggacccgacacgtgaacgccgaacccgagactccgaacatggatgtgattggagagagaatcaagaggatcaaagaagagcattcaagcacctggcactacgacgatgaaaatccttataagacatgggcttaccacggctcctatgaggtcaaagccacgggcagtgcatctagcatgattaacggggttgtgaagttactgaccaagccatgggacgtagtgcccatggtcactcaaatggccatgacagataccactcctttcggacagcagcgggtgtttaaagaaaaggttgacacacgcaccccaagacccatgccgggtacaaggaaagtgatggagataactgctgagtggttgtggcgaaccctcggccggaataagaaacctcgtctgtgcacgagagaagagttcaccaagaaggtccgcacaaacgcggccatgggggcagtgtttactgaagagaatcaatgggattcagctagggccgcagtagaagacgaggagttctggaaactagttgatcgggaaagagagcttcataagctgggaaaatgtggctcctgcgtgtacaacatgatgggtaagcgcgaaaaaaagctcggggagtttggaaaagccaagggcagtagggctatctggtacatgtggctgggcgcccgatatttggagttcgaagcgctggggtttctcaatgaggaccactggttcagccgggaaaactcttactccggagtcgagggtgaaggccttcataagctggggtatattttaagagatatctcaaaaattcccggaggcgcaatgtacgccgacgacaccgctggttgggatacaaggatcactgaggacgatctgcacaatgaggaaaagataacccagcagatggacccagagcatcgccagttggccaacgcaatctttaaactcacgtatcaaaataaggtggtgaaagtccagcgtcctacacccaaggggaccgttatggatattatcagccggaaggaccagagaggatcgggccaggtgggcacttacgggctgaacacattcaccaatatggaagctcaactagtaaggcagatggagggagaaggtgtgctttctaaagccgatctggagaacccacacctcctggagaagaaaattactcagtggttggaaaccaagggcgtcgagcgcttaaaacgaatggctatcagtggggacgattgcgtggttaagcccatagacgatcggtttgccaatgcactgctcgcgcttaacgacatgggaaaggtgagaaaagatattcctcagtggcaaccatccaagggctggcacgactggcagcaggtcccgttctgtagccatcacttccatgaactgatcatgaaagacggtaggaagctagtggtaccctgccgccctcaggatgagctgatcgggagagcccggatttcacaaggagctggctggtccctcaaagaaacagcctgtttgggcaaggcatatgctcagatgtggtctctgatgtactttcacaggcgtgaccttcgactggccagcaacgcaatatgcagtgccgttccagtgcactggatccccacgtcccgcaccacttggagcattcatgcgcaccatcagtggatgacaaccgaggatatgctcactgtctggaatagagtgtggatcgaggacaacccttggatggaagataagacaccagttaccacgtgggaggacgtgccctacttagggaaacgggaagatcaatggtgtggatctctgattggtttgacatcaagggctacctgggcccagaatatcctgactgcaatacagcaggtccgcagtctcatcggcgacgaggagttccttgattatatgccttccatgaagagatttcggaaagaagaggaaagcgagggggccatttggtga

SEQ ID NO: 15562 - RNA, 9873 nt, synthetic construct
  misc_feature 1..9873: note = derived and/or modified CDS sequence (opt3) from DENV-3__EU482453__SS-prME
  source 1..9873: mol_type = other RNA
accagcctgtgcctcatcatgatgcttcccgcaacactggctttccacttgacttccagagacggagaacctaggatgattgtggggaagaacgaacggggaaaatctttactgtttaagacggcatcaggtataaatatgtgtaccctaatcgccatggatctcggcgaaatgtgcgacgatacagtcacttacaaatgtccactgattgcggaagttgagccggaagacatcgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccattctggccctgtttctcgctcactacatcggcacatctttaactcagaaggttgtgatattcatcctgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacattgagctgcagaagaccgaagcaactcaacttgccacactgaggaaattgtgtatcgagggaaagattaccaacatcacgaccgatagccggtgccctacacagggcgaagctatactcccagaggaacaggaccagaattatgtctgtaaacacacttacgttgatcgcggttgggggaacggatgcggcctgttcggcaaggggagtttagtgacctgcgccaagtttcaatgtctggagcccattgagggaaaagtagtgcagtatgaaaatctcaagtacacagtcatcattactgtgcacaccggtgaccagcatcaggttggcaacgacacacaaggggtgaccgtcgagatcactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgccaagaagcaagaggtcgtggtcctcggctcccaggaaggagctatgcacaccgccctgactggcgctacagagattcaaaattcagggggaaccagtatattcgccggtcacttaaagtgtcggctgaaaatggataagctagaactcaaaggcatgagctacgcaatgtgcctgaacacatttgtgcttaagaaagaggtttctgagactcagcatgggaccatcttgattaaggtggaatacaagggagaggacgccccctgtaaaatccctttctccacggaagatggccaaggtaaggctcacaacgggcgtctgataaccgcgaatccagtagtcactaagaaggaggagcccgtgaacattgaagcagagccgcctttcggcgaatcaaatatcgttatcggaattggcgacaaagccctcaagatcaactggtataagaaagggagcagtattggaaagatgtttgaggctactgcccgcggtgcaagaaggatggccatactgggcgataccgcttgggacttcgggtctgtgggaggcgtccttaattccctgggtaaaatggtgcatcagatctttgggagcgcctacacagcattgttctcgggcgtatcttggattatgaagatcggaatcggcgtgctcctgacttggattgggttaaactccaaaaatacctcaatgagttttagctgcatagcgatcggaattatcacgctgtatctaggcgctgttgtccaggccgatatgggttgtgcaattaactggaaggggaaggaactcaaatgcggatccggcatcttcgtgacaaatgaggtgcacacctggactgagcagtacaagtttcaagccgactctcccaaacggctggctacagccatagccggtgcttgggaaaacggcgtctgtgggatccgaagcaccactcgcatggagaatcttttgtggaagcagattgccaacgaactgaattatatcctctgggagaacaatattaaactgaccgttgtggtgggagatatcataggcgtattagaacaggggaagagaacactgacgccacagcctatggagcttaaatactcatggaagacctggggaaaggcgaaaattgtcactgccgagacacaaaacagttccttcatcattgacggccccaacaccccagaatgccccagcgcttctagggcatggaatgtgtgggaggttgaagactatggttttggggtgttcacaactaacatctggttgaagctccgggaggtctacacccagtcatgtgatcatcgcctgatgagtgccgctataaaagacgaaagagccgtgcacgcagatatgggatactggatcgagagccagaagaatggctcctggaaactagagaaggcgtcttttattgaagttaagacgtgcacatggcctaaatcgcacaccctgtggagcaacggtgtgctcgagtccgacatgatcattccaaagtcactggccggcccgatcagtcagcataatcacaggcccgggtatcatactcaaaccgctggaccttggcaccttggcaaattggaactggatttcaactactgcgaggggacaactgtagtcataaccgagaattgtggaacacgtggcccatctttacggacgaccactgtgagcggtaagctcattcacgaatggtgctgtcgatcctgcacactgccccctcttagatatatgggggaggacggatgttggtacggcatggaaatcaggccaaccaacgagaaagaagagaatatggtgaagtcactggtcagcgccggttctggcaaggttgataactttactatgggggtgttgtgcctcgcaatcctgttcgaggaagtaatgcgcggaaaattcggcaagaaacatatgattgctggggtgctatttacattcgtcctgctcctgtccggacagatcacctggcgggacatggcccacacgcttattatgataggcagtaatgcaagcgatagaatgggtatgggggtgacttatttggccctgatcgctacctttaagattcagcccttcttagcgctcggatttttcctgaggaaacttacatctcgcgagaacctgctactcggcgttggcctggccatggcaaccactttgcaactgccggaagacatcgagcagatggctaatgggattgccttaggactcatgacactgaaacttatcacccagtttgaaacataccagctgtggactgccttggtgtccctcacctgttcaaacacgatattcacactgaccgtcgcttggcgaactgcaaccctaatcctggccggtgtgagtcttctccctctgtgccaaagctcgtccatgcggaagacagattggttgccaatgactgttgcggctatgggcgtgccccctctgcccttatttattttctctctcaaagacaccccaaagcgtagaagctggcctctgaatgagggggtcatggccgtaggacttgtgtcaatcctggcaagttccttgctcaggaacgatgttcccatggccggcccactggtggctggtgggctactgattgcatgttatgtcatcacgggaacatctgccgaccttaccgtggagaaagcggctgacgtaacttgggaagaggaagccgagcagacaggcgtgagccataacctcatgataaccgtcgatgacgatggcactatgcgcattaaggacgatgaaacagagaatatcctgaccgttttgttaaaaacggcactgctcatcgtgtccgggatttttccgtactcaatacctgccactctgcttgtgtggcacacctggcagaagcagacacaacggagcggagtcctgtgggacgtgcccagtccacccgagacccagaaagctgaattggaggaaggtgtttacagaatcaagcagcagggcattttcgggaagacacaagtaggagtgggcgtccagaaagagggtgtgtttcatactatgtggcacgttacccgaggggcagtgctaacgcacaacggaaagaggctggagcctaattgggcatctgtcaaaaaggatctcatctcctatggcggcgggtggcgcctgagcgctcagtggcaaaaaggagaagaggtgcaggtaattgccgtcgaaccaggtaagaaccccaagaatttccagacaatgcctggcatcttccagactaccacaggggagataggagcgatcgcccttgactttaaaccgggcacctcgggttcaccaattatcaaccgggaagggaaggtggttggattatacggcaatggcgtggtcactaaaaacgggggatatgtgtctggtattgcacaaaccaatgctgagcccgatggccctacaccagagctggaagaggaaatgttcaagaaaagaaacctcacgatcatggacttgcatcccgggagtggaaagactaggaagtacctgcctgccatagttcgtgaggctattaaacgccggctcagaaccctgatccttgcaccgacaagggtggtcgccgccgaaatggaggaggctctgaagggcttgcccatccgatatcagaccactgcgacaaaatccgaacacaccggtcgggagattgtggatctaatgtgccatgcaacgtttactatgcgcctgctcagcccagtaagagtgcctaattacaacttaatcataatggacgaagcccacttcacagatcccgcttctattgccgcaagggggtatatcagcacccgggttggaatgggcgaggccgctgcgatttttatgaccgccactccacctggcacagcagaggctttcccccagtccaatgccccaatccaggacgaggagcgagacataccggaaagatcatggaacagtgggaatgagtggattaccgattttgtcggaaagacagtgtggttcgtgcctagcatcaaagcaggtaacgacatcgccaactgtctgcgcaagaatggcaagaaagtcattcaactttctaggaagacttttgatacggaataccagaaaacccgtctgaacgactgggatttcgtagtgacaactgacatctccgagatgggggctaattttaaggccgatcgggttattgaccccagaaggtgcctcaaaccagtgatattgaccgatggacccgagcgcgtcatcctggcgggccctatgccagtgacagcagcctcagctgcccagcgaagaggtcgggttgggaggaacccccagaaggaaaatgaccaatacattttcaccggccagcctctcaacaatgatgaggaccatgctcactggactgaagcaaagatgctgcttgacaacatcaatacgccggagggaatcattccagccctattcgaacccgagcgcgagaaaagtgctgccatagatggcgaatatcgtctgaagggggagagcagaaaaacctttgtggaattgatgcggaggggagacttacctgtctggctggcacacaaggtggcgtccgagggtatcaaatacacagatcgcaagtggtgcttcgacggcgaacgaaacaatcagattctcgaggagaacatggatgtagaaatctggactaaagagggggaaagaaagaagctgcggcccaggtggcttgacgcccgcacctattctgatccactggctctcaaagagtttaaggacttcgccgcaggaagaaaatcgattgctttggatctggtgacagaaatcggcagggttcctagccatctagcctaccggacccgtaatgcactggacaacctcgtcatgcttcacacttcagagcatggtgggcgcgcctatcgacacgctgtggaggaactgcccgagacaatggaaacgttattgctgctcggcctgatgatacttctgaccggaggcgcgatgctctttttgatctccgggaagggaattggtaaaacaagtatcggcctgatttgtgtgatcgtctctagcgggatgttatggatggccgatgttccactacagtggatagcatccgctattgtgctggagttctttatgatggtactccttatccctgagccggaaaagcaaagaacaccccaggacaatcagctggcctacgtggtcattggaatcttgaccctggccgcaatagtggctgccaacgagatgggcctcctggaaaccacaaagagggatcttggtatgtcaaaagagccaggggttgtgtctcctactagctatctcgacgtcgacctgcaccccgcgagtgcttggacgttgtacgccgtagcaaccacagtgatcactccaatgctgcggcataccattgaaaattccacagccaacgttagcttagctgcaatcgccaaccaagcggtggtcctaatgggcctggataagggatggcctatttctaaaatggacctcggcgtgccccttctggctttggggtgctactcacaggtcaatccgctgaccctcactgccgcagtgctgcttttagttacgcactatgccatcataggaccaggcctgcaggctaaggccacacgcgaggcacagaaaagaaccgctgccggtattatgaagaaccctactgtggatgggatcatgaccatcgacctcgatcccgtaatttacgactccaagttcgagaaacaattgggacaggtgatgctgctagtcctgtgtgcggttcagctccttctgatgaggacaagttgggccttgtgcgaagcactgactctcgctaccggcccaatcacaacgctgtgggagggtagccccggcaagttttggaataccactatagccgtgtcgatggcaaacattttccgggggtcttatttagctggagccggccttgccttttccatcatgaaaagcgtcgggacaggacgaagaggcaccggttcacagggggaaactctgggagagaagtggaaaaagaagctcaatcaactaagtcgcaaagagttcgatctgtacaagaaatctggcattacagaggtggacaggaccgaggcgaaggaaggtttgaaacggggcgagacgacccatcacgctgtatcccgtgggagcgcaaagctgcagtggtttgtggaaagaaacatggttatccctgagggaagggtgatagatctcggctgtgggcgcggaggctggtcatattactgcgccggtcttaaaaaggtcacagaagtgcgggggtatactaagggaggcccgggccatgaggagcccgtcccaatgagtacctacgggtggaatatcgtgaaactgatgagcggaaaggacgttttctacttgcctcccgaaaaatgtgatacactgctctgcgacattggtgagtcctctcctagcccaactgtagaagagtcccgaaccatcagagtgttaaagatggtcgagccctggctgaaaaacaatcagttctgtattaaggtgcttaacccttatatgccaacagttatcgaacacctggagaggctacagcgcaagtacggcgggatgctcgtgcggaatcccctgtcaagaaactctacccacgaaatgtattggattagtaatggaactggcaacatcgtctcgagcgtgaatatggtatcccgtttgctgctcaacaggtttacgatgacacatcggcgcccgaccatagagaaagatgtggaccttggtgctgggactcgacacgttaacgccgaacctgagaccccaaatatggacgtcattggagagagaatcaagaggatcaaagaagaacactcttcaacatggcactacgatgacgaaaacccctataagacgtgggcataccacggcagctatgaggtgaaagccaccggctccgctagttctatgattaatggggtggtcaagctgttaactaagccttgggatgttgtgccaatggtaacacaaatggcgatgaccgacactacacccttcggacagcagcgggtgtttaaagaaaaggtcgatacccgcacaccgagacctatgcccggtactaggaaagtgatggagataaccgccgagtggctgtggcgaacgttgggccggaacaagaaaccacgtctctgcaccagagaagagttcacaaagaaggttcgcactaatgcagctatgggggccgtgtttaccgaagagaaccaatgggacagcgcaagggccgctgtcgaagatgaggagttctggaaactggtggaccgggaaagagagctacataaacttggaaaatgtggctcatgcgtatacaatatgatgggtaagcgcgagaagaagctgggggagtttggaaaagccaagggctccagggcgatctggtacatgtggctcggcgcacgatatctggagttcgaagccttggggtttctgaacgaggatcactggttcagtcgggaaaatagctactctggagttgagggtgaaggcctccataaacttgggtatattctgagagacatctccaaaattcctggaggcgctatgtacgccgatgacacagcaggttgggacactaggatcaccgaggatgacttacacaacgaggaaaagataacgcagcagatggatcccgagcatcgccagctggctaatgccatctttaaattgacatatcaaaacaaggtggtcaaagtgcagcgtccaacccccaaggggactgtgatggacattatctcacggaaggatcagagaggaagcggccaggtcggcacatacgggctcaataccttcactaacatggaagctcaactggttaggcagatggagggagaaggtgtgctatcgaaagccgaccttgagaatcctcatctgctcgagaagaaaattacccagtggctggaaacaaagggcgtagagcgcttgaaacgaatggcaatctctggggatgactgcgtggtcaagccaatagatgaccggtttgcgaacgccttactggctctcaacgatatgggaaaggtgagaaaagacattccgcagtggcaacccagtaagggctggcacgattggcagcaggttcctttctgttcccatcacttccatgaacttatcatgaaagacggtaggaagctggtggtcccatgccgcccccaggacgagctaatcgggagagcccggattagccaaggagcaggctggtcactgaaagaaacggcttgtctcggcaaggcctatgcacagatgtggtccttgatgtactttcacaggcgtgatctgcgacttgcctctaatgcgatatgcagcgctgtgcctgtacactggatcccaaccagtcgcactacatggtccattcatgcccaccatcagtggatgaccactgaggacatgctgacagtttggaacagagtgtggatcgaggataatccctggatggaagacaagacccctgtcacgacatgggaggatgtgccgtacctcgggaaacgggaagaccaatggtgtggcagcttaattggtctgacctctagggcaacttgggcccagaacatcttgaccgctatacagcaggttcgctcactgatcggcgatgaggagttcctcgactatatgccaagtatgaagagatttcggaaagaagaggaacttgagggggccatttggtga

SEQ ID NO: 15563 - RNA, 9873 nt, synthetic construct
  misc_feature 1..9873: note = derived and/or modified CDS sequence (opt3) from DENV-3__EU482454__SS-prME
  source 1..9873: mol_type = other RNA
accagcctgtgcctcatgatgatgcttcccgcaactctggctttccacttgacttccagagacggagagcctaggatgatcgtggggaagaacgaacggggaaagtctttactgtttaagacggcatcaggtattaatatgtgtaccctaatagccatggatctcggcgagatgtgcgacgatacagtcacttacaagtgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcagcttgccacactgaggaaattgtgtattgagggaaagatcaccaacattacgaccgatagccggtgccctacacagggcgaagctactctcccagaggaacaggaccagaattatgtctgtaaacacacctacgttgatcgcggttgggggaacggatgcggcctgttcggcaaggggagtttagtgacatgcgccaagtttcaatgtctggagcccatcgagggaaaagtagtgcagtatgaaaatctcaagtacactgtcataattaccgtgcacacaggtgaccagcatcaggttggcaacgacacccaaggggtgactgtcgagatcacgcctcaggcatccacagtggaagctgtacttccagagtatggaaccctgggcttggaatgctctccgcgaactggtctagatttcaatgagatgattctgctcaccatgaaaaacaaggcctggatggttcacagacagtggtttttcgacctgccccttccttggacaagcggggcgaccactgagacaccaacgtggaataggaaagaactgttggtgacctttaagaacgcccatgccaagaagcaagaggtcgtggtcctcggctcccaggaaggagctatgcacactgccctgacaggcgctaccgagatccaaaattcagggggaacaagtatcttcgccggtcacttaaagtgtcggctgaaaatggataagctagaactcaaaggcatgagctacgcaatgtgcctgaacacttttgtgcttaagaaagaggtttctgagacccagcatgggacgattttgataaaggtggaatacaagggagaggacgccccctgtaaaatccctttctccaccgaagatggccaaggtaaggctcacaacgggcgtctgattacagcgaatccagtagtcactaaaaaggaggagcccgtgaacatcgaagcagagccgcctttcggcgaatcaaatatagttattggaatcggcgacaaagccctcaagatcaactggtataagaaagggagcagtattggaaagatgtttgaggctaccgccaaaggtgcacgcagaatggccatcctgggcgatacagcttgggacttcgggtctgtgggaggcgtccttaattccctgggtaagatggtgcatcagatttttgggagcgcctacactgcattgttctcgggcgtatcttggataatgaaaatcggaattggcgtgctcctgacctggatcgggttaaactccaagaatacgtcaatgagttttagctgcatcgttattggaataatcacactgtatctaggcgcggtcgtgcaggctgatatgggttgtgtgattaactggaaggggaaagaactcaagtgcggatccggcatcttcgtcaccaatgaggttcacacttggacagagcagtacaaatttcaagccgactctcccaagaggctggcaaccgccattgctggtgcctgggaaaacggcgtgtgtgggatccggagcactacccgaatggagaatcttttgtggaaacagatagcaaacgaactgaattatatcctctgggagaacaatattaagctgacagtggtagtcggagatatcattggcgtgttagaacaggggaaacgcacgctgaccccacagcctatggagcttaagtactcatggaagacttggggaaaagctaagatcgttacagccgagacccaaaacagttccttcataattgacggccccaacacaccagaatgccccagcgcgtctagagcctggaatgtgtgggaggtcgaagactatggttttggggtgttcactaccaacatctggttgaaactcagggaggtttacacgcagtcatgtgatcatcggctgatgagtgctgcaattaaggacgaacgcgccgtgcacgctgatatgggatactggatcgagagccagaaaaatggctcctggaagctagagaaggcctcttttatagaagtaaaaacatgcacctggcctaagtcgcacactctgtggagcaacggtgtcctcgagtccgacatgatcattccaaaatcactggcaggcccgatcagtcagcataatcacagacccgggtatcatacccaaacagcgggaccttggcaccttggcaagttggaactggatttcaactactgcgaggggactaccgtggtgattacagagaattgtggaacgaggggcccatctttacgtaccactacagtcagcggtaaactcatccacgaatggtgctgtcggtcctgcaccctgccccctcttcgatatatgggggaggacggatgttggtacggcatggaaataagaccaattaacgagaaggaagagaatatggttaagtcactggtgagcgccggttctggcaaagtagataactttactatgggggtgttgtgcctcgctatcctgttcgaggaagtcatgaggggaaagttcggcaaaaagcatatgatcgccggggtgctatttacattcgttctgctcctgtccggacagattacctggcgcgacatggcacacacgcttatcatgattggcagtaatgctagcgatcggatgggtatgggggtgacttatttggccctgatagcaacctttaaaatccagcccttcttagccctcggatttttcctgagaaaacttacatctagggagaacctgctactcggcgtcggcctggctatggcgaccactttgcaactgccggaagacattgagcagatggccaatgggatcgcattaggactcatgacactgaaacttattacccagtttgaaacataccagctgtggactgctttggtgtccctcacctgttcaaacacgatcttcacactgaccgttgcctggcgcactgccaccctaatactggctggtgtgagtcttctccctctgtgccaaagctcgtccatgcgaaaaacagattggttgccaatgactgtcgcagccatgggcgtaccccctctgcccttatttatcttctctctcaaggacaccccaaaacggcgtagctggcctctgaatgagggggtgatggcggttggacttgtgtcaattctggctagttccttgctcagaaacgatgtccccatggccggcccactggtggccggtgggctactgatcgcctgttatgtaattacgggaacatctgctgaccttaccgtggagaaggcagccgacgtcacttgggttgaagaggcggaacagacaggcgtgagccataacctcatgatcaccgtggatgacgatggcactatgaggataaaagacgatgagacagaaaatattctgaccgtcttgttaaagacggctctgctcatcgtgtccgggatctttccgtactcaattcctgccactctgcttgtttggcacacctggcagaaacagacacaacgcagcggagtactgtgggacgtgcccagtccacccgagacccagaaggcagagttggaagagggtgtctaccggataaagcagcagggcatcttcgggaaaacacaagtgggagttggcgtgcagagagaaggtgtctttcatactatgtggcacgtgacccgaggggcagtactaacgcacaacggaaagaggctggagcctaattgggcttctgtcaaaaaggatctcatttcctatggcggcgggtggcgcctgagcgcccagtggcaaaaaggagaggaagtgcaggttatcgcagtggagccaggtaagaaccccaagaatttccagacaatgcctggcactttccagaccacaaccggggaaattggagctatcgcccttgactttaaaccgggcacttcgggttcaccaataatcaaccgggaggggaaggtcgtgggattatacggcaatggcgttgtgaccaaaaacgggggatatgtctctggtattgcgcaaacaaatgccgaacccgatggccctacgccagagctggaggaagagatgttcaagaaaagaaacctcactatcatggacttgcatcccgggagtggaaagaccaggaagtacctgcctgcaattgtgcgtgaagctatcaaacgccggctcagaacactgatacttgccccgaccagggtagtggctgcagagatggaagaggccctgaagggcttgcccattcgatatcagactacagccaccaaatccgagcacacgggtcgggaaatcgttgatctaatgtgccatgctacttttacaatgcgcctgctcagcccagtcagagtgcctaattacaacttaatcattatggacgaggcgcacttcaccgatcccgcatctatcgccgctagggggtatataagcacccgggtgggaatgggcgaagccgcagccatttttatgactgctacaccacctggcaccgcggaggccttcccccagtccaatgcaccaatccaggacgaggaacgagacattccggagagatcatggaacagtgggaatgaatggatcacagattttgtcggaaagactgtatggttcgtgcctagcataaaagctggtaacgacattgccaactgtctgcgcaagaatggcaagaaagttatccaactttctaggaagacgtttgataccgagtaccagaaaacacgtctgaacgactgggatttcgtggtcactaccgacatctccgaaatgggggcaaattttaaggccgatcgggtgattgaccccagaaggtgcctcaaaccagttatcttgacagatggacccgagcgcgtgattctggctggccctatgccagtcaccgccgcgtcagcagcccagcgaagaggtcgggtggggaggaacccccagaaggagaatgaccaatacatattcactggccagcctctcaacaatgatgaagaccatgctcactggacggaggccaagatgctgcttgacaacatcaataccccggaaggaattatcccagctctattcgagcccgaacgcgagaaaagtgcagccatcgatggcgagtatcgtctgaagggggaaagcagaaaaacatttgtagagttgatgcggaggggagacttacctgtgtggctggctcacaaggttgcctccgaaggtattaaatacactgatcgcaagtggtgcttcgacggcgagcgaaacaatcagatactcgaagagaacatggatgtcgagatctggaccaaagaaggggagagaaagaagctgcggcccaggtggcttgacgcacgcacatattctgatccactggcgctcaaagaatttaaggacttcgccgctggaagaaaatcgattgccttggatctggtgaccgagatcggcagggtgcctagccatctagcacaccggactcgtaatgctctggacaacctcgtcatgcttcataagtcagaacacggtgggcgcgcctaccgacacgcagttgaggagctgcccgaaacaatggagacgttattgctgctcggcctgatgattcttctgaccggaggcgccatgctctttttgatctccgggaaaggaataggtaagacaagtatgggcctgatctgtgtgattgtatctagcgggatgttatggatggctgatgtgccactacagtggatcgcgtccgccattgtcctggagttctttatgatggtgctccttatccctgagccggagaagcaaagaacaccccaggacaatcagctggcatatgttgtgataggaattttgaccctggctgccatcgtcgccgcaaacgaaatgggcctcctggagaccacaaaaagggatcttggtatgtcaaaggaaccaggggtagtgtctcctactagctacctcgacgttgacctgcatcccgctagtgcctggacgttgtatgcggtggctaccacagtcattactccaatgctgcggcacaccatcgaaaattccacagccaacgtgagcttagcagccatagctaaccaagcagtcgtgctaatgggcctggataaaggatggcctatctctaagatggacctcggcgttccccttctggccttggggtgctactcacaggtgaatccgctgaccctcactgcggctgtactgcttttagtgacgcattacgccattatcggaccaggcctgcaggcaaaagccacacgcgaagctcagaagagaaccgccgcaggtattatgaagaaccctactgtcgatgggatcatgaccatagacctcgatcccgttatttatgactccaaattcgagaagcaattgggacaggtgatgctgctagtcctgtgtgctgtgcagctccttctgatgaggacaagttgggccttgtgcgaggcgctgactctcgccaccggcccaatcacaacgctgtgggaaggtagccccggcaaattttggaataccactatcgcagtatcgatggctaacattttccgggggtcttacttagccggagcaggccttgctttttccatcatgaaaagcgtggggacaggacgaagaggcaccggttcacagggggagactctgggagaaaaatggaagaagaaactcaatcaactaagtcgcaaggagttcgatctgtataaaaagtctggcataacagaagttgacaggaccgaggccaaagagggtttgaagcggggcgaaacgacccaccatgccgtgtcccgtgggagcgcgaaactgcagtggtttgtcgagagaaacatggtgattcctgaaggaagggtcatcgatctcggctgtgggcgcggaggctggtcatactattgcgctggtcttaagaaggtgacagaggttcgggggtacactaaaggaggcccgggccacgaagaacccgtaccaatgagtacctatgggtggaatattgtgaagctgatgagcggaaaagacgtcttctacttgcctcccgagaagtgtgatacactgctctgcgacatcggtgaatcctctcctagcccaactgtggaggaatcccgaaccataagagttttaaaaatggtggagccctggctgaagaacaatcagttctgtatcaaggtccttaacccttacatgccaacagtgattgagcacctggaaaggctacagcgcaaatatggcgggatgctcgtacggaatcccctgtcaagaaactctacccatgagatgtactggatcagtaatggaactggcaacattgtgtcgagcgttaatatggtctcccgtttgctgctcaacaggtttacgatgacacaccggcgcccgaccatcgaaaaggatgtggaccttggtgcagggactcgacatgtgaacgccgagcctgaaaccccaaatatggacgtcattggagagagaatcaaaaggataaaggaggaacactcttcaacatggcactatgatgacgagaacccctacaaaacgtgggcttatcatggcagctacgaagttaaggccaccggctccgcaagttctatgattaatggggtggtaaagctgttaactaaaccttgggatgtggtcccaatggtgacacaaatggccatgaccgacactacacccttcggacagcagcgggtttttaaggagaaagtggatacccgcacaccgagacctatgcccggtactaggaaggtcatggaaatcaccgctgagtggctgtggcgaacgttgggccggaacaaaaagccacgtctctgcaccagagaggagttcacaaagaaagtgcgcactaatgcggccatgggggcagtatttaccgaggaaaaccaatgggacagcgctagggccgcagttgaggatgaagagttctggaagctggtggaccgggagagagaactacacaaacttggaaagtgtggctcatgcgtctataatatgatgggtaaacgcgagaagaaactgggggaatttggaaaggccaagggctccagggctatctggtacatgtggctcggcgcccgatacctggagttcgaggcgttggggtttctgaacgaagatcattggttcagtcgggagaatagctattctggagtggaaggtgagggcctccacaaacttgggtacattctgagagacatatccaagatccctggaggcgcaatgtatgccgatgacacagctggttgggacactaggattaccgaagatgacttacataacgaggagaaaatcacgcagcagatggatcccgaacaccgccagctggccaatgcaatttttaagttgacataccaaaacaaagtggtcaaggttcagcgtccaacccccaaggggactgtgatggacatcatatcacggaaagatcagagaggaagcggccaggtaggcacatatgggctcaataccttcactaacatggaggctcaactggtgaggcagatggaaggagagggtgtcctatcgaaggccgaccttgaaaatcctcatctgctcgagaaacgcatcacccagtggctggagacaaagggcgtggaacgattgaaacggatggctatttctggggatgactgcgttgtgaagccaatcgatgacagatttgccaacgcattactggcgctcaacgatatgggaaaggtcaggaaagacattccgcagtggcaacccagtaagggctggcatgattggcaacaggtgcctttctgttcccaccatttccacgagcttatcatgaaagacggtcgcaagctggtagttccatgcagaccccaggacgaactaatagggcgggccaggattagccaaggagctggctggtcactgaaagagacggcctgtctcggcaaggcatacgctcagatgtggtccttgatgtattttcaccgtcgagatctgcgccttgcctctaatgcaatctgcagcgccgtgcctgcgcattggatcccaaccagtagaactacatggtccattcacgctcatcaccagtggatgaccactgaagacatgctgacagtctggaaccgggtgtggatagaggataatccctggatggaggacaagacccctgttacgacatgggaagatgtgccgtacctcgggaaaagggaggaccaatggtgtggcagcttaatcggtctgacctctcgcgccacttgggcacagaacattttgaccgccatccagcaggtcagatcactgattggcgatgaagagttcctcgactacatgccaagtatgaagcggtttaggaaagaggaagagtccgaaggggctatctggtga

SEQ ID NO: 15564 - RNA, 9873 nt, synthetic construct
  misc_feature 1..9873: note = derived and/or modified CDS sequence (opt3) from DENV-3__EU482455__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactggttgcggaagtggagccggaagacatcgattgctggtgtaaccttaccagtacatgggtaacctatgggacttgcaatcaggctggagagcatcgccgagacaagcgtagcgtggccctggcaccccacgtcggcatgggtttggatacaagaacccaaacgtggatgtccgccgagggggcttggaggcaggtggaaaaagttgagacttgggcactccggcatcctggattcaccattctggccctgtttctcgctcactacatcggcacatctttaactcagaaggtggtcattttcatcctgcttatgttggtgaccccatcgatgacaatgcgctgtgtaggcgttgggaacagagactttgtggaaggactgtcaggtgccacctgggtcgatgtggtgctagagcatggcgggtgcgtcacgactatggcgaagaataaacccacactcgacatagagctgcagaagaccgaagcaactcaacttgccacactgaggaaattgtgtatcgagggaaagattaccaacatcacgaccgatagccggtgccctacacagggcgaagctattctcccagaggaacaggaccagaattatgtttgtaaacacacttacgtggatcgcggttgggggaacggatgcggcctgttcggcaaggggagtttagtaacctgcgccaagtttcaatgtctggagcccatcgagggaaaagtggtccagtatgaaaatctcaagtacacagtgataattactgttcacaccggtgaccagcatcaggtgggcaacgacacacaaggggtcaccgtggagatcactcctcaggcatccacggtagaagctgttcttccagagtatggaacactgggcttggaatgctctccgcgaaccggtctagatttcaatgagatgattctgctcactatgaaaaacaaggcctggatggtgcacagacagtggtttttcgacctgccccttccttggaccagcggggcgacaaccgagactccaacatggaataaaaaggaactgttggtcacgtttaaaaacgcccatgcaaagaagcaagaggtggtcgtgctcggctcccaggaaggagctatgcacaccgccctgactggcgctacagagatccagaattcagggggaaccagtatcttcgccggtcacttaaaatgtaggctgaagatggataaactagaactcaagggcatgagctacgcaatgtgcctgaacacatttgttcttaaaaaggaggtgtctgagactcagcatgggaccattttgataaaggtagaatacaaaggagaggacgccccctgtaagatccctttctccacggaagatggccaaggtaaagctcacaacgggcggctgattaccgcgaatccagtcgtgacaaagaaagaggagcccgttaacatcgaagcagagccgcctttcggcgaatcaaatatagtgattggaatcggcgacaaggccctcaagatcaactggtataaaaaggggagcagtattggaaaaatgtttgaggctactgcccgtggtgcacgcagaatggccatcctgggcgataccgcttgggacttcgggtctgtcggaggcgtgcttaattccctgggtaagatggtacatcagatttttgggagcgcctacacagcattgttctcgggcgtgtcttggataatgaaaatcggaattggcgttctcctgacttggatcgggttaaactccaagaatacctcaatgagttttagctgcatcgtcattggaataatcacgctgtatctaggcgcggtggtgcaggctgatatgggttgtgccattaactggaaggggaaagaactcaagtgcggatccggcatcttcgtcacaaatgaggttcacacctggactgagcagtacaaatttcaagcagactctcccaagaggctggccacagctattgccggtgcatgggaaaacggcgtgtgtgggatccggagcaccactcgaatggagaatcttttgtggaaacagatagctaacgaactgaattatatcctctgggagaacaatattaagctgaccgtggtagtcggagatatcattggcgtgttagaacaggggaaacgcacactgacgccacagcctatggagcttaagtactcatggaagacctggggaaaagccaagatcgttactgcggagacacaaaacagttccttcataattgacggccccaacaccccagaatgccccagcgcctctagagcttggaatgtgtgggaggtcgaagactatggttttggggtgttcacaactaacatctggttgaaactcagggaggtttacacccagtcatgtgatcatcggctgatgagtgcagccattaaggacgaacgcgctgtgcacgccgatatgggatactggatcgagagccagaaaaatggctcctggaagctagagaaggcatcttttatagaagtaaaaacgtgcacatggcctaagtcgcacaccctgtggagcaacggtgtcctcgagtccgacatgatcattccaaaatcactggcgggcccgatcagtcagcataatcacagacccgggtatcatactcaaaccgccggaccttggcaccttggcaagttggaactggatttcaactactgcgaggggacaactgtggtgattaccgagaattgtggaacaaggggcccatctttacgtacgaccactgtcagcggtaaactcatccacgaatggtgctgtcggtcctgcacactgccccctcttcgatatatgggggaggacggatgttggtacggcatggaaataagaccaattaacgagaaggaagagaatatggttaagtcactggtgagcgctggttctggcaaagtagataactttaccatgggggtgttgtgcctcgccatcctgttcgaggaagtcatgaggggaaagttcggcaaaaagcatatgatcgcaggggtgctatttactttcgttctgctcctgtccggacagattacatggcgcgacatggctcacacccttatcatgattggcagtaatgccagcgatcggatgggtatgggggtgacgtatttggcactgatagccacttttaaaatccagcccttcttagctctcggatttttcctgagaaagcttacctctagggagaacctgctactcggcgtcggcctggcgatggccacaaccttgcaactgccggaagacattgagcagatggcaaatgggatcgctttaggactcatgactctgaagcttattacacagtttgaaacctaccagctgtggacagccttggtgtccctcacttgttcaaacaccatcttcacgctgacagttgcctggcgcaccgctactctaatactggcaggtgtgagtcttctccctctgtgccaaagctcgtccatgcgaaaaaccgattggttgccaatgacagtcgccgcgatgggcgtaccccctctgcccttatttatcttctctctcaaggacactccaaaacggcgtagctggcctctgaatgagggggtgatggctgttggacttgtgtcaattctggccagttccttgctcagaaacgatgtccccatggcaggcccactggtggccggtgggctactgatcgcttgttatgtaattaccggaacgtctgcagaccttacagtggagaaggccgcggacgtcacctgggaagaggaagctgagcagactggcgttagccataacctcatgatcacagtggatgacgatggcaccatgaggataaaagacgatgaaactgagaatattctgacagtgttgttaaagaccgccctgctcatcgtctccgggatctttccgtactcaattcctgcaacgctgcttgtgtggcacacttggcagaaacagacccaacgcagcggagttctgtgggacgtacccagtccacccgagacacagaaggccgaattggaggaaggtgtgtaccggataaagcagcagggcatcttcgggaaaacccaagtcggagtgggcgttcagaaggagggtgtgtttcatacaatgtggcacgtcactagaggggctgtgctaacccacaacggaaaaaggctggagcctaattgggcctctgtaaagaaagatctcatttcctatggcggcgggtggcgactgagcgcacagtggcaaaagggagaagaggtccaggtgatcgctgttgaaccaggtaagaaccccaaaaatttccagacgatgcctggcattttccagacaactaccggggagatcggagccatagcgcttgactttaagccgggcacatcgggttcaccaatcattaaccgcgaagggaaagtggtcggattatacggcaatggcgtggttaccaagaacgggggatatgtgtctggtatcgcccaaactaatgcagagcccgatggccctaccccagagctggaagaggaaatgttcaaaaagcggaacctcacaattatggacttgcatcccgggagtggaaagacgagaaaatacctgcctgctatcgtcagggaggccataaagcgtcgcctccggactctgattcttgctccgaccagagtggtagcagccgaaatggaggaggccctgaaaggcttgcccatcaggtatcagacaaccgctactaagtccgaacacacaggtcgagagatcgtggatctaatgtgccatgcgacctttacgatgcggctgctcagcccagttcgcgtccctaattacaacttaattatcatggacgaagcacacttcactgatcccgcctctatagctgccagagggtatattagcacaagggtgggaatgggcgaggcagccgctatctttatgaccgcgaccccacctggcactgccgaagcattcccccagtccaatgctccaattcaggacgaggagcgggacatcccggaacgatcatggaacagtgggaatgagtggataacagattttgtgggaaaaaccgtctggttcgtacctagcattaaggccggtaacgacatcgcaaactgtctgagaaagaatggcaaaaaggtgatccaactttctcgcaaaacatttgatactgaataccagaagacgaggctgaacgactgggatttcgttgtgaccacagacatttccgagatgggggccaattttaaagctgatcgtgtcatcgacccccggagatgcctcaagccagtgattttgactgatggacccgagagggttatactggccggccctatgccagtgaccgcggcatcagccgctcagcgccgaggtagagtcgggcggaacccccagaaggaaaatgaccaatacatcttcacaggccagcctctcaacaatgatgaggaccatgcccactggaccgaagctaaaatgctgcttgacaacattaatactccggagggaatcatcccagcactattcgaacccgagagggagaagagtgccgctattgatggcgaatatcgcctgaaaggggagagccgtaagacgtttgtggaattgatgagacggggagacttacctgtatggctggcccacaaagtggcatccgagggtataaagtacaccgataggaaatggtgcttcgacggcgaacgcaacaatcagatcctcgaggagaacatggatgttgaaatttggacaaaggagggggaacgaaagaaactgagaccccggtggcttgacgcgaggacttattctgatccactggccctcaaggagtttaaagacttcgctgccggacgcaagtcgatcgcatttgatttggtcaccgaaattggcagagtgcctagccatctggcttacaggacacggaatgccctagacaacctggtgatgctccacacctcagagcatggtgggcgtgcatatcgccacgccgtcgaggaacttcccgagactatggaaacactgttattgctgggcctcatgatcctgcttacgggaggcgctatgctgttcctcatatccgggaaaggaatcggtaagaccagtattggcttgatctgtgttattgtgtctagcgggatgctgtggatggcggatgtaccattacagtggatcgcctccgcaatagtgctagagtttttcatgatggtcctgctcattcctgagccggaaaagcaacgaactccccaggacaatcagcttgcttacgtggttatcggaattctgacattggccgccatcgtggcagctaacgagatgggcctgctcgaaaccaccaaaagagatctgggtatgtcaaaggagccaggggtcgtatctcctacaagctatcttgacgtggacctccaccccgccagtgcgtggactctgtacgctgttgccacgaccgtgataacaccaatgttgaggcatactatcgaaaattccaccgcaaacgtcagcctggccgctattgcaaaccaagccgtggtcttaatgggcctagataaaggatggcctatctctaagatggacctgggcgtgcccctccttgcgctggggtgctactcacaggttaatccgttgacactgaccgctgccgtgctcctgcttgtaactcactatgcaattatcggaccaggcttacaggccaaagctacgcgggaggcccagaagcgcacagcagctggtataatgaagaaccctaccgtggatgggattatgactatcgacctggatcccgtcatctacgactccaaatttgagaagcaactcggacaggttatgttgctggtgctatgtgccgtccagctgctccttatgagaaccagttgggcgctgtgcgaagccttgacactggcaactggcccaattaccacactctgggagggtagccccggcaaattctggaatacgaccatcgctgtgtcgatggccaacatatttagggggtcttatctggcaggagctggcttagccttctccattatgaagagcgtagggatcggacggcgaggcactggttcacagggggaaacacttggagagaaatggaagaagaaactgaatcaactcagtagaaaggaatttgatctatacaaaaagtctggcattaccgaggtggaccgcactgaggccaaagaaggtctgaagaggggcgagacaacccatcacgcggtttcccgggggagcgctaaattgcagtggttcgtggaacgtaacatggtcatccctgagggaagagtgatagatctgggctgtgggaggggaggctggtcatattactgcgcaggtctcaagaaggtcacggaagtgcgcgggtataccaaaggaggcccgggccatgaggagcccgttccaatgagtacatacgggtggaatatcgtaaagcttatgagcggaaaagacgtgttctacctgcctcccgaaaagtgtgatactttgctgtgcgacattggtgagtcctctcctagcccaaccgtcgaagagtcccggacaatccgagtgctcaaaatggttgagccctggttaaagaacaatcagttttgtattaaggtgctgaacccttatatgccaactgtcatcgaacaccttgagagactgcagaggaaatacggcgggatgctagtgcgcaatcccctctcacggaactctacccacgaaatgtattggattagtaatggaacaggcaacatcgtatcgagcgtgaatatggtttccagactgttgctgaaccgtttcaccatgactcataggcggccgacgatagagaaggatgtcgacctcggtgccgggacacgccacgtgaacgctgaacctgagaccccaaatatggacgtgattggagagcgaatcaaaagaatcaaggaagagcattcttcaacttggcactacgatgacgaaaacccctataaaacctgggcctaccacggcagctatgaggtcaaggcaacaggctccgccagttctatgattaatggggttgtgaagcttctgacgaaaccttgggatgtagtgccaatggtcacccaaatggctatgactgacacaaccccctttggacagcagagggtgttcaaggaaaaagttgatactcggacaccgcgccctatgcccggtaccagaaaggtgatggagataacagcggagtggttatggaggactctgggccgaaacaaaaagccacggttgtgcacccgtgaagagtttacgaagaaagtcagaaccaatgccgcaatgggggctgtgttcacagaagagaaccaatgggacagcgcccgcgcagccgtagaagatgaggagttttggaagctcgttgacagggaacgggagctgcataaactaggaaagtgtggctcatgcgtgtacaatatgatgggtaaaagagaaaagaaacttggggagttcggaaaggctaagggctcccgcgccatctggtacatgtggctgggcgcgaggtatctcgagtttgaagcactggggttcttgaacgaggatcactggtttagtcgagaaaatagctactctggagtcgagggtgaaggcctgcataaactcgggtatattcttcgggacatctccaagattcctggaggcgccatgtacgctgatgacactgccggttgggacaccagaatcacagaggatgacctgcacaacgaggaaaaaataactcagcagatggatcccgagcataggcagttagcaaatgctatcttcaagctgacctatcaaaacaaagtggtgaaggtccagcgcccaacgcccaaggggacagttatggacattatctcacgtaaagatcagcggggaagcggccaggtgggcacctacgggttgaatacttttacaaacatggaagcccaactcgtaagacagatggagggagaaggtgtgctgtcgaaggctgacctagagaatcctcaccttctggagaaaaagattacccagtggctcgaaactaaaggcgtcgagaggctgaagcgcatggccatctctggggatgactgcgtggttaagccaatagatgaccgattcgcaaacgcgttgttagccctgaacgatatgggaaaagtgcggaaggacattccgcagtggcaacccagtaaaggctggcacgattggcagcaggtccctttctgttcccatcactttcatgaactcatcatgaaggacggtagaaaacttgtggtaccatgcaggccccaggacgagctgatcgggcgcgctagaattagccaaggagccggctggtcactaaaggaaaccgcatgtctgggcaaggcttatgcccagatgtggtccctcatgtacttccaccggagggatttgcgtctggcatctaatgccatatgcagcgcggttcctgtgcactggatcccaacaagtcgaacgacctggtccattcatgctcaccatcagtggatgactacagaggacatgcttaccgtctggaaccgcgtgtggatcgaggataatccctggatggaagacaaaactcctgttacaacctgggaggatgtgccgtacctggggaagagagaagaccaatggtgtggaagcctcattggtttaacgtctcgggccacatgggcacagaacatcctgaccgccatacagcaggtcaggtcattgatcggcgatgaggagtttctggactatatgccaagtatgaaacgcttcagaaaggaagaggaatccgagggggctatttggtga

SEQ ID NO: 15565 - RNA, 9873 nt, synthetic construct
  misc_feature 1..9873: note = derived and/or modified CDS sequence (opt3) from DENV-3__EU482456__SS-prME
  source 1..9873: mol_type = other RNA
accagcctgtgcctcatgatgatgcttcccgcaactctggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatactgtaacttacaaatgtccactgatcgcggaagttgagccggaagacattgattgctggtgtaaccttaccagtacctgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcactgagatgatcctgctcaccatgaaaaataaggcctggatggttcacagacagtggtttttcgacctgccccttccttggacaagcggggcgaccactgagacaccaacgtggaacaggaaagaactgttggtgacctttaagaatgcccatgccaagaagcaagaggtcgtggtcctcggctcccaggaaggagctatgcacactgccctgacaggcgctaccgagatccagaactcagggggaacaagtattttcgccggtcacttaaagtgtcggctgaaaatggataagctagaactcaaaggcatgagctacgcaatgtgcctgaatacttttgtgcttaagaaagaggtttctgagacccagcatgggacgatattgatcaaggtggaatacaagggagaggacgccccctgtaaaattcctttctccaccgaagatggccaaggtaaggctcacaacgggcgtctgatcacagcgaacccagtagtcactaaaaaggaggagcccgtgaatatagaagcagagccgcctttcggcgaatcaaacattgttatcggaatcggcgacaaagccctcaagattaattggtataagaaagggagcagtatcggaaagatgtttgaggctaccgcccgcggtgcaagaaggatggccattctgggcgatacagcttgggacttcgggtctgtgggaggcgtccttaactccctgggtaaaatggtgcatcagatatttgggagcgcctacactgcattgttctcgggcgtatcttggatcatgaagattggaatcggcgtgctcctgacctggatcgggttaaattccaaaaacacgtcaatgagttttagctgcattgttataggaatcattacactgtatctaggcgcggtcgtgcaggctgatatgggttgtgtgatcaattggaaggggaaggaactcaaatgcggatccggcattttcgtcaccaacgaggttcacacttggacagagcagtacaagtttcaagccgactctcccaaacggctggcaaccgccatcgctggtgcctgggaaaatggcgtgtgtgggatacgaagcactacccgcatggagaaccttttgtggaagcagatcgcaaatgaactgaactatattctctgggagaataacatcaaactgacagtggtagtcggagatacgattggcgtgttagaacaggggaagagaaccctgactccacagcctatggagcttaaatactcatggaagacatggggaaaggctaaaatcgttaccgccgagacacaaaatagttccttcataattgacggccccaacactccagaatgccccagcgcgtctagggcctggaacgtgtgggaggtcgaagactatggttttggggtgttcaccacgaatatctggttgaagctccgggaggtttacacacagtcatgtgatcatcgcctgatgagtgctgcaattaaagacgaaagagccgtgcacgctgatatgggatactggatcgagagccagaagaacggctcctggaaactagagaaggcctcttttatagaagtaaagacctgcacttggcctaaatcgcacaccctgtggagcaatggtgtcctcgagtccgacatgatcattccaaagtcactggcaggcccgatcagtcagcataaccacaggcccgggtatcatacacaaactgcgggaccttggcaccttggcaaattggaactggatttcaattactgcgaggggaccacagtggtgattacggagaactgtggaacccgtggcccatctttacggactacaaccgtcagcggtaagctcatccacgaatggtgctgtcgatcctgcactctgccccctcttagatatatgggggaggacggatgttggtacggcatggaaataaggccaattaatgagaaagaagagaacatggttaagtcactggtgagcgccggttctggcaaggtagataattttacaatgggggtgttgtgcctcgctatcctgttcgaggaagtcatgcgcggaaaattcggcaagaaacatatgatcgccggggtgctatttaccttcgttctgctcctgtccggacagattacgtggcgggacatggcacacactcttatcatgattggcagtaacgctagcgatagaatgggtatgggggtgacctatttggccctgatagcaacatttaagatccagcccttcttagccctcggatttttcctgaggaaacttacctctcgcgagaatctgctactcggcgtcggcctggctatggcgactacattgcaactgccggaagacattgagcagatggccaacgggatcgcattaggactcatgaccctgaaacttattacacagtttgaaacttaccagctgtggaccgctttggtgtccctcacgtgttcaaatacaatcttcaccctgactgttgcctggcgaaccgccacactaatactggctggtgtgagtcttctccctctgtgccaaagctcgtccatgcggaagactgattggttgccaatgaccgtcgcagccatgggcgtaccccctctgcccttatttatcttctctctcaaagacacgccaaagcgtagaagctggcctctgaacgagggggtgatggcggttggacttgtgtcaattctggctagttccttgctcaggaatgatgtccccatggccggcccactggtggccggtgggctactgatcgcctgttatgtaattacaggaacctctgctgaccttactgtggagaaagcagccgacgtcacatgggaagaggaagcggagcagaccggcgttagccataacctcatgatcactgtggatgacgatggcacaatgcgcataaaggacgatgaaaccgagaacattctgacggtgttgttaaaaactgctctgctcatcgtctccgggatctttccgtactcaattcctgccaccctgcttgtgtggcacacatggcagaagcagacccaacggagcggagttctgtgggacgtacccagtccacccgagacacagaaagcagaattggaggaaggtgtgtacagaataaagcagcagggcatcttcgggaagactcaagtcggagtgggcgttcagaaagagggtgtgtttcataccatgtggcacgtcacgcgaggggcagtgctaacacacaatggaaagaggctggagcctaactgggcttctgtcaagaaggatctcatttcctatggcggcgggtggcgcctgagcgcccagtggcaaaaaggagaagaggtccaggtgatcgcagttgaaccaggtaagaatcccaagaacttccagactatgcctggcattttccagaccacaaccggggagatcggagctatagcccttgactttaaaccgggcacttcgggttcaccaatcattaatcgggaagggaaggtggtcggattatacggcaacggcgtggttaccaaaaatgggggatatgtgtctggtatcgcgcaaacaaacgccgagcccgatggccctacgccagagctggaagaggaaatgttcaagaaaagaaatctcactattatggacttgcatcccgggagtggaaagaccaggaagtacctgcctgcaatcgtccgtgaggctataaaacgccggctcagaacactgattcttgccccgaccagggtggtagctgcagaaatggaggaggccctgaagggcttgcccatccgatatcagactacagccaccaaatccgaacacacgggtcgggagatcgtggatctaatgtgccatgctacttttacaatgcgcctgctcagcccagttagagtccctaactacaatttaattatcatggacgaagcgcacttcaccgatcccgcatctatagccgctagggggtatattagcacccgggtgggaatgggcgaggccgcagccatctttatgactgctacaccacctggcaccgcggaagccttcccccagtccaacgcaccaattcaggacgaggagcgagacatcccggaaagatcatggaatagtgggaacgagtggataacagattttgtgggaaagactgtctggttcgtacctagcattaaagctggtaatgacatcgccaactgtctgcgcaagaacggcaagaaagtgatccaactttctaggaagacgtttgataccgaataccagaaaacacgtctgaatgactgggatttcgttgtgactaccgacatttccgagatgggggcaaactttaaggccgatcgggtcatcgaccccagaaggtgcctcaaaccagtgattttgacagatggacccgagcgcgttatactggctggccctatgccagtgaccgccgcgtcagcagcccagcgaagaggtcgggtcgggaggaatccccagaaggaaaacgaccaatacatcttcactggccagcctctcaataacgatgaggaccatgctcactggacggaagccaagatgctgcttgacaatattaacaccccggagggaatcatcccagctctattcgaacccgagcgcgagaaaagtgcagccattgatggcgaatatcgtctgaagggggagagcagaaaaacatttgtggaattgatgcggaggggagacttacctgtatggctggctcacaaggtggcctccgagggtataaaatacactgatcgcaagtggtgcttcgacggcgaacgaaataaccagatcctcgaggagaatatggatgttgaaatttggaccaaagagggggaaagaaagaagctgcggcccaggtggcttgacgcacgcacatattctgatccactggcgctcaaagagtttaaggacttcgccgctggaagaaaatcgatcgccttggatctggtcaccgaaattggcagggtgcctagccatctagcataccggactcgtaacgctctggacaatctcgtgatgcttcacacatcagagcatggtgggcgcgcctatcgacacgcagtcgaggaactgcccgagacgatggaaaccttattgctgctcggcctgatgatccttctgactggaggcgccatgctctttttgatatccgggaagggaatcggtaaaacaagtattggcctgatctgtgttattgtgtctagcgggatgttatggatggctgatgtaccactacagtggatcgcgtccgccatagtgctggagttctttatgatggtcctccttattcctgagccggaaaagcaaagaacaccccaggacaaccagctggcatacgtggttatcggaattttgaccctggctgccatcgtggccgcaaatgagatgggcctcctggaaacaactaagagggatcttggtatgtcaaaagagccaggggtcgtatctcctacgagctatctcgacgtggacctgcaccccgctagtgcctggaccttgtacgcggttgctacaactgtgataaccccaatgctgcggcatacaatcgaaaactccaccgccaatgtcagcttagcagccattgctaaccaagcagtggtcctaatgggcctggataagggatggcctatctctaaaatggacctcggcgtgccccttctggccttggggtgctactcacaggttaacccgctgactctcacggcggctgtgctgcttttagtaacacactatgccattatcggaccaggcctgcaggcaaaggccacccgcgaggctcagaaaagaactgccgcaggtataatgaagaatcctaccgtggatgggattatgacaatcgacctcgatcccgtcatctacgactccaagttcgagaaacaattgggacaggttatgctgctagtgctgtgtgctgtccagctccttctgatgaggacaagttgggccttgtgcgaagcgctgaccctcgccacaggcccaattacgaccctgtgggagggtagccccggcaagttttggaacactacaatcgcagtgtcgatggctaatatattccgggggtcttatttagccggagcaggccttgctttttccattatgaaaagcgtagggaccggacgaagaggcactggttcacagggggaaacactgggagagaagtggaaaaagaagctcaaccaactaagtcgcaaagagttcgatctgtacaagaaatctggcatcaccgaggtggacaggacggaggccaaggaaggtttgaaacggggcgagaccacacatcacgccgtttcccgtgggagcgcgaagctgcagtggtttgtggaaagaaatatggtcattcctgagggaagggtgatcgatctcggctgtgggcgcggaggctggtcatattactgcgctggtcttaaaaaggtcactgaagtgcgggggtataccaagggaggcccgggccatgaggagcccgttccaatgagtacatacgggtggaacatagtaaaactgatgagcggaaaggacgtgttctacttgcctcccgaaaaatgtgatactctgctctgcgacatcggtgagtcctctcctagcccaaccgtcgaagagtcccgaacaattagagtgttaaagatggttgagccctggctgaaaaataaccagttctgtatcaaggtgcttaatccttatatgccaaccgtcattgaacacctggagaggctacagcgcaagtacggcgggatgctcgtgcggaaccccctgtcaagaaattctactcacgaaatgtattggatcagtaacggaacgggcaatattgtatcgagcgtgaacatggtttcccgtttgctgctcaataggtttacaatgacccatcggcgcccgactatcgagaaagatgtcgaccttggtgcagggacccgacacgtgaacgccgaacctgagacaccaaacatggacgtgataggagagagaattaagaggatcaaagaagaacactcttcaacgtggcactacgatgacgaaaatccctataagacctgggcttaccacggcagctatgaggtcaaagccactggctccgcaagttctatgatcaacggggttgtgaagctgttaacaaagccttgggatgtagtgccaatggtcacccaaatggccatgactgacacaacccccttcggacagcagcgggtgtttaaagaaaaggttgatacacgcactccgagacctatgcccggtaccaggaaagtgatggagattacggctgagtggctgtggcgaaccttgggccggaataagaaaccacgtctctgcacaagagaagagttcactaagaaggtccgcaccaacgcggccatgggggcagtgtttacagaagagaatcaatgggacagcgctagggccgcagtagaagatgaggagttctggaaactggttgaccgggaaagagagctacataaacttggaaaatgtggctcatgcgtgtacaacatgatgggtaagcgcgagaagaagctgggggagtttggaaaagccaagggctccagggctatatggtacatgtggctcggcgcccgatatctggagttcgaagcgttggggtttctgaatgaggatcactggttcagtcgggaaaacagctactctggagtcgagggtgaaggcctccataaacttgggtatatcctgagagacatttccaaaatccctggaggcgcaatgtacgccgatgacactgctggttgggacaccaggattacggaggatgacttacacaatgaggaaaagatcacacagcagatggatcccgagcatcgccagctggccaacgcaatatttaaattgacctatcaaaataaggtggtgaaagtccagcgtccaactcccaaggggacagttatggacatcatttcacggaaggatcagagaggaagcggccaggtgggcacctacgggctcaacactttcaccaatatggaagctcaactggtaaggcagatggagggagaaggtgtgctatcgaaagccgaccttgagaaccctcatctgctcgagaagaaaatcacacagtggctggaaacgaagggcgtcgagcgcttgaaacgaatggctatttctggggatgactgcgtggttaagccaatcgatgaccggtttgccaatgcattactggcgctcaacgatatgggaaaggtgagaaaagacataccgcagtggcaacccagtaagggctggcacgattggcagcaggtccctttctgttcccatcacttccatgaacttattatgaaagacggtaggaagctggtggtaccatgccgcccccaggacgagctaatcgggagagcccggatcagccaaggagctggctggtcactgaaagaaaccgcctgtctcggcaaggcatatgctcagatgtggtccttgatgtactttcacaggcgtgatctgcgacttgcctctaacgcaatttgcagcgccgttcctgtgcactggataccaacaagtcgcacaacctggtccatccatgcgcaccatcagtggatgactacagaggacatgctgaccgtctggaatagagtgtggattgaggataacccctggatggaagacaagacgcctgttacaacctgggaggatgtgccgtacctcgggaaacgggaagaccaatggtgtggcagcttaatcggtctgacttctagggctacctgggcccagaatattttgacagcaatccagcaggtccgctcactgataggcgatgaggagttcctcgactatatgccaagtatgaagagatttcggaaagaagaggaatccgagggggccatctggtga

SEQ ID NO: 15566 - RNA, 9873 nt, synthetic construct
  misc_feature 1..9873: note = derived and/or modified CDS sequence (opt3) from DENV-3__EU482457__SS-prME
  source 1..9873: mol_type = other RNA
accagcttctgcctgatgatgatgctccccgccacacttgcttttcacctgacttccagagacggcgagcctaggatgatcgtggggaagaacgaacggggaaaatctttgttattcaagacggcatcaggtattaatatgtgtaccctgatagccatggatctaggcgagatgtgcgacgatacagtcacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccaaacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacattacgaccgatagccggtgccctacacagggcgaagctactttgccagaggaacaggaccagaattatgtctgtaaacacacctacgttgatcgcggttgggggaacggatgcggcctctttggcaaggggagtctggtgacatgcgccaagttccaatgtttagagcccatcgagggaaaagtagtgcagtatgaaaatctgaagtacactgtcataattaccgtgcacacaggtgaccagcatcaggttggcaacgacacccaaggggtgactgtcgagatcacgcctcaggcatccacagtggaagctgtactcccagagtatggaattcttggcctggaatgctctccgcgaaccggtttggattttaatgagatgatcctactgactatgaaaaacaaggcctggatggttcacagacagtggttctttgacctccccctgccttggaccagcggggcgacaaccgagactccaacatggaataggaaagaacttctggtgacgttcaagaacgcccatgcaaaaaagcaagaggtcgtggtcttgggctcccaggaaggagctatgcacaccgccctcactggcgctacagagatccagaattcagggggaaccagtatttttgccggtcacctgaagtgtcggttaaaaatggatcgtctggaactaaagggcatgagctacgcaatgtgcctcaacacattcgtgctgaaaaaggaggtttctgagactcagcatgggaccatacttatcaaagtggaatacaagggagaggacgccccctgtaagattcctttctccacggaagatggccaaggtaaagctcacaacgggcgcttgatcaccgcgaatccagtagtcacaaagaaagaggagcccgtgaacatagaagcagagccgccttttggcgaatcaaatattgttatcggaatcggcgacaaggccctgaaaattaactggtataagaaggggagcagtatcggaaaaatgttcgaggctactgccagaggtgcaaggcggatggccattctcggcgataccgcttgggactttgggtctgtgggaggcgtcctgaattcccttggtaagatggtgcatcagatattcgggagcgcctacacagcactgttttcgggcgtatcttggatcatgaaaattggaatcggcgtgttgctcacttggatcgggctgaactccaagaatacctcaatgagtttcagctgcattgttataggaatcattacgttatatctgggcgcggtcgtgcaggctgatatgggttgtgtgatcaactggaaagggaaggaactaaagtgcggatccggcatttttgtcacaaatgaggttcacacctggactgagcagtacaaattccaagccgactctcccaagcgactcgcaacagccatcgctggtgcctgggaaaacggcgtgtgtgggatacgcagcaccactagaatggagaatctgctttggaaacagatcgcaaacgaattgaattatattctgtgggagaacaatatcaagctcaccgtggtagtcggagatacaattggcgtgctggaacaggggaaaaggacgttaaccccacagcctatggagctgaagtactcatggaaaacttggggaaaggctaagatcgttacagccgagacccaaaacagttcctttataattgacggccccaacacaccagaatgccccagcgcgtctcgggcctggaatgtgtgggaggtcgaagactatggtttcggggtgtttactaccaacatctggcttaaattgcgcgaggtttacacgcagtcatgtgatcatagactcatgagtgctgcaattaaggacgaaagggccgtgcacgctgatatgggatactggatcgagagccagaaaaatggctcctggaagctggagaaagcctctttcatagaagtaaagacatgcacctggcctaagtcgcacactctatggagcaacggtgtcctggagtccgacatgatcattccaaaatcactcgcaggcccgatcagtcagcataatcaccgtcccgggtatcatacccaaacagcgggaccttggcacctgggcaagcttgaattggattttaactactgcgaggggactaccgtggtgattacagagaattgtggaacgcggggcccatctctgcgaaccactacagtcagcggtaaattaatccacgaatggtgctgtagatcctgcaccctcccccctctgaggtatatgggggaggacggatgttggtacggcatggaaatacgcccaattaacgagaaggaagagaatatggttaaatcacttgtgagcgccggttctggcaaggtagataacttcactatgggggtgctgtgcttggctatcctcttcgaggaagtcatgcggggaaagtttggcaaaaagcatatgatcgccggggtgctgttcacatttgttctactgctctccggacagattacctggagagacatggcacacacgctgatcatgattggcagtaatgctagcgataggatgggtatgggggtgacttatcttgccttgatagcaaccttcaaaatccagccctttctggccttaggattctttctccgcaagctgacatctcgagagaaccttctgctaggcgtcggcctcgctatggcgaccactctgcaattgccggaagacattgagcagatggccaatgggatcgcactgggattaatgacactcaaactgattacccagttcgaaacataccagctttggactgctctggtgtccttgacctgttcaaacacgatctttacactcaccgttgcctggcggactgccaccctgatactagctggtgtgagtctgcttcctctctgccaaagctcgtccatgcgtaagacagattggctgccaatgactgtcgcagccatgggcgtaccccctttgcccctgttcatcttttctttaaaggacaccccaaaaagaaggagctggcctctcaatgagggggtgatggcggttggactggtgtcaattcttgctagttccctgttgcgcaacgatgtccccatggccggcccactcgtggcaggtgggctgctaatcgcctgttatgtaattacgggaacatctgctgacctgaccgtggagaaggcagccgacgtcacttgggaagaggaagcggagcagacaggcgttagccataaccttatggtgaccgtggatgacgatggcactatgcggatcaaagacgatgaaacagagaatatactcaccgtcctgttgaagacggctttactgattgtgtccgggatcttcccgtactcaatccctgccactctcctggtttggcacacctggcagaaacagacacaaagaagcggagtactttgggacgtgcccagtccacccgagacccagaaggcagaactggaggaaggtgtctacaggattaaacagcagggcatatttgggaagacacaagtgggagttggcgtgcagaaggagggtgtcttccatactatgtggcacgtgacccgaggggccgtattgacgcacaacggaaaacgcctagagcctaattgggcttctgtcaagaaagatctgatctcctatggcggcgggtggcggctcagcgcccagtggcaaaagggagaagaggtgcaggttattgcagtggaaccaggtaaaaaccccaagaatttccagacaatgcctggcatctttcagactaccacaggggagattggagctatcgccctggacttcaagccgggcacctcgggttcaccaataatcaacagagaagggaaagtcgtgggactttacggcaatggcgttgtgactaagaacgggggatatgtctctggtattgcgcaaaccaatgccgagcccgatggccctacaccagagttagaagaggaaatgtttaaaaagaggaacctgacgatcatggacctccatcccgggagtggaaaaactcgtaagtacttgcctgcaattgtgcgcgaggctatcaagcggagactgaggaccctcatactggccccgacacgagtagtggctgcagaaatggaggaggcccttaaaggcctgcccattcggtatcagaccactgccacaaagtccgaacacaccggtcgcgagatcgttgatttgatgtgccatgctacgttcactatgagactactgagcccagtcagggtgcctaattacaacctcatcattatggacgaagcgcactttacagatcccgcatctatcgccgctcgggggtatataagcacccgagtgggaatgggcgaggccgcagccattttcatgaccgctactccacctggcacagcggaagcctttccccagtccaatgcaccaatccaggacgaggagagagacattccggaacgctcatggaacagtgggaatgagtggatcaccgatttcgtcggaaaaacagtatggtttgtgcctagcataaaggctggtaacgacattgccaactgtttaaggaaaaatggcaagaaggttatccaactgtctcgtaaaactttcgatacggaataccagaagacccggcttaacgactgggattttgtggtcacaactgacatctccgagatgggggcaaatttcaaagccgatagagtgattgaccccaggcgctgcctgaagccagttatcctcaccgatggacccgagcgagtgattttggctggccctatgccagtcacagccgcgtcagcagcccagagacggggtagggtggggcgcaacccccagaaagaaaatgaccaatacatattcaccggccagcctctgaacaatgatgaggaccatgctcactggactgaagccaagatgctcctggacaacatcaatacgccggagggaattatcccagctctttttggccccgaacgtgagaagagtgcagccatcgatggggagtatagactaaaaggagaaagccggaagaccttcgtagagctgatgaggcgcggtgacttgcctgtgtggttagcttacaaagttgcctccgaaggcattaagtatacagatcgaaaatggtgctttgacggggagagaaacaatcagatactggaagagaacatggatgtcgagatctggactaaggaaggagagcggaaaaagctcaggccccgctggctggacgcaagaacctactctgatccacttgcgctgaaggaattcaaagactttgccgctggcaggaagtcgattgccctcgatttggtgacagagatcggtcgggtgcctagccacctggcacatcgtacccgcaatgctctagacaacctggtcatgctccacacttcagaacatgggggccgagcctatagacacgcagttgaggagcttcccgaaacaatggagacgctgttattgctgggactcatgattctgcttaccggcggggccatgctgttcctcatctccggaaaaggtataggcaagactagtatcgggttgatttgtgtgatcgtatctagcggaatgctgtggatggctgatgtgccattacagtggattgcgtccgccatcgtcctagaatttttcatgatggtgctgctcatacctgagccggagaaacaaaggacaccccaggacaatcagcttgcatacgttgtgattggcatcctgaccttggctgccattgtcgccgcaaacgaaatgggtctgctcgagaccacaaagcgggatctggggatgtcaaaggaaccaggcgtagtgtctcctactagctatcttgacgttgacctccaccccgctagtgcctggacgctgtacgcggtggctaccacagtcatcactccaatgttgcgccataccatagagaattccacagccaacgtgagcctggcagccatcgctaaccaagcagtcgtgttaatgggactagataaaggctggcctatttctaagatggacctgggggttcccctccttgccctgggatgctactcacaggtgaatccgttgaccctgactgcggctgtactcctgcttgtgacgcactatgccatcattggcccaggtttacaggcaaaagccacaagagaagctcagaagaggaccgccgcagggatcatgaaaaaccctactgtcgatggaataatgaccattgacctggatcccgttatctacgactccaagtttgagaagcaactcggccaggtgatgttgctggtcctatgtgctgtgcagctgctccttatgcggacaagttgggccctgtgcgaggcgttgactctggccaccggtccaatcacaacgctctgggaaggcagccccgggaaattctggaataccactattgcagtatcgatggctaacatctttcgaggatcttatctggccggcgcagggttagctttctccataatgaagagcgtgggaacaggcagacgcggtaccgggtcacagggagagactcttggcgaaaaatggaagaaaaagctgaatcaactcagtaggaaggagtttgatctatacaaaaagtctggtattacagaagttgaccggaccgaggccaaagagggcctgaagcgtggggaaacgacccatcacgccgtgtccagaggaagcgcgaaattgcagtggttcgtcgagaggaacatggtgatccctgaaggccgcgtcattgatctggggtgtggacggggcggttggtcatattactgcgctgggctcaagaaagtgacagaggttcgaggatatactaagggcggcccggggcatgaagagcccgtaccaatgagtacctacggatggaatatcgtgaagcttatgagcggtaaagacgtcttctacctgcctcccgagaagtgtgatacattgctgtgcgacataggcgaatcctctcctagcccaactgtggaggaatccagaaccatcagggttctcaaaatggtggagccctggttaaagaacaatcagttttgtattaaagtcctgaacccttatatgccaacagtgatcgagcaccttgaacgcctgcagcggaagtacgggggaatgctagtaagaaatcccctctcacgtaactctacccacgagatgtattggattagtaatggcactggtaacatcgtgtcgagcgttaatatggtctccaggctgttgctgaaccggttcacgatgacacatcgccgaccgaccattgaaaaggatgtggacctcggggcaggaactagacacgtgaacgccgagcctgaaaccccaaatatggacgtcatcggcgagaggataaaacggattaaggaggaacattcttcaacatggcactacgatgacgagaacccctataaaacgtgggcttaccacggcagctatgaagttaaggccaccgggtccgcaagttctatgatcaatggagtggtaaaacttctgactaagccttgggatgtggtcccaatggtgacacaaatggccatgaccgacactacaccctttggtcagcagcgcgttttcaaggagaaagtggataccagaacaccgaggcctatgcccggcactcgaaaggtcatggaaatcaccgctgagtggttatggcggacgctggggcgtaacaaaaagccaagattgtgcacccgcgaggaatttacaaaaaaggtgaggactaatgcggccatgggagcagtattcaccgaggaaaaccaatgggacaatgctcgggccgcagttgaggatgaagagttttggaagctcgtggacagagagcgcgaactgcataaactaggcaagtgtggtagctgcgtctacaacatgatggggaaaagggagaagaaacttggagaattcggcaaggccaaaggctcacgagctatttggtacatgtggctgggggcccggtatctcgagtttgaggcgctgggattcttgaatgaagatcactggttttccagagagaacagttacagcggtgtggaaggcgaggggctgcataagctcggatatatacttagggacatctctaagattcctggcggtgcaatgtacgccgatgacacagctgggtgggacactcgcatcaccgaagatgacctgcacaatgaggagaaaattacgcagcagatggatcccgaacatcgtcagttagccaacgcaatcttcaagctgacatatcaaaataaagtggtcaaggttcagcggccaacccccaaaggaactgtgatggacataatctccagaaaggatcagaggggctcaggccaggtagggacatacggattgaacacctttactaatatggaggctcaactcgtgcgccagatggaaggtgagggcgtcctgagcaaggccgacctagaaaaccctcaccttctggagaaaaagattacccagtggctcgagacaaaaggggtggaacgactgaagcggatggctatctcgggagatgactgcgttgtgaaaccaattgatgacagattcgccaacgcattgttagcgctgaatgatatgggcaaggtcaggaaggacatcccgcagtggcaaccctctaaaggttggcacgattggcagcaggtgcctttctgtagtcatcactttcatgagctcataatgaaggacgggcgcaaacttgtagttccatgcagaccccaggacgaactgattggacgggccaggatctcccaaggcgctggctggagcctaaaggagacggcctgtctggggaaagcatatgctcagatgtggtcactcatgtacttccaccgtcgagatttgcgcctggcctccaacgcaatctgctctgccgtgcctgtccactggattccaaccagcagaactacatggagtatacatgcgcaccatcagtggatgaccactgaagacatgcttacagtgtggaatcgggtttggatcgaggataacccctggatggaggacaagacccctgtgacgacatgggaagatgtcccgtacctgggaaagagggaggaccaatggtgtggttccctcattggcttaaccagccgcgctacttgggcccagaatatcctgaccgcaattcagcaggtgagatctttgatcggggatgaagagtttctggactatatgccatcaatgaaacggttcaggaaggaggaagagagtgaaggagccatatggtga

SEQ ID NO: 15567 - RNA, 9873 nt, synthetic construct
  misc_feature 1..9873: note = derived and/or modified CDS sequence (opt3) from DENV-3__EU482458__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttgacgacctttaagaacgcccatgcaaaaaagcaagaggtggtcgtgctcggctcccaggaaggagctatgcacactgccctgacaggcgctaccgagatccagaattcagggggaacaagtattttcgccggtcacttaaagtgtcggctgaaaatggataagctagaactcaaaggcatgagctacgcaatgtgcctgaacacttttgtccttaagaaagaggtgtctgagacccagcatgggacgatattgatcaaggttgaatacaagggagaggacgccccctgtaaaattcctttctccaccgaagatggccaaggtaaggctcacaacgggcgtctgatcacagcgaatccagtggtaactaaaaaggaggagcccgtcaacatagaagcagagccgcctttcggcgaatcaaatattgtgatcggaatcggcgacaaagccctcaagattaactggtataagaaagggagcagtatcggaaagatgtttgaggctaccgcccgcggtgcaagaaggatggccattctgggcgatacagcttgggacttcgggtctgttggaggcgtgcttaattccctgggtaaaatggtccatcagatatttgggagcgcctacactgcattgttctcgggcgtgtcttggatcatgaagattggaatcggcgtactcctgacctggatcgggttaaactccaaaaatacgtcaatgagttttagctgcattgtgataggaatcattacactgtatctaggcgcggttgtccaggctgatatgggttgtgccatcaactggaaggggaaggaactcaaatgcggatccggcattttcgtgaccaatgaggtgcacacttggacagagcagtacaagtttcaagcagactctcccaaacggctggccaccgctatcgccggtgcatgggaaaacggcgtctgtgggatacgaagcactacccgcatggagaatcttttgtggaagcagatcgctaacgaactgaattatattctctgggagaacaatatcaaactgacagttgtggtgggagatattatcggcgtattagaacaggggaagagaacgctgaccccacagcctatggagcttaaatactcatggaagacttggggaaaggccaaaatagtcacagcggagacccaaaacagttccttcattatcgacggccccaacacaccagaatgccccagcgcctctagggcttggaatgtgtgggaggttgaagactatggttttggggtgttcactaccaacatttggttgaagctccgggaggtctacacgcagtcatgtgatcatcgcctgatgagtgcagccatcaaagacgaaagagctgtgcacgccgatatgggatactggatagagagccagaagaatggctcctggaaactagagaaggcatcttttatcgaagttaagacatgcacctggcctaaatcgcacactctgtggagcaacggtgtgctcgagtccgacatgattatcccaaagtcactggcgggcccgattagtcagcataatcacaggcccgggtatcatacccaaacagccggaccttggcaccttggcaaattggaactggatttcaactactgcgaggggactaccgtagtcatcacagagaattgtggaatgcgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtgaagtcactggtcagcgctggttctggcaaggttgataactttaccatgggggtgttgtgcctcgccatcctgttcgaggaagtaatgcgcggaaaattcggcaagaaacatatgattgcaggggtgctatttactttcgtcctgctcctgtccggacagatcacatggcgggacatggctcacacccttattatgataggcagtaatgccagcgatagaatgggtatgggggtgacgtatttggcactgatcgccacttttaagattcagcccttcttagctctcggatttttcctgaggaaacttacctctcgcgagaacctgctactcggcgttggcctggcgatggccacaaccttgcaactgccggaagacatcgagcagatggcaaatgggattgctttaggactcatgactctgaagcttatcacacagtttgaaacctaccagctgtggacagccttggtgtccctcacttgttcaaacaccatattcacgctgacagtcgcctggcgaaccgctactctaatcctggcaggtgtgagtcttctccctctgtgccaaagctcgtccatgcggaagaccgattggttgccaatgacagttgccgcgatgggcgtgccccctctgcccttatttattttctctctcaaagacactccaaagcgtagaagctggcctctgaatgagggggtcatggctgtaggacttgtgtcaatcctggccagttccttgctcaggaacgatgttcccatggcaggcccactggtggccggtgggctactgattgcttgttatgtcatcaccggaacgtctgcagaccttacagtggagaaagccgcggacgtaacctgggaagaggaagctgagcagactggcgtgagccataacctcatgataacagtcgatgacgatggcaccatgcgcattaaggacgatgaaactgagaatatcctgacagttttgttaaaaaccgccctgctcatcgtgtccgggatttttccgtactcaatacctgcaacgctgcttgtgtggcacacttggcagaagcagacccaacggagcggagtcctgtgggacgtgcccagtccacccgagacacagaaagccgaattggaggaaggtgtttacagaatcaagcagcagggcattttcgggaagacccaagtaggagtgggcgtccagaaagagggtgtgtttcatacaatgtggcacgttactaggggggctgtgctaacccacaacggaaagcgactggagcctaattgggcctctgtcaaaaaggatctcatctcctatggcggcgggtggcgcctgagcgcacagtggcaaaaaggagaagaggtgcaggtaattgctgtcgaaccaggtaagaaccccaagaatttccagacgatgcctggcatcttccagacaactaccggggagataggagccatcgcgcttgactttaaaccgggcacatcgggttcaccaattatcaaccgggaagggaaggtggttggattatacggcaatggcgtggtcaccaaaaacgggggatatgtgtctggtattgcccaaactaatgcagagcccgatggccctaccccagagctggaagaggaaatgttcaagaaaagaaacctcacaatcatggacttgcatcccgggagtggaaagacgaggaagtacctgcctgctatagttcgtgaggccattaaacgccggctcagaactctgatccttgctccgaccagggtggtcgcagccgaaatggaggaggccctgaagggcttgcccatccgatatcagacaaccgctactaaatccgaacacacaggtcgggagattgtggatctaatgtgccatgcgacctttacgatgcgcctgctcagcccagtaagagtgcctaattacaacttaatcataatggacgaagcacacttcactgatcccgcctctattgctgccagggggtatatcagcacacgggttggaatgggcgaggcagccgctatttttatgaccgcgaccccacctggcactgccgaagcattcccccagtccaatgctccaatccaggacgaggagcgagacataccggaaagatcatggaacagtgggaatgagtggattacagattttgtcggaaagaccgtgtggttcgtgcctagcatcaaagccggtaacgacatcgcaaactgtctgcgcaagaatggcaagaaagtcattcaactttctaggaagacatttgatactgaataccagaaaacgcgtctgaacgactgggatttcgtagtgaccacagacatctccgagatgggggccaattttaaggctgatcgggttattgaccccagaaggtgcctcaaaccagtgatattgactgatggacccgagcgcgtcatcctggccggccctatgccagtgaccgcggcatcagccgctcagcgaagaggtcgggttgggaggaacccccagaaggaaaatgaccaatacattttcacaggccagcctctcaacaatgatgaggaccatgcccactggaccgaagctaagatgctgcttgacaacatcaatactccggagggaatcattccagcactattcgaacccgagcgcgagaaaagtgccgctatagatggcgaatatcgtctgaagggggagagcagaaaaacgtttgtggaattgatgcggaggggagacttacctgtctggctggcccacaaggtggcatccgagggtatcaaatacaccgatcgcaagtggtgcttcgacggcgaacgaaacaatcagattctcgaggagaacatggatgtagaaatctggacaaaagagggggaaagaaagaagctgcggcccaggtggcttgacgcgcgcacttattctgatccactggccctcaaagagtttaaggacttcgctgccggaagaaaatcgattgcattggatctggtgaccgaaatcggcagggttcctagccatctagcttaccggacacgtaatgccctggacaacctcgtcatgcttcacacctcagagcatggtgggcgcgcatatcgacacgccgtggaggaactgcccgagactatggaaacattattgctgctcggcctgatgatacttctgacgggaggcgctatgctctttttgatctccgggaagggaattggtaaaaccagtatcggcctgatttgtgtgatcgtctctagcgggatgttatggatggcggatgttccactacagtggatagcctccgcaattgtgctggagttctttatgatggtactccttatccctgagccggaaaagcaaagaactccccaggacaatcagctggcttacgtggtcattggaatcttgacactggccgccatagtggcagctaacgagatgggcctcctggaaaccaccaagagggatcttggtatgtcaaaagagccaggggttgtgtctcctacaagctatctcgacgtcgacctgcaccccgccagtgcgtggactttgtacgctgtagccacgaccgtgatcacaccaatgctgcggcatactattgaaaattccaccgcaaacgttagcttagccgctatcgcaaaccaagccgtggtcctaatgggcctggataagggatggcctatttctaaaatggacctcggcgtgccccttctggcgttggggtgctactcacaggtcaatccgctgacactcaccgctgccgtgctgcttttagttactcactatgcaatcataggaccaggcctgcaggccaaggctacgcgcgaggcccagaaaagaacagcagctggtattatgaagaaccctaccgtggatgggatcatgactatcgacctcgatcccgtaatttacgactccaagttcgagaaacaattgggacaggtgatgctgctagtcctgtgtgccgttcagctccttctgatgaggaccagttgggcgttgtgcgaagccctgacactcgcaactggcccaatcaccacactgtgggagggtagccccggcaagttttggaatacgaccatagctgtgtcgatggccaacattttccgggggtcttatttagcaggagctggccttgccttttccatcatgaaaagcgtcgggactggacgaagaggcacaggttcacagggggaaaccctgggagagaagtggaaaaagaagctcaatcaactaagtcgcaaagaattcgatctgtacaagaaatctggcattactgaggtggacaggacagaggccaaggaaggtttgaaacggggcgagaccacgcatcacgcggtatcccgtgggagcgctaagctgcagtggtttgtggaaagaaacatggttatccctgagggaagggtgatagatctcggctgtgggcgcggaggctggtcatattactgcgcaggtcttaaaaaggtcaccgaagtgcgggggtatacaaagggaggcccgggccatgaggagcccgtcccaatgagtacttacgggtggaatatcgtgaaactgatgagcggaaaggacgttttctacttgcctcccgaaaaatgtgataccctgctctgcgacattggtgagtcctctcctagcccaacagtagaagagtcccgaactatcagagtgttaaagatggtcgagccctggctgaaaaacaatcagttctgtattaaggtgcttaacccttatatgccaaccgttatcgaacacctggagaggctacagcgcaagtacggcgggatgctcgtgcggaatcccctgtcaagaaactctacacacgaaatgtattggattagtaatggaaccggcaacatcgtctcgagcgtgaatatggtatcccgtttgctgctcaacaggtttactatgacgcatcggcgcccgacaatagagaaagatgtggaccttggtgccgggacccgacacgttaacgctgaacctgagactccaaatatggacgtcattggagagagaatcaagaggatcaaagaagagcattcttcaacctggcactacgatgacgaaaacccctataagacatgggcctaccacggcagctatgaggtgaaagcaacgggctccgccagttctatgattaatggggtggtcaagctgttaaccaagccttgggatgttgtgccaatggtaactcaaatggctatgacagacaccactcccttcggacagcagcgggtgtttaaagaaaaggtcgatacacgcaccccgagacctatgcccggtacaaggaaagtgatggagataactgcggagtggctgtggcgaaccttgggccggaacaagaaaccacgtctctgcacgagagaagagttcaccaagaaggttcgcacaaatgccgcaatgggggctgtgtttactgaagagaaccaatgggacagcgccagggcagccgtcgaagatgaggagttctggaaactggtggaccgggaaagagagctacataagcttggaaaatgtggctcatgcgtatacaatatgatgggtaagcgcgaaaaaaagctgggggagtttggaaaagctaagggctccagggccatctggtacatgtggctcggcgcgcgatatctggagttcgaagcattggggtttctgaacgaggatcactggttcagtcgggaaaatagctactctggagttgagggtgaaggcctccataagcttgggtatattctgagagacatctccaaaattcctggaggcgccatgtacgctgatgacaccgccggttgggacacaaggatcactgaggatgacttacacaacgaggaaaagataacccagcagatggatcccgagcatcgccagctggcaaatgctatctttaaattgacgtatcaaaacaaggtggtcaaagtgcagcgtccaacacccaaggggaccgtgatggacattatctcacggaaggatcagagaggaagcggccaggtcggcacttacgggctcaatacattcaccaacatggaagcccaactggttaggcagatggagggagaaggtgtgctatcgaaagctgaccttgagaatcctcacctgctcgagaagaaaattactcagtggctggaaaccaagggcgtagagcgcttgaaacgaatggccatctctggggatgactgcgtggtcaagccaatagatgaccggtttgcaaacgcgttactggccctcaacgatatgggaaaggtgagaaaagacattccgcagtggcaacccagtaagggctggcacgattggcagcaggttcctttctgttcccatcacttccatgaacttatcatgaaagacggtaggaagctggtggtcccatgccgcccccaggacgagctaatcgggagagctcggattagccaaggagccggctggtcactgaaagaaacagcatgtctcggcaaggcttatgcccagatgtggtccttgatgtactttcacaggcgtgatctgcgacttgcatctaatgccatatgcagcgcggtgcctgtacactggatcccaacgagtcgcaccacttggtccattcatgctcaccatcagtggatgacaaccgaggacatgctgactgtttggaacagagtgtggatcgaggataatccctggatggaagacaagacacctattaccacgtgggaggatgtcccgtacctcgggaaacgggaagaccaatggtgtggaagcttaatcggtctgacatctagggccacctgggcacagaacatattgactgccatccagcaggtgcgctcactgattggcgatgaggagttcctcgactatatgccaagtatgaagagatttcggaaagaagaggaatccgagggggctatctggtga

SEQ ID NO: 15568 - RNA, 9873 nt, synthetic construct
  misc_feature 1..9873: note = derived and/or modified CDS sequence (opt3) from DENV-3__EU482459__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaatgccagcgatagaatgggtatgggggttacgtatttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaagcttatcacacagtttgaaacctaccagctgtggacagccttggtctccctcacttgttcaaacaccatattcacgctgacagtggcctggcgaaccgctactctaatcctggcaggtgttagtcttctccctctgtgccaaagctcgtccatgcggaagaccgattggttgccaatgacagtggccgcgatgggcgtcccccctctgcccttatttattttctctctcaaagacactccaaagcgtagaagctggcctctgaatgagggggtaatggctgtgggacttgtttcaatcctggccagttccttgctcaggaacgatgtgcccatggcaggcccactggtcgccggtgggctactgattgcttgttatgtgatcaccggaacgtctgcagaccttacagtagagaaagccgcggacgtgacctgggaagaggaagctgagcagactggcgtcagccataacctcatgataacagttgatgacgatggcaccatgcgcattaaggacgatgaaactgagaatatcctgacagtgttgttaaaaaccgccctgctcatcgtgtccgggatttttccgtactcaatacctgcaacgctgcttgtctggcacacttggcagaagcagacccaacggagcggagtgctgtgggacgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaacggaaagcgactggagcctaattgggcctctgtgaaaaaggatctcatctcctatggcggcgggtggcgcctgagcgcacagtggcaaaaaggagaagaggtacaggtcattgctgtggaaccaggtaagaaccccaagaatttccagacgatgcctggcatcttccagacaactaccggggagataggagccatcgcgcttgactttaaaccgggcacatcgggttcaccaattatcaaccgggaagggaaggttgtgggattatacggcaatggcgtcgtgaccaaaaacgggggatatgtttctggtattgcccaaactaatgcagagcccgatggccctaccccagagctggaagaggaaatgttcaagaaaagaaacctcacaatcatggacttgcatcccgggagtggaaagacgaggaagtacctgcctgctatagtgcgtgaggccattaaacgccggctcagaactctgatccttgctccgaccagggtcgtggcagccgaaatggaggaggccctgaagggcttgcccatccgatatcagacaaccgctactaaatccgaacacacaggtcgggagattgtagatctaatgtgccatgcgacctttacgatgcgcctgctcagcccagtgagagttcctaattacaacttaatcataatggacgaagcacacttcactgatcccgcctctattgctgccagggggtatatcagcacacgggtcggaatgggcgaggcagccgctatttttatgaccgcgaccccacctggcactgccgaagcattcccccagtccaatgctccaatccaggacgaggagcgagacataccggaaagatcatggaacagtgggaatgagtggattacagattttgtgggaaagaccgtgtggttcgtccctagcatcaaagccggtaacgacatcgcaaactgtctgcgcaagaatggcaagaaagtaattcaactttctaggaagacatttgatactgaataccagaaaacgcgtctgaacgactgggatttcgtggttaccacagacatctccgagatgggggccaattttaaggctgatcgggtgattgaccccagaaggtgcctcaaaccagtcatattgactgatggacccgagcgcgtgatcctggccggccctatgccagttaccgcggcatcagccgctcagcgaagaggtcgggtggggaggaacccccagaaggaaaatgaccaatacattttcacaggccagcctctcaacaatgatgaggaccatgcccactggaccgaagctaagatgctgcttgacaacatcaatactccggagggaatcattccagcactattcgaacccgagcgcgagaaaagtgccgctatagatggcgaatatcgtctgaagggggagagcagaaaaacgtttgtcgaattgatgcggaggggagacttacctgtgtggctggcccacaaggtagcatccgagggtatcaaatacaccgatcgcaagtggtgcttcgacggcgaacgaaacaatcagattctcgaggagaacatggatgtggaaatctggacaaaagagggggaaagaaagaagctgcggcccaggtggcttgacgcgcgcacttattctgatccactggccctcaaagagtttaaggacttcgctgccggaagaaaatcgattgcattggatctggttaccgaaatcggcagggtccctagccatctagcttaccggacacgtaatgccctggacaacctcgtgatgcttcacacctcagagcatggtgggcgcgcatatcgacacgccgtggaggaactgcccgagactatggaaacattattgctgctcggcctgatgatacttctgacgggaggcgctatgctctttttgatctccgggaagggaattggtaaaaccagtatcggcctgatttgtgtcatcgtttctagcgggatgttatggatggcggatgtgccactacagtggatagcctccgcaattgtactggagttctttatgatggtgctccttatccctgagccggaaaagcaaagaactccccaggacaatcagctggcttacgtcgtgattggaatcttgacactggccgccatagttgcagctaacgagatgggcctcctggaaaccaccaagagggatcttggtatgtcaaaagagccaggggtggtctctcctacaagctatctcgacgtagacctgcaccccgccagtgcgtggactttgtacgctgtggccacgaccgttatcacaccaatgctgcggcatactattgaaaattccaccgcaaacgtgagcttagccgctatcgcaaaccaagccgtcgtgctaatgggcctggataagggatggcctatttctaaaatggacctcggcgtcccccttctggcgttggggtgctactcacaggtgaatccgctgacactcaccgctgccgttctgcttttagtgactcactatgcaatcataggaccaggcctgcaggccaaggctacgcgcgaggcccagaaaagaacagcagctggtattatgaagaaccctaccgtagatgggatcatgactatcgacctcgatcccgtgatttacgactccaagttcgagaaacaattgggacaggtcatgctgctagttctgtgtgccgtgcagctccttctgatgaggaccagttgggcgttgtgcgaagccctgacactcgcaactggcccaatcaccacactgtgggagggtagccccggcaagttttggaatacgaccatagctgtctcgatggccaacattttccgggggtcttatttagcaggagctggccttgccttttccatcatgaaaagcgtggggactggacgaagaggcacaggttcacagggggaaaccctgggagagaagtggaaaaagaagctcaatcaactaagtcgcaaagaattcgatctgtacaagaaatctggcattactgaggtagacaggacagaggccaaggaaggtttgaaacggggcgagaccacgcatcacgcggtgtcccgtgggagcgctaagctgcagtggtttgttgaaagaaacatggtgatccctgagggaagggtcatagatctcggctgtgggcgcggaggctggtcatattactgcgcaggtcttaaaaaggtgaccgaagtccgggggtatacaaagggaggcccgggccatgaggagcccgtgccaatgagtacttacgggtggaatctggttaaattgatgagcggaaaggacgtattctacctgcctcccgaaaaatgtgataccctcttatgcgacatcggtgagtcctctcctagcccaacagtggaagagtcccgaactattagagtcctgaagatggtggagccctggcttaaaaacaatcagttctgtatcaaggttctgaacccttatatgccaaccgtgattgaacacctagagaggctccagcgcaagtacggcgggatgctggtccggaatcccttgtcaagaaactctacacacgaaatgtattggatcagtaatggaaccggcaacattgtgtcgagcgtaaatatggtgtcccgtctgctccttaacaggtttactatgacgcatcggcgcccgacaatcgagaaagatgttgacctgggtgccgggacccgacacgtcaacgctgaacctgagactccaaatatggacgtgataggagagagaattaagaggatcaaagaagagcattcttcaacctggcactacgatgacgaaaacccctataagacatgggcctaccacggcagctatgaggtgaaagcaacgggctccgccagttctatgatcaatggggtcgttaagttactgaccaagccttgggatgtggtaccaatggtgactcaaatggctatgacagacaccactcccttcggacagcagcgggtctttaaagaaaaggtggatacacgcaccccgagacctatgcccggtacaaggaaagttatggagattactgcggagtggttgtggcgaaccctcggccggaacaagaaaccacgtctgtgcacgagagaagagttcaccaagaaggtgcgcacaaatgccgcaatgggggctgtctttactgaagagaaccaatgggacagcgccagggcagccgtggaagatgaggagttctggaaactagtagaccgggaaagagagcttcataagctgggaaaatgtggctcatgcgtttacaatatgatgggtaagcgcgaaaaaaagctcggggagtttggaaaagctaagggctccagggccatatggtacatgtggctgggcgcgcgatatttggagttcgaagcactggggtttctcaacgaggatcactggttcagtcgggaaaatagctactctggagtggagggtgaaggccttcataagctggggtatatcttaagagacatttccaaaatccctggaggcgccatgtacgctgatgacaccgccggttgggacacaaggattactgaggatgacctgcacaacgaggaaaagatcacccagcagatggatcccgagcatcgccagttggcaaatgctatatttaaactcacgtatcaaaacaaggtcgtgaaagtgcagcgtccaacacccaaggggaccgtcatggacatcatttcacggaaggatcagagaggaagcggccaggttggcacttacgggctgaatacattcaccaacatggaagcccaactagtgaggcagatggagggagaaggtgtactttcgaaagctgacctggagaatcctcacctcctggagaagaaaatcactcagtggttggaaaccaagggcgtggagcgcttaaaacgaatggccatttctggggatgactgcgtcgtgaagccaatcgatgaccggtttgcaaacgcgctgctcgcccttaacgatatgggaaaggttagaaaagacataccgcagtggcaacccagtaagggctggcacgattggcagcaggtgcctttctgttcccatcacttccatgaactgattatgaaagacggtaggaagctagtcgtgccatgccgcccccaggacgagctgatcgggagagctcggatcagccaaggagccggctggtcactcaaagaaacagcatgtttgggcaaggcttatgcccagatgtggtccctgatgtactttcacaggcgtgatcttcgactggcatctaatgccatttgcagcgcggtacctgttcactggataccaacgagtcgcaccacttggtccatccatgctcaccatcagtggatgacaaccgaggacatgctcactgtgtggaacagagtctggattgaggataatccctggatggaagacaagacacctgtgaccacgtgggaggatgttccgtacttagggaaacgggaagaccaatggtgtggaagcctgatcggtttgacatctagggccacctgggcacagaacattctgactgccatccagcaggtgcgctcactcataggcgatgaggagttccttgactatatgccaagtatgaagagatttcggaaagaagaggaatccgagggggctatctggtga

SEQ ID NO: 15569 - RNA, 9873 nt, synthetic construct
  misc_feature 1..9873: note = derived and/or modified CDS sequence (opt3) from DENV-3__EU482460__SS-prME
  source 1..9873: mol_type = other RNA
accagcctgtgcctcatgatgatgcttcccgccacattcgcttttcacctgacttccagagacggcgagcctaggatgatcgtggggaagaacgaacggggaaaatctttgttattcaagacggcatcaggtattaatatgtgtaccctgatagccatggatctaggcgagatgtgcgacgatacagtcacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccaaacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacattacgaccgatagccggtgccctacacagggcgaagctatcttgccagaggaacaggaccagaattatgtctgtaaacacacttacgttgatcgcggttgggggaacggatgcggcctctttggcaaggggagtctggtgacctgcgccaagttccaatgtttagagcccatagagggaaaagtagtgcagtatgaaaatctgaagtacacagtcattatcactgtgcacaccggtgaccagcatcaggttggcaacgacacacaaggggtgaccgtcgagattactcctcaggcatccacggtggaagctgtactcccagagtatggaacacttggcctggaatgctctccgcgaaccggtttggattttaatgagatgatcctactgactatgaaaaacaaggcctggatggttcacagacagtggttctttgacctccccctgccttggaccagcgggacaaccactgagacaccaacgtggaataggaaagaacttctggtgaccttcaagaacgcgcatgccaaaaagcaagaggtcgtggtcttgggctcccaggaaggagcaatgcacactgctctcacaggcgccaccgagatccagaattcagggggaacaagtatttttgctggtcacctgaagtgtcggttaaaaatggataagctggaactaaaaggcatgagctacgccatgtgcctcaacactttcgtgctgaagaaagaggtttctgagacccagcatgggacgatacttatcaaggtggaatacaagggagaggacgcaccctgtaaaattcctttctccaccgaagatggccaaggtaaggcccacaacgggcgtttgatcacagctaatccagtagtcactaaaaaggaggagcccgtgaacatagaagcggagccgccttttggcgaatcaaatattgttatcggaatcggcgacaaagcactgaagattaactggtataagaaagggagcagtatcggaaagatgttcgaggccaccgctcgcggtgccagaaggatggcaattctcggcgatacagcctgggactttgggtctgtgggaggcgtcctgaattcccttggtaaaatggtgcatcagatattcgggagcgcttacactgccctgttttcgggcgtatcttggatcatgaagattggaatcggcgtgttgctcacctggatcgggctgaactccaaaaatacgtcaatgagtttcagctgcattgttataggaatcattacattatatctgggcgcagtcgtgcaggcggatatgggttgtgctatcaactggaaggggaaggaactaaaatgcggatccggcatttttgtgaccaatgaggtccacacttggacagagcagtaccggttccaagccgactctcccaagcgactcgcaaccgccatcgctggtgcctgggaaaacggcgtttgtgggatacgcagcactaccagaatggagaatctgctttggaaacagatcgcaaacgaattgaattatattctgtgggagaacaatatcaagctcacagtggtggtaggagatattatcggcgtcctggaacaggggaaaagggctttagccccacagcctatggagctgaagtactcatggaaaacgtggggaaaggcgaagatagtgaccgccgagactcaaaacagttcctttattatcgacggccccaacacaccagaatgccccagcgcttctcgggcatggaatgtttgggaggtggaagactatggtttcggggtctttaccacaaacatttggcttaaattgcgcgaggtgtacactcagtcatgtgatcatagactcatgagtgccgctatcaaggacgaaagggccgttcacgcagatatgggatactggatagagagccagaaaaatggctcctggaagctggagaaagcgtctttcatcgaagtgaagacctgcacgtggcctaagtcgcacacactatggagcaacggtgtactggagtccgacatgattatcccaaaatcactcgccggcccgattagtcagcataatcaccgtcccgggtatcatacccaaactgctggaccttggcacctgggcaagcttgaattggattttaactactgcgaggggaccacagtcgtgatcactgagaattgtggaacccggggcccatctctgcgaacaacgaccgtgagcggtaaattaatacacgaatggtgctgtagatcctgcactctcccccctctgaggtatatgggggaggacggatgttggtacggcatggaaattcgcccaatcaacgagaaggaagagaatatggtcaaatcacttgttagcgccggttctggcaaggtggataacttcacaatgggggtactgtgcttggcaatcctcttcgaggaagtgatgcggggaaagtttggcaaaaagcatatgattgctggggtcctgttcacctttgtgctactgctctccggacagatcacttggagagacatggcccacacactgattatgataggcagtaatgcaagcgataggatgggtatgggggttacctatcttgccttgatcgctacgttcaaaattcagccctttctggcgttaggattctttctccgcaagctgacttctcgagagaaccttctgctaggcgtgggcctcgccatggcaaccacactgcaattgccggaagacatcgagcagatggctaatgggattgccctgggattaatgaccctcaaactgatcactcagttcgaaacataccagctttggaccgccctggtctccttgacatgttcaaacactatatttaccctcacggtggcttggcggacagcaaccctgatcctagccggtgttagtctgcttcctctctgccaaagctcgtccatgcgtaagactgattggctgccaatgaccgtggcggctatgggcgtcccccctttgcccctgttcattttttctttaaaggacacaccaaaaagaaggagctggcctctcaatgagggggtaatggccgtgggactggtttcaatccttgcaagttccctgttgcgcaacgatgtgcccatggccggcccactcgtcgctggtgggctgctaattgcatgttatgtgatcactggaacctctgccgacctgacggtagagaaggcggctgacgtgacatgggaagaggaagccgagcagaccggcgtcagccataaccttatgataactgttgatgacgatggcacaatgcggattaaagacgatgaaaccgagaatatcctcactgtgctgttgaagacagcattactgatcgtgtccgggattttcccgtactcaatacctgccaccctcctggtctggcacacgtggcagaaacagactcaaagaagcggagtgctttgggacgttcccagtccacccgagacccagaaggctgaactggaggaaggtgtatacaggatcaaacagcagggcatttttgggaagacacaagtgggagtcggcgtgcagaaggagggtgttttccataccatgtggcacgtgacacgaggggccgtcttgactcacaacggaaaacgcctagagcctaattgggcatctgtgaagaaagatctgatctcctatggcggcgggtggcggctcagcgctcagtggcaaaagggagaagaggtacaggtcattgccgtggaaccaggtaaaaaccccaagaatttccagaccatgcctggcatctttcagacgacaatgggggagataggagcgatcgccctggacttcaagccgggcacttcgggttcaccaattatcaacagagaagggaaagttgtgggactttacggcaatggcgtcgtgaccaagaacgggggatatgtttctggtattgcacaaacaaatgctgagcccgatggccctaccccagagttagaagaggaaatgtttaaaaagaggaacctgactatcatggacctccatcccgggagtggaaaaacccgtaagtacttgcctgccatagtgcgcgaggctattaagcggagactgaggacactcatcctggcaccgacgcgagtcgtggccgccgaaatggaggaggctcttaaaggcctgcccatccggtatcagactaccgcgacaaagtccgaacacaccggtcgcgagattgtagatttgatgtgccatgcaactttcacaatgagactactgagcccagtgagggttcctaattacaacctcatcataatggacgaagcccactttaccgatcccgcttctattgccgcacgggggtatatcagcacgcgagtcggaatgggcgaggccgctgcgattttcatgactgccacaccacctggcaccgcagaagcttttccccagtccaatgccccaatccaggacgaggagagagacataccggaacgctcatggaacagtgggaatgagtggattaccgatttcgtgggaaaaactgtgtggtttgtccctagcatcaaggcaggtaacgacatcgccaactgtttaaggaaaaatggcaagaaggtaattcaactgtctcgtaaaacattcgataccgaataccagaagacacggcttaacgactgggattttgtggttactacggacatctccgagatgggggctaatttcaaagccgatagagtgattgaccccaggcgctgcctgaagccagtcatactcaccgatggacccgagcgagtgatcttggcgggccctatgccagttacagcagcctcagctgcccagagacggggtagggtggggcgcaacccccagaaagaaaatgaccaatacattttcactggccagcctctgaacaatgatgaggaccatgctcactggaccgaagcaaagatgctcctggacaacatcaatacaccggagggaatcattccagccctttttgaacccgagcgtgagaagagtgctgccatagatggcgaatatagactaaaaggggagagccggaagaccttcgtcgaactgatgaggcgcggagacttgcctgtgtggttagcacacaaagtagcgtccgagggtatcaagtacactgatcgaaaatggtgctttgacggcgaaagaaacaatcagattctggaggagaacatggatgtggaaatctggacgaaggagggggaacggaaaaagctcaggccccgctggctggacgccagaacctattctgatccacttgctctgaaggagttcaaagactttgccgcaggaaggaagtcgattgctctcgatttggttacagaaatcggccgggtccctagccatctggcctaccgtactcgcaatgcactagacaacctggtgatgctccacacctcagagcatggtgggcgagcctatagacacgctgtggaggaacttcccgagacaatggaaaccctgttattgctgggcctcatgatactgcttactggaggcgcgatgctgttcctcatctccgggaaaggaattggtaagacaagtatcggcttgatttgtgtcatcgtttctagcgggatgctgtggatggccgatgtgccattacagtggatagcatccgctattgtactagagtttttcatgatggtgctgctcatccctgagccggaaaaacaaaggacgccccaggacaatcagcttgcctacgtcgtgattggaatcctgaccttggccgcaatagttgctgccaacgagatgggcctgctcgaaactacaaagcgggatctgggtatgtcaaaggagccaggggtggtctctcctaccagctatcttgacgtagacctccaccccgcgagtgcttggaccctgtacgccgtggcaacaactgttatcacgccaatgttgcgccataccattgaaaattccacagccaacgtgagcctggctgcaatcgccaaccaagcggtcgtgttaatgggcctagataaaggatggcctatttctaagatggacctgggcgtccccctccttgctctggggtgctactcacaggtgaatccgttgactctgaccgccgcagttctcctgcttgtgacacactatgccatcataggaccaggcttacaggctaaagccaccagagaggcacagaagaggactgctgccggtattatgaaaaaccctacggtagatgggatcatgacaatcgacctggatcccgtgatttacgacccaaagtttgagaagcaactcggacaggtcatgttgctggttctatgtgcggtgcagctgctccttatgcggacctcctgggccctgtgcgaagcattgactctggctaccggccccatcacaactctctgggagggtagtcctggcaaattctggaataccacaatagccgtcagcatggcaaacatttttcgagggtcgtatctggctggagccggcttagccttctctatcatgaagtccgtggggacgggaagacgcggcaccggtagccagggggaaactcttggagagaaatggaagaaaaagctgaatcaactctcaaggaaggaatttgatctatacaaaaagagtggcattacagaggtagaccggaccgaggcgaaagaaggtctgaagcgtggcgagactacacatcacgctgtgtctagagggtccgcaaaattgcagtggttcgttgaaaggaacatggtgatcccggagggacgcgtcatagatctgggctgtgggcggggaggctggagctattactgcgccggtctcaagaaagtgaccgaagtccgagggtatacgaagggaggccccggccatgaggagccagtgcctatgtcaacctacgggtggaatatcgttaagcttatgagtggaaaagacgtattctacctgccccctgaaaagtgtgatacattgctgtgcgacattggtgagagctccccatctcccactgtggaagagagcagaaccatcagggtcctcaaaatggtggagccttggttaaagaacaatcagttttgtattaaagttctgaacccatatatgcccacagtgatcgaacaccttgagcgcctgcagcggaagtacggcgggatgctagtcagaaatccgctctcccgtaactcaactcacgaaatgtattggatttctaatggaaccggcaacatcgtgagttcggtaaatatggtgagcaggctgttgctgaaccggttcacaatgacccatcgccgacctactatagagaaggatgttgacctcggtgctgggacgagacacgtcaacgccgaaccagagacacccaatatggacgtgattggagagaggatcaaacggatcaaggaagagcattcctctacctggcactacgatgacgaaaacccttataaaacttgggcataccacggctcatatgaggtgaaggccaccggcagcgcttccagtatgattaatggggtcgttaaacttctgacaaagccatgggatgtggtacccatggtgacgcaaatggcgatgaccgacactacaccgtttggacagcagcgcgtcttcaaggaaaaagtggataccagaactcctaggcccatgccaggtacacgaaaggttatggagataaccgccgagtggttatggcggacactgggccgtaacaaaaagcctagattgtgcactcgcgaagagtttaccaaaaaggtgaggacgaatgcagctatgggggccgtcttcaccgaagagaaccaatgggactctgcacgggccgctgtggaagatgaggagttttggaagctcgtagacagagaacgcgagctgcataaactaggaaagtgtggcagctgcgtttacaatatgatgggtaaaagggaaaagaaacttggggagttcggaaaggccaaaggctcacgagcgatctggtacatgtggctgggcgcacggtatctcgagtttgaagccctggggttcttgaacgaggatcactggttttccagagaaaatagttacagcggagtggagggtgaaggcctgcataagctcgggtatattcttagggacatctctaagattcccggaggcgctatgtacgccgatgacacagcaggttgggacactcgcatcaccgaggatgacctgcacaacgaggaaaaaataacacagcagatggatccagagcatcgtcagttagctaatgccatcttcaagctgacttatcaaaacaaagtcgtgaaggtgcagcggcccacccctaaagggacggtcatggacattatctccagaaaggatcagaggggatcaggccaggttggcacatacgggttgaatacctttactaacatggaagctcaactcgtgcgccagatggagggagaaggtgtactgagcaaggccgacctagagaatccacaccttctggagaaaaagattacacagtggctcgaaaccaaaggcgtggagcgactgaagcggatggcaatctcgggggatgactgcgtcgtgaaaccgatagatgacagattcgcgaacgccttgttagctctgaacgatatgggaaaggttaggaaggacattccccagtggcaaccttctaaaggctggcacgattggcagcaggtgccattctgtagtcatcactttcatgaactcatcatgaaggacggtcgcaaacttgtcgtgccctgcagacctcaggacgagctgatcgggcgggccaggatttcccaaggagcaggctggagcctaaaggaaactgcttgtctgggcaaagcctatgcacagatgtggtcactcatgtacttccaccgtcgagatttgcgcctggcctccaatgcgatatgctctgctgtaccagttcactggatccccaccagcagaacaacgtggagtattcatgcccaccatcagtggatgaccactgaggacatgcttacagtgtggaaccgggtctggatcgaggataatccttggatggaagacaagaccccggtgactacatgggaggatgttccatacctggggaagagggaagaccaatggtgtggatccctcattggtttaaccagccgcgcaacgtgggcccagaacatcctgacagctatacagcaggtgagatctttgatcggcgatgaggagtttctggactatatgccctcaatgaaacggttcaggaaggaagaggaaagtgagggggccatttggtga

SEQ ID NO: 15570 - RNA, 9873 nt, synthetic construct
  misc_feature 1..9873: note = derived and/or modified CDS sequence (opt3) from DENV-3__EU482461__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaatgccagcgatagaatgggtatgggggttacgtatttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaagcttatcacacagtttgaaacctaccagctgtggacagccttggtctccctcacttgttcaaacaccatattcacgctgacagtggcctggcgaaccgctactctaatcctggcaggtgttagtcttctccctctgtgccaaagctcgtccatgcggaagaccgattggttgccaatgacagtggccgcgatgggcgtcccccctctgcccttatttattttctctctcaaagacactccaaagcgtagaagctggcctctgaatgagggggtaatggctgtgggacttgtttcaatcctggccagttccttgctcaggaacgatgtgcccatggcaggcccactggtcgccggtgggctactgattgcttgttatgtgatcaccggaacgtctgcagaccttacagtagagaaagccgcggacgtgacctgggaagaggaagctgagcagactggcgtcagccataacctcatgataacagttgatgacgatggcaccatgcgcattaaggacgatgaaactgagaatatcctgacagtgttgttaaaaaccgccctgctcatcgtgtccgggatttttccgtactcaatacctgcaacgctgcttgtctggcacacttggcagaagcagacccaacggagcggagtgctgtgggacgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaacggaaagcgactggagcctaattgggcctctgtgaaaaaggatctcatctcctatggcggcgggtggcgcctgagcgcacagtggcaaaaaggagaagaggtacaggtcattgctgtggaaccaggtaagaaccccaagaatttccagacgatgcctggcatcttccagacaactaccggggagataggagccatcgcgcttgactttaaaccgggcacatcgggttcaccaattatcaaccgggaagggaaggttgtgggattatacggcaatggcgtcgtgaccaaaaacgggggatatgtttctggtattgcccaaactaatgcagagcccgatggccctaccccagagctggaagaggaaatgttcaagaaaagaaacctcacaatcatggacttgcatcccgggagtggaaagacgaggaagtacctgcctgctatagtgcgtgaggccattaaacgccggctcagaactctgatccttgctccgaccagggtcgtggcagccgaaatggaggaggccctgaagggcttgcccatccgatatcagacaaccgctactaaatccgaacacacaggtcgggagattgtagatctaatgtgccatgcgacctttacgatgcgcctgctcagcccagtgagagttcctaattacaacttagtcatcatggacgaagcacacttcactgatcccgcctctatagctgccagggggtatattagcacacgggtgggaatgggcgaggcagccgctatctttatgaccgcgaccccacctggcactgccgaagcattcccccagtccaatgctccaattcaggacgaggagcgagacatcccggaaagatcatggaacagtgggaatgagtggataacagattttgtgggaaagaccgtctggttcgtacctagcattaaagccggtaacgacatcgcaaactgtctgcgcaagaatggcaagaaagtgatccaactttctaggaagacatttgatactgaataccagaaaacgcgtctgaacgactgggatttcgttgtgaccacagacatttccgagatgggggccaattttaaggctgatcgggtcatcgaccccagaaggtgcctcaaaccagtgattttgactgatggacccgagcgcgttatactggccggccctatgccagtgaccgcggcatcagccgctcagcgaagaggtcgggtcgggaggaacccccagaaggaaaatgaccaatacatcttcacaggccagcctctcaacaatgatgaggaccatgcccactggaccgaagctaagatgctgcttgacaacattaatactccggagggaatcatcccagcactattcgaacccgagcgcgagaaaagtgccgctattgatggcgaatatcgtctgaagggggagagcagaaaaacgtttgtggaattgatgcggaggggagacttacctgtatggctggcccacaaggtggcatccgagggtataaaatacaccgatcgcaagtggtgcttcgacggcgaacgaaacaatcagatcctcgaggagaacatggatgttgaaatttggacaaaagagggggaaagaaagaagctgcggcccaggtggcttgacgcgcgcacttattctgatccactggccctcaaagagtttaaggacttcgctgccggaagaaaatcgatcgcattggatctggtcaccgaaattggcagggtgcctagccatctagcttaccggacacgtaatgccctggacaacctcgtgatgcttcacacctcagagcatggtgggcgcgcatatcgacacgccgtcgaggaactgcccgagactatggaaacattattgctgctcggcctgatgatccttctgacgggaggcgctatgctctttttgatatccgggaagggaatcggtaaaaccagtattggcctgatctgtgttattgtgtctagcgggatgttatggatggcggatgtaccactacagtggatcgcctccgcaatagtgctggagttctttatgatggtcctccttattcctgagccggaaaagcaaagaactccccaggacaatcagctggcttacgtggttatcggaattttgacactggccgccatcgtggcagctaacgagatgggcctcctggaaaccaccaagagggatcttggtatgtcaaaagagccaggggtcgtatctcctacaagctatctcgacgtggacctgcaccccgccagtgcgtggactttgtacgctgttgccacgaccgtgataacaccaatgctgcggcatactatcgaaaattccaccgcaaacgtcagcttagccgctattgcaaaccaagccgtggtcctaatgggcctggataagggatggcctatctctaaaatggacctcggcgtgccccttctggcgttggggtgctactcacaggttaatccgctgacactcaccgctgccgtgctgcttttagtaactcactatgcaattatcggaccaggcctgcaggccaaggctacgcgcgaggcccagaaaagaacagcagctggtataatgaagaaccctaccgtggatgggattatgactatcgacctcgatcccgtcatctacgactccaagttcgagaaacaattgggacaggttatgctgctagtgctgtgtgccgtccagctccttctgatgaggaccagttgggcgttgtgcgaagccctgacactcgcaactggcccaattaccacactgtgggagggtagccccggcaagttttggaatacgaccatcgctgtgtcgatggccaacatattccgggggtcttatttagcaggagctggccttgccttttccattatgaaaagcgtagggactggacgaagaggcacaggttcacagggggaaaccctgggagagaagtggaaaaagaagctcaatcaactaagtcgcaaagaattcgatctgtacaagaaatctggcatcactgaggtggacaggacagaggccaaggaaggtttgaaacggggcgagaccacgcatcacgcggtttcccgtgggagcgctaagctgcagtggtttgtggaaagaaacatggtcattcctgagggaagggtgatcgatctcggctgtgggcgcggaggctggtcatattactgcgcaggtcttaaaaaggtcaccgaagtgcgggggtatacaaagggaggcccgggccatgaggagcccgttccaatgagtacttacgggtggaatctggtaaaattgatgagcggaaaggacgtgttctacctgcctcccgaaaaatgtgataccctcttatgcgacataggtgagtcctctcctagcccaacagtcgaagagtcccgaactatcagagtgctgaagatggttgagccctggcttaaaaacaatcagttctgtattaaggtgctgaacccttatatgccaaccgtcatcgaacacctagagaggctccagcgcaagtacggcgggatgctggtgcggaatcccttgtcaagaaactctacacacgaaatgtattggattagtaatggaaccggcaacatcgtatcgagcgtgaatatggtttcccgtctgctccttaacaggtttactatgacgcatcggcgcccgacaattgagaaagatgtcgacctgggtgccgggacccgacacgtgaacgctgaacctgagactccaaatatggacgtgatcggagagagaataaagaggattaaagaagagcattcttcaacctggcactacgatgacgaaaacccctataagacatgggcctaccacggcagctatgaggtcaaagcaacgggctccgccagttctatgatcaatggggttgtgaagttactgaccaagccttgggatgtagtgccaatggtcactcaaatggctatgacagacaccactcccttcggacagcagcgggtgtttaaagaaaaggttgatacacgcaccccgagacctatgcccggtacaaggaaagtgatggagatcactgcggagtggttgtggcgaaccctcggccggaacaagaaaccacgtctgtgcacgagagaagagttcaccaagaaggtccgcacaaatgccgcaatgggggctgtgtttactgaagagaaccaatgggacagcgccagggcagccgtagaagatgaggagttctggaaactagttgaccgggaaagagagcttcataagctgggaaaatgtggctcatgcgtgtacaatatgatgggtaagcgcgaaaaaaagctcggggagtttggaaaagctaagggctccagggccatttggtacatgtggctgggcgcgcgatatttggagttcgaagcactggggtttctcaacgaggatcactggttcagtcgggaaaatagctactctggagtcgagggtgaaggccttcataagctggggtatatattaagagacatctccaaaattcctggaggcgccatgtacgctgatgacaccgccggttgggacacaaggatcactgaggatgacctgcacaacgaggaaaagattacccagcagatggatcccgagcatcgccagttggcaaatgctatctttaaactcacgtatcaaaacaaggtggtgaaagtccagcgtccaacacccaaggggaccgttatggacataatctcacggaaggatcagagaggaagcggccaggtgggcacttacgggctgaatacattcaccaacatggaagcccaactagtaaggcagatggagggagaaggtgtgctttcgaaagctgacctggagaatcctcacctcctggagaagaaaattactcagtggttggaaaccaagggcgtcgagcgcttaaaacgaatggccatctctggggatgactgcgtggttaagccaattgatgaccggtttgcaaacgcgctgctcgcccttaacgatatgggaaaggtgagaaaagacatcccgcagtggcaacccagtaagggctggcacgattggcagcaggtccctttctgttcccatcacttccatgaactgataatgaaagacggtaggaagctagtggtaccatgccgcccccaggacgagctgattgggagagctcggatcagccaaggagccggctggtcactcaaagaaacagcatgtttgggcaaggcttatgcccagatgtggtccctgatgtactttcacaggcgtgatcttcgactggcatctaatgccatctgcagcgcggttcctgtgcactggattccaacgagtcgcaccacttggtccatacatgctcaccatcagtggatgacaaccgaggacatgctcactgtctggaacagagtgtggatcgaggataatccctggatggaagacaagacacctgttaccacgtgggaggatgtgccgtacttagggaaacgggaagaccaatggtgtggaagcctgattggtttgacatctagggccacctgggcacagaacatcctgactgccattcagcaggtccgctcactcatcggcgatgaggagttccttgactatatgccaagtatgaagagatttcggaaagaagaggaatccgagggggctatatggtga

SEQ ID NO: 15571 - RNA, 9873 nt, synthetic construct
  misc_feature 1..9873: note = derived and/or modified CDS sequence (opt3) from DENV-3__EU482462__SS-prME
  source 1..9873: mol_type = other RNA
accagcctgtgcctcatgatgatgcttcccgcaacactggctttccacttgacttccagggacggagagcctaggatgatcgtggggaagaacgaacggggaaagtctttactgtttaagacggcatcaggtattaatatgtgtaccttaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaggaataagcccacactcgacatcgagctgcagaaaaccgaagcaactcaacttgccacactgcggaagttgtgtattgagggaaaaatcaccaacattacgaccgatagccgctgccctacacagggcgaagctatcctcccagaggaacaggaccagaattatgtctgtaagcacacttacgttgatcgaggttgggggaacggatgcggcctgttcggcaaagggagtttagtgacctgcgccaagtttcaatgtctggagcccatagagggaaaggtagtgcagtatgaaaatctcaaatacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgagaaccggtctagatttcaatgagatgatcctgctcactatgaagaacaaagcctggatggttcacaggcagtggtttttcgacctgccccttccttggaccagcggggcgacaaccgagactccaacatggaatcggaaggaactgttggtgacgtttaaaaacgcccatgcaaagaaacaagaggtcgtggtcctcggctcccaggaaggagctatgcacaccgccctgactggcgctacagagatccaaaattcagggggaaccagtattttcgccggtcacttaaagtgtcgtctgaagatggataaactagaactcaagggcatgagctacgcaatgtgcctgaacacatttgtgcttaaaaaggaggtttctgagactcagcatgggaccatattgatcaaagtggaatacaagggagaggacgccccctgtaagattcctttctccacggaagatggccaaggtaaagctcacaacgggcgcctgatcaccgcgaatccagtagtcacaaagaaagaggagcccgtgaacatagaagcagagccgcctttcggcgaatcaaatattgttatcggaatcggcgacaaggccctcaaaattaactggtataagaaggggagcagtatcggaaaaatgtttgaggctactgccagaggtgcaaggcggatggccattctgggcgataccgcttgggacttcgggtctgtgggaggcgtccttaattccctgggtaagatggtgcatcagatatttgggagcgcctacacagcattgttctcgggcgtatcttggatcatgaaaattggaatcggcgtgctcctgacttggatcgggttaaactccaagaatacctcaatgagttttagctgcattgttataggaatcattacgctgtatctaggcgcggtcgtgcaggctgatatgggttgtgccatcaactggaaagggaaggaactcaagtgcggatccggcattttcgtgacaaatgaggtccacacctggactgagcagtacaaatttcaagcagactctcccaagcgactggccacagctatcgccggtgcatgggaaaacggcgtttgtgggatacgcagcaccactagaatggagaatcttttgtggaaacagatcgctaacgaactgaattatattctctgggagaacaatatcaagctgaccgtggtggtaggagatattatcggcgtcttagaacaggggaaaaggacactgacgccacagcctatggaccttaagtactcatggaaaacctggggaaaggccaagatagtgactgcggagacacaaaacagttccttcattatcgacggccccaacaccccagagtgccccagcgcctctcgggcttggaatgtttgggaagtggaggattatggttttggggtcttcacaactaacatttggttgaaactccgcgaagtgtacacccagtcatgtgaccatagactgatgagtgcagccatcaaggatgagagggctgttcacgccgacatgggatactggatagaaagccagaaaaatggctcctggaagctagagaaagcatcttttatcgaggtgaagacgtgcacatggcctaagtcgcacaccctgtggagcaacggtgtactcgaatccgatatgattatcccaaaatcactggcgggcccgattagtcagcataatcaccgtcccgggtatcatactcaaaccgccggaccttggcaccttggcaagttggagctggacttcaactactgcgaagggacaactgtcgtgatcaccgagaattgtggaacacggggcccatctttacgaacgaccactgtgagcggtaaactcatacacgagtggtgctgtagatcctgcacactgccccctcttaggtatatgggggaagatggatgttggtacggcatggagattcgcccaatcaacgaaaaggaggaaaatatggtcaaatcactggttagcgctggttctggcaaggtggacaactttaccatgggggtattgtgcctcgccatcctgttcgaggaggtgatgcggggaaagttcggcaaaaagcatatgattgcaggggtcctatttactttcgtgctgctcctgtccggacagatcacatggaaagatatggctcacacctttattatgataggcagtaatgccagcgacagaatgggtatgggggttacgtatcttgcattgatcgccactttcaagattcagccctttctggctttaggattctttctcaggaaactgacctctcgcgaaaaccttctgctaggcgtgggcctcgcgatggccacaaccctgcaattgccggaggatatcgaacagatggcaaatgggattgctctgggattaatgactctcaagctgatcacacagttcgagacctaccagctttggacagccctggtctccttgacttgttcaaacaccatatttacgctcacagtggcctggcgaaccgctactctggttctagccggtgtgagtctgcttcctctctgccaaagctcgtccatgcggaagaccgactggctgccaatgacagtcgccgcgatgggcgtaccccctttgcccctgttcatcttttctttaaaagatactccaaagcgtagaagctggcctctcaatgaaggggtgatggctgttggactggtgtcaattcttgccagttccctgttgaggaacgacgtccccatggcaggcccactcgtggccggtgggctgctaatcgcttgttatgtaattaccggaacgtctgcagacctgacagtggagaaagccgcggatgtcacctgggaggaagaggctgaacagactggcgttagccataaccttatgatcacagtggacgatgacggcaccatgcgcataaaggatgacgagactgaaaatattctcacagtgctgttgaaaaccgccttactgatcgtctccgggatcttcccgtactcaattcctgcaacgctcctggtgtggcacacttggcagaagcagacccaacggagcggagttctttgggatgtacccagtccacccgagacacagaaagccgagctggaagagggtgtgtacagaataaagcagcagggcatctttgggaagacccaagtcggagtgggcgttcagaaagaaggtgtgttccatacaatgtggcacgtcactagaggggctgtgttgacccacaacggaaagcgactagagcctaattgggcctctgtcaagaaggacctgatttcctatggcggcgggtggcgcctcagcgcacagtggcaaaaaggagaggaagtccaggtgatcgctgttgagccaggtaagaaccccaagaatttccagacgatgcctggcatttttcagacaactaccggggaaatcggagccatagcgctggatttcaaaccgggcacatcgggttcaccaatcattaaccgggaggggaaggtggtcggactttacggcaatggcgtggttaccaaaaacgggggatatgtgtctggtatcgcccaaactaatgcagaacccgacggccctaccccagagttagaggaagagatgtttaagaaaagaaacctgacaattatggatctccatcccgggagtggaaagacgaggaagtacttgcctgctatcgtccgtgaagccataaaacgccggctgagaactctcattctggctccgaccagggtggtagcagccgagatggaagaggcccttaagggcctgcccatccgatatcagacaaccgctactaaatccgagcacacaggtcgggaaatcgtggacttgatgtgccatgcgaccttcacgatgcgcctactgagcccagttagagtccctaattacaacctcattatcatggatgaggcacactttactgaccccgcctctatagctgccagggggtatattagcacacgggtgggaatgggcgaagcagccgctatcttcatgaccgcgaccccacctggcactgccgaggcatttccccagtccaatgctccaattcaggacgaggaacgagatatcccggagagatcatggaacagtgggaatgaatggataacagacttcgtgggaaagaccgtctggtttgtacctagcattaaagccggtaacgatatcgcaaactgtttacgcaagaatggcaagaaagtgatccaactgtctaggaagacattcgacactgagtaccagaaaacgcgtcttaacgattgggactttgttgtgaccacagatatttccgaaatgggggccaatttcaaggctgaccgggtcatcgatcccagaaggtgcctgaaaccagtgattctcactgacggacccgagcgcgttatattggccggccctatgccagtgaccgcggcatcagccgctcagcgaagaggtcgggtcgggaggaacccccagaaggagaatgatcaatacatcttcacaggccagcctctgaacaatgacgaagaccatgcccactggaccgaggctaagatgctcctggataacattaatactccggaaggaatcatcccagcactttttgagcccgaacgcgagaaaagtgccgctattgacggcgagtatcgtctaaagggggaaagcagaaaaacgttcgtggagctgatgcggaggggagatttgcctgtatggttagcccacaaggtggcatccgaaggtataaaatacaccgaccgcaagtggtgctttgatggcgagcgaaacaatcagatcctggaagagaacatggacgttgagatttggacaaaagaaggggagagaaagaagctccggcccaggtggctggatgcgcgcacttattctgacccacttgccctgaaagagttcaaggattttgctgccggaagaaaatcgatcgcactcgacttggtcaccgagattggcagggtgcctagccatctggcttaccggacacgtaatgccctagataacctggtgatgctccacacctcagaacatggtgggcgcgcatatcgacacgccgtcgaggagcttcccgaaactatggagacactgttattgctgggcctcatgatcctgcttacgggaggcgctatgctgttcctcatatccgggaagggaatcggtaaaaccagtattggcttgatctgtgttattgtgtctagcgggatgctgtggatggcggacgtaccattacagtggatcgcctccgcaatagtgctagaatttttcatgatggtcctgctcattcctgagccggagaagcaaagaactccccaggataatcagcttgcttacgtggttatcggcattctgacattggccgccatcgtggcagctaacgaaatgggcctgctcgagaccaccaagagggacctgggtatgtcaaaagaaccaggggtcgtatctcctacaagctatcttgacgtggatctccaccccgccagtgcgtggactctgtacgctgttgccacgaccgtgataacaccaatgttgcggcatactatcgaaaattccaccgcaaacgtcagcctggccgctattgcaaaccaagccgtggtcttaatgggcctagacaagggatggcctatctctaaaatggatctgggcgtgcccctccttgcgctggggtgctactcacaggttaatccgttgacactgaccgctgccgtgctcctgcttgtaactcactatgcaattatcggaccaggcttacaggccaaggctacgcgcgaagcccagaaaagaacagcagctggtataatgaagaaccctaccgtggacgggattatgactatcgatctggaccccgtcatctacgattccaagtttgagaaacaactcggacaggttatgttgctggtgctatgtgccgtccagctgctccttatgaggaccagttgggcgctgtgcgaggccttgacactggcaactggcccaattaccacactctgggaaggtagccccggcaagttctggaatacgaccatcgctgtgtcgatggccaacatatttcgggggtcttatctggcaggagctggcttagccttctccattatgaaaagcgtagggactggacgaagaggcacaggttcacagggggagacccttggagaaaagtggaaaaagaagctgaatcaactcagtcgcaaagagtttgacctatacaagaaatctggcatcactgaagtggataggacagaggccaaggagggtctgaaacggggcgaaaccacgcatcacgcggtttcccgtgggagcgctaagttgcagtggttcgtggagagaaacatggtcattcctgaaggaagggtgatcgacctgggctgtgggcgcggaggctggtcatattactgcgcaggtctcaaaaaggtcaccgaggtgcgggggtatacaaagggaggcccgggccatgaagaacccgttccaatgagtacttacgggtggaatatagtaaaacttatgagcggaaaggatgtgttctacctgcctcccgagaaatgtgacaccttgctgtgcgatatcggtgaatcctctcctagcccaacagtcgaggaatcccgaactattagagtgctcaagatggttgagccctggctaaagaacaatcagttttgtatcaaggtgctgaacccttatatgccaaccgtcattgagcaccttgaaaggctgcagcgcaagtacggcgggatgctagtgcggaatcccctctcaagaaactctacacacgagatgtattggatcagtaatggaaccggcaacattgtatcgagcgtgaatatggtttcccgtctgttgctgaacaggttcactatgacgcatcggcgcccgacaatcgaaaaagacgtcgacctcggtgccgggacccgacacgtgaacgctgagcctgaaactccaaatatggatgtgataggagagagaattaagaggatcaaagaggaacattcttcaacctggcactacgacgatgagaacccctataagacatgggcctaccacggcagctatgaagtcaaagcaacgggctccgccagttctatgatcaatggggttgtgaaacttctgaccaagccttgggacgtagtgccaatggtcactcaaatggctatgacagataccactccctttggacagcagcgggtgttcaaagagaaggttgacacacgcaccccgagacctatgcccggtacaaggaaagtgatggaaattactgcggagtggttatggcgaaccctgggccggaacaagaaaccacgtttgtgcacgagagaggaatttaccaagaaggtccgcacaaatgccgcaatgggggctgtgttcactgaggaaaaccaatgggatagcgccagggcagccgtagaggacgaagagttttggaaactcgttgatcgggagagagaactgcataagctaggaaaatgtggctcatgcgtgtacaatatgatgggtaagcgcgagaagaaacttggggagttcggaaaagctaaaggctccagggccatatggtacatgtggctgggcgcgcgatatctcgagtttgaggcactggggttcttgaacgaagaccactggtttagtcgggagaatagctactctggagtcgaaggtgagggcctgcataagctcgggtatatccttagagatatttccaaaatccctggaggcgccatgtacgctgacgacaccgccggttgggatacaaggattactgaagacgatctgcacaacgaggagaagatcacccagcagatggaccccgaacatcgccagttagcaaatgctatattcaaactgacgtatcaaaacaaggtggtgaaagtccagcgtccaacacccaaggggaccgttatggatatcatttcacggaaggaccagagaggaagcggccaggtgggcacttacgggttgaatacatttaccaacatggaggcccaactcgtaaggcagatggaaggagagggtgtgctgtcgaaagctgatctagaaaatcctcaccttctggagaagaaaatcactcagtggctcgagaccaagggcgtcgaacgcctgaaacgaatggccatttctggggacgattgcgtggttaagccaatcgacgatcggttcgcaaacgcgttgttagccctgaacgacatgggaaaggtgagaaaagatataccgcagtggcaacccagtaagggctggcacgactggcagcaggtccctttctgttcccatcactttcatgagctcattatgaaagacggtaggaaacttgtggtaccatgccgcccccaggatgaactgatcgggagagctcggatcagccaaggagccggctggtcactaaaagagacagcatgtctgggcaaggcttatgcccagatgtggtccctcatgtacttccacaggcgtgacttgcgactggcatctaatgccatttgcagcgcggttcctgtgcactggataccaatcagtcgcacgacctggtccattcatgctcaccatcagtggatgactacagaagatatgcttaccgtctggaacagagtgtggatcgaggacaatccctggatggaggataagactcctgttacaacctgggaagacgtgccgtacctggggaaacgggaggatcaatggtgtggaagcctcattggtttaacgtctagggccacatgggcacagaacatcctgaccgccatacagcaggtccgctcattgatcggcgacgaagagtttctggattatatgccaagtatgaagagattccggaaagaggaagagtccgaaggggctatttggtga

SEQ ID NO: 15572 - RNA, 9873 nt, synthetic construct
  misc_feature 1..9873: note = derived and/or modified CDS sequence (opt3) from DENV-3__EU660407__SS-prME
  source 1..9873: mol_type = other RNA
acaagcctgtgcctcatgatgatgcttcccgcaacactggctttccacttgacttccagagacggcgaacctaggatgatcgtggggaagaatgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgccaagaagcaagaggtcgtggtcctcggctcccaggaaggagctatgcacaccgccctgactggcgctacagagatccaaaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcaccaagaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgtgatcaactggaaggggaaggaactcaaatgcggatccggcattttcgtcacaaatgaggttcacacctggactgagcagtacaagtttcaagccgactctcccaaacggctggcaacagccatcgctggtgcctgggaaaacggcgtgtgtgggatacgaagcaccactcgcatggagaatcttttgtggaagcagatcgcaaacgaactgaattatattctctgggagaacaatatcaaactgaccgtggtagtcggagatattatcggcgtgttagaacaggggaagagaacactgacgccacagcctatggagcttaaatactcatggaagacctggggaaaggctaaaatagttactgccgagacacaaaacagttccttcattatcgacggccccaacaccccagaatgccccagcgcgtctagggcctggaatgtgtgggaggtcgaagactatggttttggggtgttcacaactaacatttggttgaagctccgggaggtttacacccagtcatgtgatcatcgcctgatgagtgctgcaatcaaagacgaaagagccgtgcacgctgatatgggatactggatagagagccagaagaatggctcctggaaactagagaaggcctcttttatcgaagtaaagacgtgcacatggcctaaatcgcacaccctgtggagcaacggtgtcctcgagaatgacatgattatcccaaagtccctggcaggcccgatttcacagcataaccacaggcccgggtatcatactcaaaccgcgggaccttggcaccttggcaaattggaactggatttcaattactgcgaggggacaactgtggtgatcaccgagaactgtggaacacgtggcccaagtttacggacgaccactgtctctggtaagctcatacacgaatggtgctgtcgaagctgcacactgccccctcttagatatatgggggaggacggatgttggtacggcatggaaattaggccaatcaatgagaaagaagagaacatggttaagtccctggtgtcagccggtagcggcaaggtagataattttaccatgggggtgttgtgcctcgctatcctgttcgaggaagtcatgcgcggaaaattcggcaagaaacatatgattgccggggtgctatttactttcgttctgctcctgtctggacagatcacatggcgggacatggcacacacccttattatgataggctccaacgctagtgatagaatgggtatgggggtgacgtatttggccctgatcgcaacttttaagattcagcccttcttagccctcggatttttcctgaggaaacttaccagccgcgagaatctgctactcggcgtcggcctggctatggcgacaaccttgcaactgccggaagacatcgagcagatggccaacgggattgcattaggactcatgactctgaaacttatcacacagtttgaaacctaccagctgtggacagctttggtgtctctcacttgttccaataccatattcacgctgacagttgcctggcgaaccgccactctaatcctggctggtgtgtcacttctccctctgtgccaaagtagctcgatgcggaagaccgattggttgccaatgacagtcgcagccatgggcgtaccccctctgcccttatttattttctccctcaaagacactccaaagcgtagatcttggcctctgaacgagggggtgatggcggttggacttgtgagcatcctggcttcaagtttgctcaggaacgatgtccccatggccggcccactggtggccggtgggctactgattgcctgttatgtaatcaccggaacgtccgctgaccttacagtggagaaagcagccgacgtcacctgggaagaggaagcggagcagactggcgtttctcataatctcatgataacagtggatgacgatggcaccatgcgcattaaggacgatgaaactgagaacatcctgacagtgttgttaaaaaccgctctgctcatcgtcagcgggatttttccgtactccatacctgccacgctgcttgtgtggcacacttggcagaagcagacccaacggtcaggagttctgtgggacgtacccagcccacccgagacacagaaagcagaattggaggaaggtgtgtacagaatcaagcagcagggcattttcgggaagacccaagtcggagtgggcgttcagaaagagggtgtgtttcatacaatgtggcacgtcactcgaggggcagtgctaacccacaatggaaagaggctggagcctaactgggctagtgtcaagaaggatctcatctcttatggcggcgggtggcgcctgtccgcccagtggcaaaaaggagaagaggtccaggtgattgcagttgaaccaggtaagaatcccaagaacttccagacgatgcctggcatcttccagacaactaccggggagataggagctatcgcccttgactttaaaccgggcacaagcggttcgccaattatcaatcgggaagggaaggtggtcggattatacggcaacggcgtggttaccaaaaatgggggatatgtgtcaggtattgcgcaaactaacgccgagcccgatggccctaccccagagctggaagaggaaatgttcaagaaaagaaatctcacaatcatggacttgcatcccgggtctggaaagacgaggaagtacctgcctgcaatagtccgtgaggctattaaacgccggctcagaactctgatccttgccccgaccagggtggtagctgcagaaatggaggaggccctgaagggcttgcccatccgatatcagacaaccgccactaaaagtgaacacacaggtcgggagattgtggatctaatgtgccatgctacctttacgatgcgcctgctctccccagttagagtccctaactacaatttaatcataatggacgaagcgcacttcactgatcccgcaagcattgccgctagggggtatatctctacacgggtgggaatgggcgaggccgcagccatttttatgaccgctaccccacctggcactgcggaagccttcccccagagcaacgcaccaatccaggacgaggagcgagacataccggaaagatcctggaactcagggaacgagtggattacagattttgtgggaaagaccgtctggttcgtacctagtatcaaagctggtaacgacatcgccaattgtctgcgcaagaacggcaagaaagtgattcaacttagcaggaagacatttgatactgaataccagaaaacgaagctgaatgactgggatttcgttgtgaccacagacatctctgagatgggggcaaactttaaagccgatcgtgtcattgacccccggagatgcctcaagccagtgatattgactgatggacccgagagggttatcctggctggccctatgccagtgaccgccgcgtccgcagcccagcgccgaggtagagtcgggcggaatccccagaaggaaaacgaccaatacattttcacaggccagcctctcaataacgatgaggaccatgctcactggaccgaagccaaaatgctgcttgacaatatcaacactccggagggaatcattccagctctattcgaacccgagagggagaagtcagcagccatagatggcgaatatcgcctgaaaggggagagtcgtaagacgtttgtggaattgatgagacggggagacttacctgtatggctggctcacaaagtggccagcgagggtatcaagtacaccgataggaaatggtgcttcgacggcgaacgcaataaccagattctcgaggagaatatggatgttgaaatctggacaaaggagggggaacgaaagaaactgagaccccggtggcttgacgcaaggacttattccgatccactggcgctcaaggagtttaaagacttcgccgctggacgcaagtctattgccttggatctggtcaccgaaatcggcagagtgccttcgcatctagcatacaggacacggaacgctctggacaatctcgtgatgcttcacaccagcgagcatggtgggcgtgcctatcgccacgcagtcgaggaactgcccgagactatggaaacattattgctgctcggcctgatgatacttctgacgggaggcgccatgctctttttgatctcagggaaaggaattggtaagacctccatcggcctgatttgtgttatcgtgagttctgggatgttatggatggctgatgtaccactacagtggatagcgagcgccattgtgctggagttctttatgatggtcctccttatccctgagccggaaaagcaacgaactccccaggacaaccagctggcatacgtggttattggaatcttgacactggctgccatagtggccgcaaatgagatgggcctcctggaaaccaccaaaagagatcttggtatgtccaaggagccaggggtcgtatcacctacatcttatctcgacgtggacctgcaccccgctagcgcctggactttgtacgcggttgctacgaccgtgatcacaccaatgctgaggcatactattgaaaacagtaccgccaacgtctccttagcagccatcgctaatcaagcagtggtcctaatgggcctggataaaggatggcctattagcaagatggacctcggcgtgccccttctggccttggggtgctactctcaggttaacccgctgacactcaccgcggctgtgctgcttttagtaactcactatgccatcataggaccaggcctgcaggcaaaagccacgcgggaggctcagaagcgcacagccgcaggtattatgaagaatcctaccgtggatgggatcatgactatcgacctcgatcccgtcatttacgactcaaaattcgagaagcaattgggacaggttatgctgctagtgctgtgtgctgtccagctccttctgatgagaacctcctgggccttgtgcgaagcgctgacactcgccactggcccaatcaccacactgtgggagggtagtcccggcaaattttggaacacgaccatagcagtgagcatggctaatattttcagggggtcgtatttagccggagcaggccttgctttttctatcatgaagtccgtagggactggacggcgaggcacaggtagccagggggaaaccctgggagagaaatggaagaagaaactcaaccaactatcaagaaaggagttcgatctgtacaaaaagagtggcattactgaggtggaccgcacagaggccaaagaaggtttgaagaggggcgagaccacgcatcacgccgtttctcgggggtccgcgaaactgcagtggtttgtggaacgtaatatggtcatccctgagggaagagtgatagatctcggctgtgggaggggaggctggagctattactgcgctggtcttaagcgcgtcaccgaagtgcgggggtatacaaagggaggcccgggccatgaggagcccgttccaatgtcaacttacgggtggaacatcgtaaaactgatgagtggaaaggacgtgttctacttgcctcccgaaaaatgtgataccctgctctgcgacattggtgagagctccccttctccaacagtcgaagagagccgaactatcagagtgttaaagatggttgagccctggctgaaaaataaccagttctgtattaaggtgcttaatccttatatgccaaccgtcatcgaacacctggagaggctacagcgcaagtacggcgggatgctcgtgcggaaccccctgtccagaaattcaacacacgaaatgtattggatttctaacggaaccggcaatatcgtaagttcggtgaacatggttagccgtttgctgctcaacaggtttactatgacgcatcggcgcccgacaatagagaaagatgtcgaccttggtgcagggacccgacacgtgaatgccgaacctgagactccaaacatggacgtgattggagagagaatcaagaggatcaaagaagaacactcctctacctggcactacgatgacgaaaatccctataagacatgggcttaccacggctcatatgaggtcaaagccacgggcagcgcatccagtatgattaacggggttgtgaagctgttaaccaagccttgggatgtagtgccaatggtcactcaaatggccatgacagacaccactcccttcggacagcagcgggtgtttaaagaaaaggttgatacacgcaccccgagacctatgcccggtacaaggaaagtgatggagataactgctgagtggctgtggcgaaccttgggccggaataagaaaccacgtctctgcacgagagaagagttcaccaagaaggtccgcacaaacgcggccatgggggcagtgtttactgaagagaatcaatgggactctgctagggccgcagtagaagatgaggagttctggaaactggttgaccgggaaagagagctacataaacttggaaaatgtggcagctgcgtgtacaacatgatgggtaagcgcgagaaaaagctgggggagtttggaaaagccaagggctcaagggctatctggtacatgtggctcggcgcccgatatctggagttcgaagcgttggggtttctgaatgaggatcactggttctcccgggaaaacagttacagcggagtcgagggtgaaggcctccataaacttgggtatattctgagagacatctctaaaattcctggaggcgcaatgtacgccgatgacaccgctggttgggacacaaggatcactgaggatgacttacacaatgaggaaaagataacccagcagatggatcccgagcatcgccagctggccaacgcaatctttaaattgacgtatcaaaataaggtggtgaaagtccagcgtccaacacccaaggggaccgttatggacattatctcccggaaggatcagagaggatcaggccaggtgggcacttacgggctcaacacattcaccaatatggaagctcaactggtaaggcagatggagggagaaggtgtgctaagcaaagccgaccttgagaaccctcatctgctcgagaagaaaattactcagtggctggaaaccaagggcgtcgagcgcttgaaacgaatggctatctcgggggatgactgcgtggttaagccaatagatgaccggtttgccaacgcattactggcgctcaatgatatgggaaaggtgagaaaagacattccgcagtggcaaccctctaagggctggcacgattggcagcaggtccctttctgtagtcatcacttccatgaacttatcatgaaagacggtaggaagctggtggtaccatgccgcccccaggacgagctaatcgggagagcccggatttcccaaggagctggctggagcctgaaagaaacagcctgtctcggcaaggcatatgctcagatgtggtcattgatgtactttcacaggcgtgatctgcgacttgcctccaacgcaatatgctctgccgttcctgtgcactggatcccaacgagccgcaccacttggagtattcatgcgcaccatcagtggatgacaaccgaggacatgctgactgtctggaatagagtgtggatcgaggataacccctggatggaagacaagacacctgttaccacgtgggaggatgtgccgtacctcgggaaacgggaagaccaatggtgtggatccttaattggtctgacaagcagggctacctgggcccagaatatcttgactgcaatacagcaggtccgctctctgatcggcgatgaggagttcctcgactatatgccatcaatgaagagatttcggaaagaagaggaaagtgagggggccatttggtga

SEQ ID NO: 15573 - RNA, 9873 nt, synthetic construct
  misc_feature 1..9873: note = derived and/or modified CDS sequence (opt3) from DENV-3__EU660409__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactaggcttgccacactgcggaaattgtgtattgagggaaagatcaccaacattacgaccgatagccgctgccctacacaaggcgaagctatcctcccagaggaacaggaccagaattatgtctgtaaacacacttacgttgatcgaggttgggggaacggatgcggcctgttcggcaaggggagtttagtgacctgcgccaagtttcagtgtctggagctcatagagggaaaagtagtgcaatatgaaaatcttaagtacacagtcattatcactgtgcacaccggtgaccagcatcaggttggcaacgacacacagggggcaaccgtggagattactccccaagcttccacggtcgaagccgtgctgcctgagtatggaacattgggcctagaatgctctccaagaaccggtctggatttcaatgagatgatcctcctgactatgaaaaacaaggcgtggatggtacacaggcagtggtttttcgaccttccgctgccctggaccagcggggccacaaccgagactcctacatggaatcggaaagaattgctcgttacgtttaagaacgcacatgctaaaaagcaggaggtggtcgtgctgggctcccaagaaggagccatgcacaccgctttaactggcgccacagagatccagaattcagggggaaccagtattttcgcaggtcacctgaagtgtcgtctaaaaatggataagctcgaactgaaaggcatgagctacgccatgtgccttaacacatttgtcttgaagaaagaggtgtctgagactcagcatgggaccatactgatcaaggttgaatacaagggagaggacgctccatgtaaaattcccttctccacggaagatggccagggtaaggcgcacaacgggcgcctcatcaccgcaaatcctgtggtaacaaaaaaggaggagccagtcaacatagaagccgagcccccgttcggcgaatcaaatattgtgatcggaatcggcgacaaagctctgaagattaactggtataagaaagggagcagtatcggaaagatgtttgaggccactgcaagaggtgccaggcggatggctattcttggcgataccgcctgggacttcgggtctgttggaggcgtgctgaattccttgggtaaaatggtccatcaaatatttgggagcgcatacacagcgctcttctcgggcgtgtcttggatcatgaagattggaatcggcgtactgttaacttggatcgggctgaactccaaaaatacctcaatgagttttagctgcattgctataggaatcattacgctatatctcggcgccgtggttcaggcagatatgggttgtgtcatcaactggaaggggaaggaactgaaatgcggatccggcattttcgtgacaaatgaggtgcacacctggactgagcagtacaagtttcaggccgactctcctaaacgacttgctacagccatcgcaggtgcttgggaaaacggcgtctgtgggatacgcagcaccactagaatggagaatttgctgtggaagcaaatcgccaacgaactcaattatattctgtgggagaacaatatcaaattaaccgttgtggtgggagatattatcggcgtactggaacaggggaagaggacacttacgccccagccaatggagttgaaatactcatggaagacctggggaaaggcgaaaatagtcactgccgagacacagaacagttccttcattatcgacggccctaacacccccgaatgcccaagcgcttctcgggcatggaatgtgtgggaggttgaagactatggttttggggtgttcacaactaacatttggctcaagctgcgcgaggtctacacccaatcatgtgatcatagactaatgagtgccgctatcaaagacgaaagggccgtgcacgcagatatgggatactggatagagagccagaagaatggctcctggaaactggagaaggcgtcttttatcgaagttaagacgtgcacatggcccaaatcgcacaccctctggagcaacggtgtgctggagtccgacatgattatccctaagtcacttgccggcccaattagtcagcataatcaccgtccggggtatcatactcagaccgctggaccctggcacttgggcaaactggaattagatttcaactactgcgaggggacaactgtagtcatcaccgagaattgtggaacacggggcccttctctccgaacgaccactgtgagcggtaagctgatacacgaatggtgctgtagatcctgcacacttccacccctgaggtatatgggggaggacggatgttggtacggcatggaaattcgccctatcaacgagaaagaagagaatatggtgaagtcattggtcagcgccggttctggcaaggttgataactttaccatgggggcactctgcctggctatcctattcgaggaagtgatgcggggaaaattcggcaagaaacatatgattgccggggtactgtttactttcgtgctcctgctttccggacaaatcacatggagagacatggcacacaccttgattatgataggcagtaatgccagcgataggatgggtatgggggtcacgtatctggctttaatcgcgacttttaagattcagccattcctcgccctgggatttttccttcgcaaactgacctctcgagagaacctactcctgggcgtgggcttggcaatggctacaaccctgcagttacccgaagacatcgagcaaatggccaatgggattgccctcggactgatgactcttaagctgatcacacagtttgaaacctaccagttgtggacagctctcgtttccctgacttgttcaaacaccatattcacgctaacagtggcatggcggaccgccactctgatccttgcgggtgtcagtctcctgccgttgtgccagagctcgtccatgcgtaagaccgattggctgcctatggctgtggccgcaatgggcgttccacccttacctctctttattttctctctgaaagacacacccaagagaaggagctggccacttaatgagggggtgatggccgtcggactggtatcaatcttggctagttccctcctgcgcaacgatgtgcctatggcaggccccctagttgccggtgggctgcttattgcgtgttatgtgatcactggaacctctgctgacctcacggtcgagaaagtggccgacgtaacatgggaagaggaagcagagcaaaccggcgtgagccataacctgatgataactgtcgatgacgatggcacaatgcggattaaggacgatgaaaccgagaatatcttgactgttttactgaaaacagccctcctgatcgtgtccgggatttttccatactcaataccggctacccttctggtgtggcacacgtggcagaagcagactcagagaagcggagtcttgtgggacgtgcctagtcccccagagacccaaaaagccgaactagaggaaggtgtttacaggatcaagcagcagggcattttcgggaagacacaggtaggagtgggcgtccaaaaagagggtgtgtttcataccatgtggcacgttacacgaggggcagtgctgactcacaacggaaagcgcctcgagcccaattgggcttctgtcaaaaaggatctgatctcctatggcggcgggtggcggcttagcgcccagtggcagaaaggagaagaggtgcaagtaattgcggtcgaacctggtaagaacccaaagaatttccagaccatgcccggcatcttccagacgacaactggggagataggagccatcgcattagactttaaacctggcacctcgggttcaccgattatcaacagagaagggaaggtggttggactgtacggcaatggcgtggtcacaaaaaacgggggatatgtgtctggtattgctcagaccaatgccgagccagatggccccactcctgagctcgaagaggaaatgttcaagaaaaggaacttgaccatcatggacctgcatccagggagtggaaagacacgtaagtacctccccgctatagttcgcgaggcaattaaacggagactgaggacgcttatcctggcccctactcgagtggtcgccgctgaaatggaggaggcgttgaagggcctaccgatccggtatcaaaccacagcaaccaaatccgaacacactggtcgcgagattgtggatctgatgtgccatgccacatttaccatgagactcttaagccccgtaagggtgccaaattacaacctgatcataatggacgaagctcacttcacggatcctgcctctattgcagcccgggggtatatcagcactcgagttggaatgggcgaggctgcggccatttttatgacagcaacccccccaggcaccgctgaagccttccctcagtccaatgcacccatccaggacgaggagagagacataccagaacgctcatggaacagtgggaatgagtggattactgattttgtcggaaagacagtgtggttcgtgccgagcatcaaagccggtaacgacatcgctaactgtcttaggaagaatggcaagaaagtcattcagctgtctcgtaagacctttgatacagaataccaaaaaactcggctcaacgactgggatttcgtagtgacgaccgacatctccgagatgggggccaattttaaggcggatagagttattgaccctaggcgctgcttgaaacccgtgatactgacagatggaccagagcgagtcatcctcgcaggccccatgcctgtgactgccgcttcagccgctcagagacggggtagggttgggcgcaacccacagaaggaaaatgaccagtacattttcaccggccaacccctgaacaatgatgaggaccatgcacactggacagaagccaagatgcttctagacaacatcaatacccctgagggaatcattccggctctgttcgaaccagagcgtgagaaaagtgccgcaatagatggcgaatatagattgaagggggagagccggaaaacttttgtggaattaatgaggcgcggagacctgcccgtctggctcgcgcacaaggtggcctccgagggtatcaaatacacggatcgaaagtggtgcttcgacggcgaaagaaacaatcagattctggaggagaacatggatgtagaaatctggaccaaagagggggaacggaagaagcttaggcctcgctggctggacgctagaacatattctgatcccctcgccttgaaagagtttaaggacttcgcagctggaaggaaatcgattgccctggatctagtgactgaaatcggccgggttccaagccatctggcataccgtacccgcaatgccctcgacaaccttgtcatgctgcacacatcagagcatggtgggcgagcttatagacacgcggtggaggaattacctgagaccatggaaactttgctgctcctgggccttatgatactgctcacaggaggcgccatgttgtttctgatctccgggaagggaattggtaaaacgagtatcggcttaatttgtgtgaccgtctctagcgggatgctatggatggcagatgttcccctgcagtggatcgcttccgccatagtgctcgagttctttatgatggtacttctgattccagagcctgaaaagcagaggactccgcaagacaatcagttggcctacgtggtcatcggaattctgacactcgcagctatcgtggccgcgaacgagatgggcctgcttgaaaccaccaagcgggatctcggtatgtcaaaagagcccggggttgtgtctccaacaagctatctggacgtcgacttgcaccctgctagtgcctggactctgtacgcagtagccacgaccgtgataacacccatgttacgccatactatcgaaaattccaccgctaacgttagcctagcagccattgcgaaccaggctgtggtcctgatgggcctcgataagggatggccaatctctaaaatggaccttggcgtgcctctgttggccctggggtgctactcacaagtcaatcccctcacactgaccgcagccgtgcttttactggttactcactatgctattatcggaccgggcctccaggccaaggcaacgagagaggctcagaaaaggacagccgcgggtataatgaagaacccaaccgtggatgggattatgactatcgacttggatcctgtaatctacgactccaagttcgagaaacagctgggacaagtgatgctactggtcctctgtgccgttcagcttctgttgatgcggaccagttgggcactgtgcgaagctctcacactggccactggccccattaccacattatgggagggtagcccaggcaagttttggaatacgaccatcgcagtgtcgatggctaacatattccgagggtcttatcttgccggagccggcctggcgttttccattatgaaaagcgtcgggactggaagacgcggcacaggttcacagggggaaaccctcggagagaagtggaaaaagaagctaaatcagctgagtaggaaagaattcgatttgtacaagaaatctggcatcactgaggtggaccggacagaggctaaggaaggtctgaaacgtggcgagaccacgcatcacgcagtatccagagggagcgccaagctccaatggtttgtggaaaggaacatggttattcccgagggacgcgtgatcgatcttggctgtgggcggggaggctggtcatattactgcgctggtctgaaaaaggtcaccgaagtgcgagggtatacaaagggaggccctggccatgaggagccggtccccatgagtacttacgggtggaatatagtgaaattgatgagcggaaaggacgttttctacctgccacctgaaaaatgtgataccctcttatgcgacatcggtgagtcctctcccagccctacagtagaagagtccagaactattagggtgctgaagatggtcgagccatggcttaaaaacaatcagttctgtatcaaggtgctgaacccctatatgcctaccgttattgaacacctagagcgcctccagcggaagtacggcgggatgctggtgagaaatccattgtcacgtaactctacacacgaaatgtattggatcagtaatggaaccggcaacattgtctcgagcgtgaatatggtatccaggctgctccttaaccggtttactatgacgcatcgccgacccacaatcgagaaagatgtggacctgggtgccgggaccagacacgttaacgcagaaccggagactcctaatatggacgtcataggagagaggattaagcggatcaaagaagagcattcttcaacctggcactacgatgacgaaaacccatataagacatgggcctaccacggcagctatgaggtgaaagctacgggctccgcgagttctatgatcaatggggtggtcaagttactgaccaagccctgggatgttgtgcctatggtaactcagatggccatgacagacaccactccattcggacaacagcgcgtgtttaaagaaaaggtcgatacaagaacccccaggccgatgcctggtacacgaaaagtgatggagattactgcagagtggttgtggcggaccctcggccgtaacaagaaacccagactgtgcacgcgcgaagagttcaccaagaaggttaggacaaatgctgccatgggggcagtgtttactgaagagaaccagtgggacagcgcccgggctgccgtcgaagatgaggagttctggaaactagtggacagagaacgcgagcttcataagctgggaaaatgtggctcatgcgtatacaatatgatgggtaagagggaaaaaaagctcggggagtttggaaaagcgaagggctcccgagcaatatggtacatgtggctgggcgcccggtatttggagttcgaagctctggggtttctcaacgaggatcactggttcagtagagaaaatagctactctggagttgagggtgaaggccttcataagctggggtatatcttaagggacatttccaaaatcccaggaggcgccatgtacgcagatgacaccgctggttgggacacacgcattactgaggatgacctgcacaacgaggaaaagatcacccaacagatggatcctgagcatcgtcagttggccaatgctatatttaaactcacgtatcagaacaaggtggtcaaagtgcaacggcccacaccaaaggggaccgtgatggacatcatttcaagaaaggatcagaggggaagcggccaggtcggcacttacgggctgaatacattcaccaacatggaagcccagctagttcgccaaatggagggagaaggtgtgctttcgaaagcagacctggagaatccccacctcctggagaagaaaatcactcagtggttggaaaccaagggcgtagagcgattaaaacggatggcgatttctggggatgactgcgtggtcaagcctatcgatgacagatttgccaacgctctgctcgcccttaacgatatgggaaaggtgaggaaagacataccacagtggcagccgagtaagggctggcacgattggcaacaggttcccttctgttcccatcacttccatgaactgattatgaaagacggtcgcaagctagtggtcccttgcagaccacaggacgagctgatcgggcgggcaaggatcagccagggagctggctggtcactcaaagaaacagcctgtttgggcaaggcatatgcccaaatgtggtccctgatgtactttcaccgtcgagatcttcgcctggcgtctaatgctatttgcagcgccgtgcccgtacactggatacctacgagtagaaccacttggtccatccatgcacaccatcagtggatgacaaccgaggacatgctcactgtttggaaccgggtgtggattgaggataatccatggatggaagacaagacacccgtcaccacgtgggaggatgtgccttacttagggaaaagggaagaccagtggtgtggaagcctgatcggtttgacatctcgcgccacctgggctcaaaacattctgactgccatccagcaggttagatcactcataggcgatgaggagttccttgactatatgccgagtatgaagcggtttaggaaagaagaggaatccgagggggcaatctggtga

SEQ ID NO: 15574 - RNA, 9873 nt, synthetic construct
  misc_feature 1..9873: note = derived and/or modified CDS sequence (opt3) from DENV-3__EU660410__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaggaataagcccacactcgacatcgagctgcagaaaaccgaagcaactcaacttgccacactgcggaagttgtgtattgagggaaaaatcaccaacattacgaccgatagccgctgccctacacagggcgaagctatcctcccagaggaacaggaccagaattatgtctgtaagcacacttacgttgatcgaggttgggggaacggatgcggcctgttcggcaaagggagtttagtgacctgcgccaagtttcaatgtctggagcccatagagggaaaggtagtgcagtatgaaaatctcaaatacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgagaaccggtctagatttcaatgagatgatcctgctcactatgaagaacaaagcctggatggttcacaggcagtggtttttcgacctgccccttccttggaccagcggggcgacaaccgagactccaacatggaatcggaaggaactgttggtgacgtttaaaaacgcccatgcaaagaaacaagaggtcgtggtcctcggctcccaggaaggagctatgcacaccgccctgactggcgctacagagatccagaattcagggggaaccagtattttcgccggtcacttaaagtgtcgtctgaagatggataaactagaactcaagggcatgagctacgcaatgtgcctgaacacatttgtgcttaaaaaggaggtttctgagactcagcatgggaccatattgatcaaagtggaatacaagggagaggacgccccctgtaagattcctttctccacggaagatggccaaggtaaagctcacaacgggcgcctgatcaccgcgaatccagtagtcacaaagaaagaggagcccgtgaacatagaagcagagccgcctttcggcgaatcaaatattgttatcggaatcggcgacaaggccctcaaaattaactggtataagaaggggagcagtatcggaaaaatgtttgaggctactgccagaggtgcaaggcggatggccattctgggcgataccgcttgggacttcgggtctgtgggaggcgtccttaattccctgggtaagatggtgcatcagatatttgggagcgcctacacagcattgttctcgggcgtatcttggatcatgaaaattggaatcggcgtgctcctgacttggatcgggttaaactccaagaatacctcaatgagttttagctgcattgttataggaatcattacgctgtatctaggcgcggtcgtgcaggctgatatgggttgtgccatcaactggaaagggaaggaactcaagtgcggatccggcattttcgtgacaaatgaggtccacacctggactgagcagtacaaatttcaagcagactctcccaagcgactggccacagctatcgccggtgcatgggaaaacggcgtttgtgggatacgcagcaccactagaatggagaatcttttgtggaaacagatcgctaacgaactgaattatattctctgggagaacaatatcaagctgaccgtggtggtaggagatattatcggcgtcttagaacaggggaaaaggacactgacgccacagcctatggagcttaagtactcatggaaaacctggggaaaggccaagatagtgactgcggagacacaaaacagttccttcattatcgacggccccaacaccccagaatgccccagcgcctctcgggcttggaatgtttgggaggtggaagactatggttttggggtcttcacaactaacatttggttgaaactccgcgaggtgtacacccagtcatgtgatcatagactgatgagtgcagccatcaaggacgaaagggctgttcacgccgatatgggatactggatagagagccagaaaaatggctcctggaagctagagaaagcatcttttatcgaagtgaagacgtgcacatggcctaagtcgcacaccctgtggagcaacggtgtactcgagtccgacatgattatcccaaaatcactggcgggcccgattagtcagcataatcaccgtcccgggtatcatactcaaaccgccggaccttggcaccttggcaagttggaactggatttcaactactgcgaggggacaactgtcgtgatcaccgagaattgtggaacacggggcccatctttacgaacgaccactgtgagcggtaaactcatacacgaatggtgctgtagatcctgcacactgccccctcttaggtatatgggggaggacggatgttggtacggcatggaaattcgcccaatcaacgagaaggaagagaatatggtcaaatcactggttagcgctggttctggcaaggtggataactttaccatgggggtattgtgcctcgccatcctgttcgaggaagtgatgcggggaaagttcggcaaaaagcatatgattgcaggggtcctatttactttcgtgctgctcctgtccggacagatcacatggagagacatggctcacacctttattatgataggcagtaatgccagcgataggatgggtatgggggttacgtatcttgcattgatcgccactttcaaaattcagccctttctggctttaggattctttctccgcaagctgacctctcgagagaaccttctgctaggcgtgggcctcgcgatggccacaaccctgcaattgccggaagacatcgagcagatggcaaatgggattgctctgggattaatgactctcaaactgatcacacagttcgaaacctaccagctttggacagccctggtctccttgacttgttcaaacaccatatttacgctcacagtggcctggcggaccgctactctggttctagcaggtgtgagtctgcttcctctctgccaaagctcgtccatgcgtaagaccgattggctgccaatgacagtcgccgcgatgggcgtaccccctttgcccctgttcatcttttctttaaaggacactccaaaaagaaggagctggcctctcaatgagggggtgatggctgttggactggtgtcaattcttgccagttccctgttgcgcaacgatgtccccatggcaggcccactcgtggccggtgggctgctaatcgcttgttatgtaattaccggaacgtctgcagacctgacagtggagaaggccgcggacgtcacctgggaagaggaagctgagcagactggcgttagccataaccttatgatcacagtggatgacgatggcaccatgcggataaaagacgatgaaactgagaatattctcacagtgctgttgaagaccgccttactgatcgtctccgggatcttcccgtactcaattcctgcaacgctcctggtgtggcacacttggcagaaacagacccaaagaagcggagttctttgggacgtacccagtccacccgagacacagaaggccgaactggaggaaggtgtgtacaggataaaacagcagggcatctttgggaagacccaagtcggagtgggcgttcagaaggagggtgtgttccatacaatgtggcacgtcactcgaggggctgtgttgacccacaacggaaaacgcctagagcctaattgggcctctgtaaagaaagatctgatttcctatggcggcgggtggcggctcagcgcacagtggcaaaagggagaagaggtccaggtgatcgctgttgaaccaggtaaaaaccccaagaatttccagacgatgcctggcatttttcagacaactaccggggagatcggagccatagcgctggacttcaagccgggcacatcgggttcaccaatcattaacagagaagggaaagtggtcggactttacggcaatggcgtggttaccaagaacgggggatatgtgtctggtatcgcccaaactaatgcagagcccgatggccctaccccagagttagaagaggaaatgtttaaaaagaggaacctgacaattatggacctccatcccgggagtggaaaaacgcgtaagtacttgcctgctatcgtccgcgaggccataaagcggagactgaggactctcattctggctccgacccgagtggtagcagccgaaatggaggaggcccttaaaggcctgcccatccggtatcagacaaccgctactaagtccgaacacacaggtcgcgagatcgtggatttgatgtgccatgcgaccttcacgatgagactactgagcccagttagggtccctaattacaacctcattatcatggacgaagcacactttactgatcccgcctctatagctgcccgggggtatattagcacacgagtgggaatgggcgaggcagccgctatcttcatgaccgcgaccccacctggcactgccgaagcatttccccagtccaatgctccaattcaggacgaggagagagacatcccggaacgctcatggaacagtgggaatgagtggataacagatttcgtgggaaaaaccgtctggtttgtacctagcattaaggccggtaacgacatcgcaaactgtttaaggaaaaatggcaagaaggtgatccaactgtctcgtaaaacattcgatactgaataccagaagacgcggcttaacgactgggattttgttgtgaccacagacatttccgagatgggggccaatttcaaagctgatagagtcatcgaccccaggcgctgcctgaagccagtgattctcactgatggacccgagcgagttatattggccggccctatgccagtgaccgcggcatcagccgctcagagacggggtagggtcgggcgcaacccccagaaagaaaatgaccaatacatcttcacaggccagcctctgaacaatgatgaggaccatgcccactggaccgaagctaagatgctcctggacaacattaatactccggagggaatcatcccagcactttttgaacccgagcgtgagaagagtgccgctattgatggcgaatatagactaaaaggggagagccggaagacgttcgtggaactgatgaggcgcggagacttgcctgtatggttagcccacaaagtggcatccgagggtataaagtacaccgatcgaaaatggtgctttgacggcgaaagaaacaatcagatcctggaggagaacatggatgttgaaatttggacaaaggagggggaacggaaaaagctcaggccccgctggctggacgcgagaacttattctgatccacttgccctgaaggagttcaaagactttgctgccggaaggaagtcgatcgcactcgatttggtcaccgaaattggccgggtgcctagccatctggcttaccgtacacgcaatgccctagacaacctggtgatgctccacacctcagagcatggtgggcgagcatatagacacgccgtcgaggaacttcccgagactatggaaacactgttattgctgggcctcatgatcctgcttacgggaggcgctatgctgttcctcatatccgggaaaggaatcggtaagaccagtattggcttgatctgtgttattgtgtctagcgggatgctgtggatggcggatgtaccattacagtggatcgcctccgcaatagtgctagagtttttcatgatggtcctgctcattcctgagccggaaaaacaaaggactccccaggacaatcagcttgcttacgtggttatcggaattctgacattggccgccatcgtggcagctaacgagatgggcctgctcgaaaccaccaagcgggatctgggtatgtcaaaggagccaggggtcgtatctcctacaagctatcttgacgtggacctccaccccgccagtgcgtggactctgtacgctgttgccacgaccgtgataacaccaatgttgcgccatactatcgaaaattccaccgcaaacgtcagcctggccgctattgcaaaccaagccgtggtcttaatgggcctagataaaggatggcctatctctaagatggacctgggcgcgcccctccttgctctggggtgctactcacaggtgaatccgttgacactgaccgccgcagttctcctgcttgtgactcactatgccattatcggaccaggcttacaggctaaagccacgagagaggcacagaagaggacagctgccggtataatgaaaaaccctaccgtagatgggattatgactatcgacctggatcccgtgatctacgactccaagtttgagaagcaactcggacaggtcatgttgctggttctatgtgcggtgcagctgctccttatgcggaccagttgggccctgtgcgaagcattgacactggctactggcccaattaccacactctgggagggtagccccggcaaattctggaatacgaccatcgccgtctcgatggcaaacatatttcgagggtcttatctggctggagccggcttagccttctccattatgaagagcgtggggactggaagacgcggcacaggttcacagggggaaacccttggagagaaatggaagaaaaagctgaatcaactcagtaggaaggaatttgatctatacaaaaagtctggcatcactgaggtagaccggacagaggcgaaagaaggtctgaagcgtggcgagaccacgcatcacgctgtgtccagagggagcgcaaaattgcagtggttcgttgaaaggaacatggtgattcctgagggacgcgtcatcgatctgggctgtgggcggggaggctggtcatattactgcgccggtctcaagaaagtgaccgaagtccgagggtatacaaagggaggcccgggccatgaggagcccgtgccaatgagtacttacgggtggaatatagttaagcttatgagcggaaaagacgtattctacctgcctcccgaaaagtgtgataccttgctgtgcgacatcggtgagtcctctcctagcccaacagtggaagagtccagaactattagggtcctcaaaatggtggagccctggttaaagaacaatcagttttgtatcaaagttctgaacccttatatgccaaccgtgattgaacaccttgagcgcctgcagcggaagtacggcgggatgctagtcagaaatcccctctcacgtaactctacacacgaaatgtattggatcagtaatggaaccggcaacattgtgtcgagcgtaaatatggtgtccaggctgttgctgaaccggttcactatgacgcatcgccgaccgacaatcgagaaggatgttgacctcggtgctgggaccagacacgtcaacgccgaacctgagactccaaatatggacgtgataggagagaggattaaacggatcaaggaagagcattcttcaacctggcactacgatgacgaaaacccctataaaacatgggcataccacggcagctatgaggtgaaggccacgggctccgctagttctatgatcaatggggtcgttaaacttctgaccaagccttgggatgtggtaccaatggtgactcaaatggcgatgacagacaccactccctttggacagcagcgcgtcttcaaggaaaaagtggatacaagaaccccgaggcctatgcccggtacacgaaaggttatggagattactgccgagtggttatggcggaccctgggccgtaacaaaaagccaagattgtgcacgcgcgaagagtttaccaaaaaggtgaggacaaatgcagctatgggggccgtcttcactgaagagaaccaatgggacagcgcacgggccgctgtggaagatgaggagttttggaagctcgtagacagagaacgcgagctgcataaactaggaaagtgtggctcatgcgtttacaatatgatgggtaaaagggaaaagaaacttggggagttcggaaaggccaaaggctcccgagcgatatggtacatgtggctgggcgcacggtatctcgagtttgaagccctggggttcttgaacgaggatcactggtttagtagagaaaatagctactctggagtggagggtgaaggcctgcataagctcgggtatatccttagggacatttccaagatccctggaggcgctatgtacgccgatgacaccgcaggttgggacacacgcattactgaggatgacctgcacaacgaggaaaaaatcacccagcagatggatcccgagcatcgtcagttagctaatgccatattcaagctgacgtatcaaaacaaagtcgtgaaggtgcagcggccaacacccaaagggaccgtcatggacatcatttcaagaaaggatcagaggggaagcggccaggttggcacttacgggttgaatacatttaccaacatggaagctcaactcgtgcgccagatggagggagaaggtgtactgtcgaaggccgacctagagaatcctcaccttctggagaaaaagatcactcagtggctcgaaaccaaaggcgtggagcgactgaagcggatggcaatttctggggatgactgcgtcgtgaaaccaatcgatgacagattcgcgaacgccttgttagctctgaacgatatgggaaaggttaggaaggacataccgcagtggcaacccagtaaaggctggcacgattggcagcaggtgcctttctgttcccatcactttcatgaactcattatgaaggacggtcgcaaacttgtcgtgccatgcagaccccaggacgagctgatcgggcgggccaggatcagccaaggagcaggctggtcactaaaggaaacagcttgtctgggcaaagcctatgcacagatgtggtccctcatgtacttccaccgtcgagatttgcgcctggcctctaatgcgatttgcagcgctgtacctgttcactggataccaatcagtagaacgacctggtccattcatgcccaccatcagtggatgactacagaggacatgcttaccgtgtggaaccgggtctggatcgaggataatccctggatggaagacaagactcctgtgacaacctgggaggatgttccgtacctggggaagagggaagaccaatggtgtggaagcctcattggtttaacgtctcgcgcaacatgggcccagaacatcctgaccgctatacagcaggtgagatcattgatcggcgatgaggagtttctggactatatgccaagtatgaaacggttcaggaaggaagaggaatccgagggggccatttggtga

SEQ ID NO: 15575 - RNA, 9873 nt, synthetic construct
  misc_feature 1..9873: note = derived and/or modified CDS sequence (opt3) from DENV-3__EU660411__SS-prME
  source 1..9873: mol_type = other RNA
accagcctgtgcctcatgatgatgcttcccgcaaccctggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcagcttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcagtgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgccaagaagcaagaggtcgtggtcctcggctcccaggaaggagctatgcacaccgccctgactggcgctacagagatccaaaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcactaagaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgtgatcaactggaaggggaaggaactcaaatgcggatccggcattttcgtcacaaatgaggttcacacctggactgagcagtacaagtttcaagccgactctcccaaacggctggcaacagccatcgctggtgcctgggaaaacggcgtgtgtgggatacgaagcaccactcgcatggagaatcttttgtggaagcagatcgcaaacgaactgaattatattctctgggagaacaatatcaaactgaccgtggtagtcggagatattatcggcgtgttagaacaggggaagagaacactgacgccacagcctatggagcttaaatactcatggaagacctggggaaaggctaaaatagttactgccgagacacaaaacagttccttcattatcgacggccccaacaccccagaatgccccagcgcgtctagggcctggaatgtgtgggaggtcgaagactatggttttggggtgttcacaactaacatttggttgaagctccgggaggtttacacccagtcatgtgatcatcgcctgatgagtgctgcaatcaaagacgaaagagccgtgcacgctgatatgggatactggatagagagccagaagaatggctcctggaaactagagaaggcctcttttatcgaagtaaagacgtgcacatggcctaaatcgcacaccctgtggagcaacggtgtcctcgagtccgacatgattatcccaaagtcactggcaggcccgattagtcagcataatcacaggcccgggtatcatactcaaaccgcgggaccttggcaccttggcaaattggaactggatttcaactactgcgaggggacaactgtggtgatcaccgagaattgtggaacacgtggcccatctttacggacgaccactgtcagcggtaagctcatacacgaatggtgctgtcgatcctgcacactgccccctcttagatatatgggggaggacggatgttggtacggcatggaaattaggccaatcaacgagaaagaagagaatatggttaagtcactggtgagcgccggttctggcaaggtagataactttaccatgggggtgttgtgcctcgctatcctgttcgaggaagtcatgcgcggaaaattcggcaagaaacatatgattgccggggtgctatttactttcgttctgctcctgtccggacagatcacatggcgggacatggcacacacccttattatgataggcagtaatgctagcgatagaatgggtatgggggtgacgtatttggccctgatcgcaacttttaagattcagcccttcttagccctcggatttttcctgaggaaacttacctctcgcgagaacctgctactcggcgtcggcctggctatggcgacaaccttgcaactgccggaagacatcgagcagatggccaatgggattgcattaggactcatgactctgaaacttatcacacagtttgaaacctaccagctgtggacagctttggtgtccctcacttgttcaaacaccatattcacgctgacagttgcctggcgaaccgccactctaatcctggctggtgtgagtcttctccctctgtgccaaagctcgtccatgcggaagaccgattggttgccaatgacagtcgcagccatgggcgtaccccctctgcccttatttattttctctctcaaagacactccaaagcgtagaagctggcctctgaatgagggggtgatggcggttggacttgtgtcaatcctggctagttccttgctcaggaacgatgtccccatggccggcccactggtggccggtgggctactgattgcctgttatgtaatcaccggaacgtctgctgaccttacagtggagaaagcagccgacgtcacctgggaagaggaagcggagcagactggcgttagccataacctcatgataacagtggatgacgatggcaccatgcgcattaaggacgatgaaactgagaatatcctgacagtgttgttaaaaaccgctctgctcatcgtctccgggatttttccgtactcaatacctgccacgctgcttgtgtggcacacttggcagaagcagacccaacggagcggagttctgtgggacgtacccagtccacccgagacacagaaagcagaattggaggaaggtgtgtacagaatcaagcagcagggcattttcgggaagacccaagtcggagtgggcgttcagaaagagggtgtgtttcatacaatgtggcacgtcactcgaggggcagtgctaacccacaacggaaagaggctggagcctaattgggcttctgtcaagaaggatctcatctcctatggcggcgggtggcgcctgagcgcccagtggcaaaaaggagaagaggtccaggtgattgcagttgaaccaggtaagaaccccaagaatttccagacgatgcctggcatcttccagacaactaccggggagataggagctatcgcccttgactttaaaccgggcacatcgggttcaccaattatcaaccgggaagggaagattgtgggattatacggcaatggcgtcgtgaccaaaaacgggggatatgtttctggtatcgcgcaaactaatgccgagcccgatggccctaccccagagctggaagaggaaatgttcaagaaaagaaacctcacaataatggacttgcatcccgggagtggaaagacgaggaagtacctgcctgcaattgtgcgtgaggctatcaaacgccggctcagaactctgatccttgccccgaccagggtcgtggctgcagaaatggaggaggccctgaagggcttgcccattcgatatcagacaaccgccatcaaatccgaacacactggtcgggagatagtagatctaatgtgccatgctacatttaccatgcgcctgctcagcccagtgagagttcctaattacaacttaattatcatggacgaagcgcacttcacggatcccgcatctattgccgctagggggtatatcagcactcgggtcggaatgggcgaggccgcagccatatttatgacagctaccccacctggcaccgcggaagccttcccccagtccaatgcaccaattcaggacgaggagcgagacatcccggaaagatcatggaacagtgggaatgagtggatcactgattttgtgggaaagacagtgtggttcgtccctagcattaaagctggtaacgacatcgccaactgtctgcgcaagaatggcaagaaagtaattcaactttctaggaagacctttgatacagaataccagaaaactcgtctgaacgactgggatttcgtggttacgaccgacatatccgagatgggggcaaattttaaggccgatcgggtgatcgaccccagaaggtgcctcaaaccagtcattttgacagatggacccgagcgcgtgatcctggctggccctatgccagttactgccgcgtcagcagcccagcgaagaggtcgggtggggaggaacccccagaaggaaaatgaccaatacatcttcaccggccagcctctcaacaatgatgaggaccatgctcactggacagaagccaagatgctgcttgacaacattaataccccggagggaataatcccagctctattcgaacccgagcgcgagaaaagtgcagccattgatggcgaatatcgtctgaagggggagagcagaaaaacttttgtcgaattgatgcggaggggagacttacctgtgtggctggctcacaaggtagcctccgagggtatcaaatacacggatcgcaagtggtgcttcgacggcgaacgaaacaatcagattctcgaggagaacatggatgtggaaatctggaccaaagagggggaaagaaagaagctgcggcccaggtggcttgacgcacgcacatattctgatccactggcgctcaaagagtttaaggacttcgccgctggaagaaaatcgatagccttggatctggttactgaaatcggcagggtccctagccatctagcataccggacccgtaatgctctggacaacctcgtgatgcttcacacatcagagcatggtgggcgcgcctatcgacacgcagtggaggaactgcccgagaccatggaaactttattgctgctcggcctgatgattcttctgacaggaggcgccatgctctttttgatctccgggaagggaattggtaaaacgagtatcggcctgatatgtgtcattgtttctagcgggatgttatggatggctgatgtgccactacagtggatcgcgtccgccattgtactggagttctttatgatggtgctccttatccctgagccggaaaagcaaagaacaccccaggacaatcagctggcatacgtcgtgataggaatcttgactctggctgccattgttgccgcaaacgagatgggcctcctggaaacaaccaagagggatcttggtatgtcaaaagagccaggggtggtctctcctaccagctatctcgacgtagacctgcaccccgctagtgcctggacattgtacgcggtggctactacggttatcaccccaatgctgcggcatacaattgaaaattccactgccaacgtgagcttagcagccatcgctaaccaagcagtcgtgctaatgggcctggataagggatggcctatatctaaaatggacctcggcgtcccccttctggccttggggtgctactcacaggtgaatccgctgaccctcacagcggctgttctgcttttagtgacccactatgccattatcggaccaggcctgcaggcaaaggccactcgcgaggctcagaaaagaacggccgcaggtatcatgaagaaccctacagtagatgggattatgaccatcgacctcgatcccgtgatatacgactccaagttcgagaaacaattgggacaggtcatgctgctagttctgtgtgctgtgcagctccttctgatgaggacaagttgggccttgtgcgaagcgctgaccctcgccacaggcccaattactaccctgtgggagggtagccccggcaagttttggaatacaacgatcgcagtctcgatggctaacattttccgggggtcttatttagccggagcaggccttgctttttccatcatgaaaagcgtggggaccggacgaagaggcactggttcacagggggaaacactgggagagaagtggaaaaagaagctcaatcaactaagtcgcaaagagttcgatctgtacaagaaatctggcataaccgaggtagacaggactgaggccaaggaaggtttgaaacggggcgagacaacccatcacgccgtgtcccgtgggagcgcgaagctgcagtggtttgttgaaagaaacatggtgatccctgagggaagggtcattgatctcggctgtgggcgcggaggctggtcatattactgcgctggtcttaaaaaggtgacggaagtccgggggtataccaagggaggcccgggccatgaggagcccgtgccaatgagtacatacgggtggaatatcgttaaactgatgagcggaaaggacgtattctacttgcctcccgaaaaatgtgatactctgctctgcgacattggtgagtcctctcctagcccaaccgtggaagagtcccgaacaatcagagtcttaaagatggtggagccctggctgaaaaacaatcagttctgtattaaggttcttaacccttatatgccaactgtgatcgaacacctggagaggctacagcgcaagtacggcgggatgctcgtccggaatcccctgtcaagaaactctacccacgaaatgtattggataagtaatggaacaggcaacattgtgtcgagcgtaaatatggtgtcccgtttgctgctcaacaggtttaccatgactcatcggcgcccgacgatcgagaaagatgttgaccttggtgcagggacacgacacgtcaacgccgaacctgagaccccaaatatggacgtgatcggagagagaattaagaggataaaagaagaacactcttcaacttggcactacgatgacgaaaacccctataagacctgggcttaccacggcagctatgaggtgaaagccacaggctccgcaagttctatgatcaatggggtcgttaagctgttaacgaagccttgggatgtggtaccaatggtgacccaaatggccatgactgacacaacccccttcggacagcagcgggtctttaaagaaaaggtggatactcgcacaccgagacctatgcccggtaccaggaaagttatggagattacagctgagtggctgtggcgaactttgggccggaacaagaaaccacgtctctgcaccagagaagagttcacgaagaaggtgcgcaccaatgcggccatgggggcagtctttacagaagagaaccaatgggacagcgctagggccgcagtggaagatgaggagttctggaaactggtagaccgggaaagagagctacataaacttggaaaatgtggctcatgcgtttacaatatgatgggtaagcgcgagaaaaagctgggggagtttggaaaagccaagggctccagggctatctggtacatgtggctcggcgcccgatatctggagttcgaagcgttggggtttctgaacgaggatcactggttcagtcgggaaaatagctactctggagtggagggtgaaggcctccataaacttgggtatattctgagagacatctccaaaatacctggaggcgcaatgtacgccgatgacactgctggttgggacaccaggatcacagaggatgacttacacaacgaggaaaagattactcagcagatggatcccgagcatcgccagctggccaatgcaatctttaaattgacctatcaaaacaaggtcgtgaaagtgcagcgtccaacgcccaaggggacagtcatggacattatctcacggaaggatcagagaggaagcggccaggttggcacctacgggctcaatactttcacaaacatggaagctcaactggtgaggcagatggagggagaaggtgtactatcgaaagccgaccttgagaatcctcatctgctcgagaagaaaataacccagtggctggaaactaagggcgtggagcgcttgaaacgaatggctatttctggggatgactgcgtcgtgaagccaatcgatgaccggtttgccaacgcattactggcgctcaacgatatgggaaaggttagaaaagacatcccgcagtggcaacccagtaagggctggcacgattggcaacaggtgcctttctgttcccatcacttccatgaacttattatgaaagacggtaggaagctggtcgtgccatgccgcccccaggacgagctaatagggagagcccggatcagccaaggagctggctggtcactgaaagaaaccgcctgtctcggcaaggcatatgctcagatgtggtccttgatgtactttcacaggcgtgatctgcgacttgcctctaatgcaatttgcagcgccgtacctgttcactggatcccaacaagtcgcacgacctggtccattcatgcgcaccatcagtggatgactacagaggacatgctgaccgtgtggaacagagtctggatcgaggataatccctggatggaagacaagactcctgtgacaacctgggaggatgttccgtacctcgggaaacgggaagaccaatggtgtggcagcttaataggtctgacgtctagggctacatgggcccagaacatcttgaccgcaattcaacaggtgcgctcactgatcggcgatgaggagttcctcgactatatgccaagtatgaagagatttcggaaagaagaggaatccgagggggccatttggtga

SEQ ID NO: 15576 - RNA, 9873 nt, synthetic construct
  misc_feature 1..9873: note = derived and/or modified CDS sequence (opt3) from DENV-3__FJ432722__SS-prME
  source 1..9873: mol_type = other RNA
acaagcctgtgcctcatgatgatgcttcccgcaacactggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgccaagaagcaagaggtcgtggtcctcggctcccaggaaggagctatgcacaccgccctgactggcgctacagagatccaaaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcaccaagaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgtgatcaactggaaggggaaggaactcaaatgcggatccggcattttcgtcacaaatgaggttcacacctggactgagcagtacaagtttcaagccgactctcccaaacggctggcaacagccatcgctggtgcctgggaaaacggcgtgtgtgggatacgaagcaccactcgcatggagaatcttttgtggaagcagatcgcaaacgaactgaattatattctctgggagaacaatatcaaactgaccgtggtagtcggagatattatcggcgtgttagaacaggggaagagaacactgacgccacagcctatggagcttaaatactcatggaagacctggggaaaggctaaaatagttactgccgagacacaaaacagttccttcattatcgacggccccaacaccccagaatgccccagcgcgtctagggcctggaatgtgtgggaggtcgaagactatggttttggggtgttcacaactaacatttggttgaagctccgggaggtttacacccagtcatgtgatcatcgcctgatgagtgctgcaatcaaagacgaaagagccgtgcacgctgatatgggatactggatagagagccagaagaatggctcctggaaactagagaaggcctcttttatcgaagtaaagacgtgcacatggcctaaatcgcacaccctgtggagcaacggtgtcctcgagtccgacatgattatcccaaagtcactggcaggcccgattagtcagcataatcacaggcccgggtatcatactcaaaccgcgggaccttggcaccttggcaaattggaactggatttcaactactgcgaggggacaactgtggtgatcaccgagaattgtggaacacgtggcccatctttacggacgaccactgtcagcggtaagctcatacacgaatggtgctgtcgatcctgcacactgccccctcttagatatatgggggaggacggatgttggtacggcatggaaattaggccaatcaacgagaaagaagagaatatggttaagtcactggtgagcgccggttctggcaaggtagataactttaccatgggggtgttgtgcctcgctatcctgttcgaggaagtcatgcgcggaaaattcggcaagaaacatatgattgccggggtgctatttactttcgttctgctcctgtccggacagatcacatggcgggacatggcacacacccttattatgataggcagtaatgctagcgatagaatgggtatgggggtgacgtatttggccctgatcgcaacttttaagattcagcccttcttagccctcggatttttcctgaggaaacttacctctcgcgagaacctgctactcggcgtcggcctggctatggcgacaaccttgcaactgccggaagacatcgagcagatggccaatgggattgcattaggactcatgactctgaaacttatcacacagtttgaaacctaccagctgtggacagctttggtgtccctcacttgttcaaacaccatattcacgctgacagttgcctggcgaaccgccactctaatcctggctggtgtgagtcttctccctctgtgccaaagctcgtccatgcggaagaccgattggttgccaatgacagtcgcagccatgggcgtaccccctctgcccttatttattttctctctcaaagacactccaaagcgtagaagctggcctctgaatgagggggtgatggcggttggacttgtgtcaatcctggctagttccttgctcaggaacgatgtccccatggccggcccactggtggccggtgggctactgattgcctgttatgtaatcaccggaacgtctgctgaccttacagtggagaaagcagccgacgtcacctgggaagaggaagcggagcagactggcgttagccataacctcatgataacagtggatgacgatggcaccatgcgcattaaggacgatgaaactgagaatatcctgacagtgttgttaaaaaccgctctgctcatcgtctccgggatttttccgtactcaatacctgccacgctgcttgtgtggcacacttggcagaagcagacccaacggagcggagttctgtgggacgtacccagtccacccgagacacagaaagcagaattggaggaaggtgtgtacagaatcaagcagcagggcattttcgggaagacccaagtcggagtgggcgttcagaaagagggtgtgtttcatacaatgtggcacgtcactcgaggggcagtgctaacccacaacggaaagaggctggagcctaattgggcttctgtcaaaaaggatctcatctcctatggcggcgggtggcgcctgagcgcccagtggcaaaaaggagaagaggtccaggtgattgcagttgaaccaggtaagaaccccaagaatttccagacgatgcctggcatcttccagacaactaccggggagataggagctatcgcccttgactttaaaccgggcacatcgggttcaccaattatcaaccgggaagggaaggtggtcggattatacggcaatggcgtggttaccaaaaacgggggatatgtgtctggtattgcgcaaactaatgccgagcccgatggccctaccccagagctggaagaggaaatgttcaagaaaagaaacctcacaatcatggacttgcatcccgggagtggaaagacgaggaagtacctgcctgcaatagtccgtgaggctattaaacgccggctcagaactctgatccttgccccgaccagggtggtagctgcagaaatggaggaggccctgaagggcttgcccatccgatatcagacaaccgccactaaatccgaacacacaggtcgggagattgtggatctaatgtgccatgctacctttacgatgcgcctgctcagcccagttagagtccctaattacaacttaatcataatggacgaagcgcacttcactgatcccgcatctattgccgctagggggtatatcagcacacgggtgggaatgggcgaggccgcagccatttttatgaccgctaccccacctggcactgcggaagccttcccccagtccaatgcaccaatccaggacgaggagcgagacataccggaaagatcatggaacagtgggaatgagtggattacagattttgtgggaaagaccgtctggttcgtacctagcatcaaagctggtaacgacatcgccaactgtctgcgcaagaatggcaagaaagtgattcaactttctaggaagacatttgatactgaataccagaaaacgaagctgaacgactgggatttcgttgtgaccacagacatctccgagatgggggcaaattttaaagccgatcgtgtcattgacccccggagatgcctcaagccagtgatattgactgatggacccgagagggttatcctggctggccctatgccagtgaccgccgcgtcagcagcccagcgccgaggtagagtcgggcggaacccccagaaggaaaatgaccaatacattttcacaggccagcctctcaacaatgatgaggaccatgctcactggaccgaagccaaaatgctgcttgacaacatcaatactccggagggaatcattccagctctattcgaacccgagagggagaagagtgcagccatagatggcgaatatcgcctgaaaggggagagccgtaagacgtttgtggaattgatgagacggggagacttacctgtatggctggctcacaaagtggcctccgagggtatcaagtacaccgataggaaatggtgcttcgacggcgaacgcaacaatcagattctcgaggagaacatggatgttgaaatctggacaaaggagggggaacgaaagaaactgagaccccggtggcttgacgcaaggacttattctgatccactggcgctcaaggagtttaaagacttcgccgctggacgcaagtcgattgccttggatctggtcaccgaaatcggcagagtgcctagccatctagcatacaggacacggaatgctctggacaacctcgtgatgcttcacacctcagagcatggtgggcgtgcctatcgccacgcagtcgaggaactgcccgagactatggaaacattattgctgctcggcctgatgatacttctgacgggaggcgccatgctctttttgatctccgggaaaggaattggtaagaccagtatcggcctgatttgtgttatcgtgtctagcgggatgttatggatggctgatgtaccactacagtggatagcgtccgccattgtgctggagttctttatgatggtcctccttatccctgagccggaaaagcaacgaactccccaggacaatcagctggcatacgtggttattggaatcttgacactggctgccatagtggccgcaaacgagatgggcctcctggaaaccaccaaaagagatcttggtatgtcaaaggagccaggggtcgtatctcctacaagctatctcgacgtggacctgcaccccgctagtgcctggactttgtacgcggttgctacgaccgtgatcacaccaatgctgaggcatactattgaaaattccaccgccaacgtcagcttagcagccatcgctaaccaagcagtggtcctaatgggcctggataaaggatggcctatttctaagatggacctcggcgtgccccttctggccttggggtgctactcacaggttaatccgctgacactcaccgcggctgtgctgcttttagtaactcactatgccatcataggaccaggcctgcaggcaaaagccacgcgggaggctcagaagcgcacagccgcaggtattatgaagaaccctaccgtggatgggatcatgactatcgacctcgatcccgtcatttacgactccaaattcgagaagcaattgggacaggttatgctgctagtgctgtgtgctgtccagctccttctgatgagaaccagttgggccttgtgcgaagcgctgacactcgccactggcccaatcaccacactgtgggagggtagccccggcaaattttggaatacgaccatagcagtgtcgatggctaacattttcagggggtcttatttagccggagcaggccttgctttttccatcatgaaaagcgtagggactggacggcgaggcacaggttcacagggggaaaccctgggagagaaatggaagaagaaactcaatcaactaagtagaaaggagttcgatctgtacaaaaagtctggcattactgaggtggaccgcacagaggccaaagaaggtttgaagaggggcgagaccacgcatcacgccgtttcccgggggagcgcgaaactgcagtggtttgtggaacgtaacatggtcatccctgagggaagagtgatagatctcggctgtgggaggggaggctggtcatattactgcgctggtcttaagaaggtcaccgaagtgcgcgggtatacaaaaggaggcccgggccatgaggagcccgttccaatgagtacttacgggtggaatatcgtaaagctgatgagcggaaaagacgtgttctacttgcctcccgaaaagtgtgataccctgctctgcgacattggtgagtcctctcctagcccaacagtcgaagagtcccggactatccgagtgttaaaaatggttgagccctggctgaagaacaatcagttctgtattaaggtgcttaacccttatatgccaaccgtcatcgaacacctggagagactacagaggaaatacggcgggatgctcgtgcgcaatcccctgtcacggaactctacacacgaaatgtattggattagtaatggaaccggcaacatcgtatcgagcgtgaatatggtttccagattgctgctcaaccgttttactatgacgcataggcggccgacaatagagaaggatgtcgaccttggtgcagggacccgccacgtgaacgccgaacctgagactccaaatatggacgtgattggagagcgaatcaaaagaatcaaggaagaacactcttcaacctggcactacgatgacgaaaacccctataaaacatgggcttaccacggcagctatgaggtcaaggccacgggctccgcaagttctatgattaatggggttgtgaagctgttaaccaaaccttgggatgtagtgccaatggtcactcaaatggccatgacagacaccactcccttcggacagcagagggtgtttaaggaaaaagttgatacacggaccccgcgccctatgcccggtacaagaaaggtgatggagataactgctgagtggctgtggaggaccttgggccgaaacaaaaagccacggctctgcacgcgtgaagagttcaccaagaaagtcagaacaaatgcggccatgggggcagtgtttactgaagagaaccaatgggacagcgctcgcgccgcagtagaagatgaggagttctggaagctggttgacagggaacgggagctacataaacttggaaagtgtggctcatgcgtgtacaatatgatgggtaaaagagaaaagaaactgggggagtttggaaaggccaagggctcccgcgctatctggtacatgtggctcggcgccaggtatctggagttcgaagcgttggggtttctgaacgaggatcactggttcagtcgagaaaatagctactctggagtcgagggtgaaggcctccataaacttgggtatattctgcgggacatctccaagattcctggaggcgcaatgtacgccgatgacaccgctggttgggacacaagaatcactgaggatgacttacacaacgaggagaaaataacccagcagatggatcccgagcataggcagctggccaatgcaatctttaagttgacgtatcaaaacaaagtggtgaaggtccagcgcccaacacccaaggggaccgttatggacattatctcacgtaaagatcagcggggaagcggccaggtgggcacttacgggctcaatacattcaccaacatggaagctcaactggtaagacagatggagggagaaggtgtgctatcgaaggccgaccttgagaatcctcatctgctcgagaaaaagattactcagtggctggaaaccaaaggcgtcgagaggttgaagcgcatggctatctctggggatgactgcgtggttaagccaatagatgaccgatttgccaacgcattactggcgctcaacgatatgggaaaagtgcggaaggacattccgcagtggcaacccagtaaaggctggcacgattggcagcaggtccctttctgttcccatcacttccatgaacttatcatgaaggacggtagaaaactggtggtaccatgcaggccccaggacgagctaatcgggcgcgccagaattagccaaggagctggctggtcactgaaggaaacagcctgtctcggcaaggcatatgctcagatgtggtccttgatgtactttcaccggagggatctgcgtcttgcctctaatgcaatatgcagcgccgttcctgtgcactggatcccaacgagtcgaaccacttggtccattcatgcgcaccatcagtggatgacaaccgaggacatgctgactgtctggaaccgcgtgtggatcgaggataatccctggatggaagacaaaacacctgttaccacgtgggaggatgtgccgtacctcgggaagagagaagaccaatggtgtggcagcttaattggtctgacatctcgggctacctgggcccagaacatcttgactgcaatacagcaggtcaggtcactgatcggcgatgaggagttcctcgactatatgccaagtatgaaacgctttagaaaggaagaggaatccgagggggtgatttggtga

SEQ ID NO: 15577 - RNA, 9873 nt, synthetic construct
  misc_feature 1..9873: note = derived and/or modified CDS sequence (opt3) from DENV-3__FJ432728__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgaggactgtggaacacgtggcccatctttacggacgaccactgtgagcggtaagctcatacacgaatggtgctgtcgatcctgcacactgccccctcttagatatatgggggaggatggatgttggtacggcatggaaattaggccaatcaatgagaaagaagagaacatggtcaagtcactggttagcgctggttctggcaaggtggacaattttaccatgggggtattgtgcctcgccatcctgttcgaggaagtgatgcgcggaaaattcggcaagaaacatatgattgcaggggtcctatttactttcgtgctgctcctgtccggacagatcacatggcgggatatggctcacacccttattatgataggcagtaacgccagcgacagaatgggtatgggggttacgtatttggcactgatcgccacttttaagattcagcccttcttagctctcggatttttcctgaggaaacttacctctcgcgagaatctgctactcggcgtgggcctggcgatggccacaaccttgcaactgccggaagatatcgagcagatggcaaacgggattgctttaggactcatgactctgaagcttatcacacagtttgaaacctaccagctgtggacagccttggtctccctcacttgttcaaataccatattcacgctgacagtggcctggcgaaccgctactctaatcctggcaggtgttagtcttctccctctgtgccaaagctcgtccatgcggaagaccgactggttgccaatgacagtggccgcgatgggcgtcccccctctgcccttatttattttctctctcaaagatactccaaagcgtagaagctggcctctgaacgagggggtaatggctgtgggacttgtttcaatcctggccagttccttgctcaggaatgacgtgcccatggcaggcccactggtcgccggtgggctactgattgcttgttatgtgatcaccggaacgtctgcagaccttacagtagagaaagccgcggatgtgacctgggaagaggaagctgagcagactggcgtcagccataacctcatgataacagttgacgatgacggcaccatgcgcattaaggatgacgaaactgagaacatcctgacagtgttgttaaaaaccgccctgctcatcgtgtccgggatttttccgtactcaatacctgcaacgctgcttgtctggcacacttggcagaagcagacccaacggagcggagtgctgtgggatgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaatggaaagcgactggagcctaactgggcctctgtgaaaaaggacctcatctcctatggcggcgggtggcgcctgagcgcacagtggcaaaaaggagaagaggtacaggtcattgctgtggaaccaggtaagaatcccaagaacttccagacgatgcctggcatcttccagacaactaccggggagataggagccatcgcgcttgattttaaaccgggcacatcgggttcaccaattatcaatcgggaagggaaggttgtgggattatacggcaacggcgtcgtgaccaaaaatgggggatatgtttctggtattgcccaaactaacgcagagcccgacggccctaccccagagctggaagaggaaatgttcaagaaaagaaatctcacaatcatggatttgcatcccgggagtggaaagacgaggaagtacctgcctgctatagtgcgtgaggccattaaacgccggctcagaactctgatccttgctccgaccagggtcgtggcagccgaaatggaggaggccctgaagggcttgcccatccgatatcagacaaccgctactaaatccgaacacacaggtcgggagattgtagacctaatgtgccatgcgacctttacgatgcgcctgctcagcccagtgagagttcctaactacaatttaatcataatggatgaagcacacttcactgaccccgcctctattgctgccagggggtatatcagcacacgggtcggaatgggcgaggcagccgctatttttatgaccgcgaccccacctggcactgccgaagcattcccccagtccaacgctccaatccaggacgaggagcgagatataccggaaagatcatggaatagtgggaacgagtggattacagactttgtgggaaagaccgtgtggttcgtccctagcatcaaagccggtaatgatatcgcaaactgtctgcgcaagaacggcaagaaagtaattcaactttctaggaagacatttgacactgaataccagaaaacgcgtctgaatgattgggacttcgtggttaccacagatatctccgagatgggggccaactttaaggctgaccgggtgattgatcccagaaggtgcctcaaaccagtcatattgactgacggacccgagcgcgtgatcctggccggccctatgccagttaccgcggcatcagccgctcagcgaagaggtcgggtggggaggaatccccagaaggaaaacgatcaatacattttcacaggccagcctctcaataacgacgaggaccatgcccactggaccgaagctaagatgctgcttgataatatcaacactccggagggaatcattccagcactattcgaacccgagcgcgagaaaagtgccgctatagacggcgaatatcgtctgaagggggagagcagaaaaacgtttgtcgaattgatgcggaggggagatttacctgtgtggctggcccacaaggtagcatccgagggtatcaaatacaccgaccgcaagtggtgcttcgatggcgaacgaaataaccagattctcgaggagaatatggacgtggaaatctggacaaaagagggggaaagaaagaagctgcggcccaggtggcttgatgcgcgcacttattctgacccactggccctcaaagagtttaaggatttcgctgccggaagaaaatcgattgcattggacctggttaccgaaatcggcagggtccctagccatctagcttaccggacacgtaacgccctggataatctcgtgatgcttcacacctcagagcatggtgggcgcgcatatcgacacgccgtggaggaactgcccgagactatggaaacattattgctgctcggcctgatgatacttctgacgggaggcgctatgctctttttgatctccgggaagggaattggtaaaaccagtatcggcctgatttgtgtcatcgtttctagcgggatgttatggatggcggacgtgccactacagtggatagcctccgcaattgtactggagttctttatgatggtgctccttatccctgagccggaaaagcaaagaactccccaggataaccagctggcttacgtcgtgattggaatcttgacactggccgccatagttgcagctaatgagatgggcctcctggaaaccaccaagagggaccttggtatgtcaaaagagccaggggtggtctctcctacaagctatctcgacgtagatctgcaccccgccagtgcgtggactttgtacgctgtggccacgaccgttatcacaccaatgctgcggcatactattgaaaactccaccgcaaatgtgagcttagccgctatcgcaaaccaagccgtcgtgctaatgggcctggacaagggatggcctatttctaaaatggatctcggcgtcccccttctggcgttggggtgctactcacaggtgaacccgctgacactcaccgctgccgttctgcttttagtgactcactatgcaatcataggaccaggcctgcaggccaaggctacgcgcgaggcccagaaaagaacagcagctggtattatgaagaatcctaccgtagacgggatcatgactatcgatctcgaccccgtgatttacgattccaagttcgagaaacaattgggacaggtcatgctgctagttctgtgtgccgtgcagctccttctgatgaggaccagttgggcgttgtgcgaagccctgacactcgcaactggcccaatcaccacactgtgggagggtagccccggcaagttttggaacacgaccatagctgtctcgatggccaatattttccgggggtcttatttagcaggagctggccttgccttttccatcatgaaaagcgtggggactggacgaagaggcacaggttcacagggggaaaccctgggagagaagtggaaaaagaagctcaaccaactaagtcgcaaagaattcgacctgtacaagaaatctggcattactgaggtagataggacagaggccaaggaaggtttgaaacggggcgagaccacgcatcacgcggtgtcccgtgggagcgctaagctgcagtggtttgttgaaagaaatatggtgatccctgagggaagggtcatagacctcggctgtgggcgcggaggctggtcatattactgcgcaggtcttaaaaaggtgaccgaagtccgggggtatacaaagggaggcccgggccatgaggagcccgtgccaatgagtacttacgggtggaacctggttaaattgatgagcggaaaggatgtattctacctgcctcccgaaaaatgtgacaccctcttatgcgatatcggtgagtcctctcctagcccaacagtggaagagtcccgaactattagagtcctgaagatggtggagccctggcttaaaaataaccagttctgtatcaaggttctgaatccttatatgccaaccgtgattgaacacctagagaggctccagcgcaagtacggcgggatgctggtccggaaccccttgtcaagaaattctacacacgaaatgtattggatcagtaacggaaccggcaatattgtgtcgagcgtaaacatggtgtcccgtctgctccttaataggtttactatgacgcatcggcgcccgacaatcgagaaagacgttgacctgggtgccgggacccgacacgtcaacgctgaacctgagactccaaacatggatgtgataggagagagaattaagaggatcaaagaagagcattcttcaacctggcactacgacgatgaaaatccctataagacatgggcctaccacggcagctatgaggtgaaagcaacgggctccgccagttctatgatcaacggggtcgttaagttactgaccaagccttgggacgtggtaccaatggtgactcaaatggctatgacagataccactcccttcggacagcagcgggtctttaaagaaaaggtggacacacgcaccccgagacctatgcccggtacaaggaaagttatggagattactgcggagtggttgtggcgaaccctcggccggaataagaaaccacgtctgtgcacgagagaagagttcaccaagaaggtgcgcacaaacgccgcaatgggggctgtctttactgaagagaatcaatgggatagcgccagggcagccgtggaagacgaggagttctggaaactagtagatcgggaaagagagcttcataagctgggaaaatgtggctcatgcgtttacaacatgatgggtaagcgcgaaaaaaagctcggggagtttggaaaagctaagggctccagggccatatggtacatgtggctgggcgcgcgatatttggagttcgaagcactggggtttctcaatgaggaccactggttcagtcgggaaaacagctactctggagtggagggtgaaggccttcataagctggggtatatcttaagagatatttccaaaatccctggaggcgccatgtacgctgacgacaccgccggttgggatacaaggattactgaggacgatctgcacaatgaggaaaagatcacccagcagatggaccccgagcatcgccagttggcaaacgctatatttaaactcacgtatcaaaataaggtcgtgaaagtgcagcgtccaacacccaaggggaccgtcatggatatcatttcacggaaggaccagagaggaagcggccaggttggcacttacgggctgaacacattcaccaatatggaagcccaactagtgaggcagatggagggagaaggtgtactttcgaaagctgatctggagaaccctcacctcctggagaagaaaatcactcagtggttggaaaccaagggcgtggagcgcttaaaacgaatggccatttctggggacgattgcgtcgtgaagccaatcgacgatcggtttgcaaatgcgctgctcgcccttaacgacatgggaaaggttagaaaagatataccgcagtggcaacccagtaagggctggcacgactggcagcaggtgcctttctgttcccatcacttccatgaactgattatgaaagacggtaggaagctagtcgtgccatgccgcccccaggatgagctgatcgggagagctcggatcagccaaggagccggctggtcactcaaagaaacagcatgtttgggcaaggcttatgcccagatgtggtccctgatgtactttcacaggcgtgaccttcgactggcatctaacgccatttgcagcgcggtacctgttcactggataccaacgagtcgcaccacttggtccatccatgctcaccatcagtggatgacaaccgaggatatgctcactgtgtggaatagagtctggattgaggacaacccctggatggaagataagacacctgtgaccacgtgggaggacgttccgtacttagggaaacgggaagatcaatggtgtggaagcctgatcggtttgacatctagggccacctgggcacagaatattctgactgccatccagcaggtgcgctcactcataggcgacgaggagttccttgattatatgccaagtatgaagagatttcggaaagaagaggaatccgagggggctatctggtga

SEQ ID NO: 15578 - RNA, 9873 nt, synthetic construct
  misc_feature 1..9873: note = derived and/or modified CDS sequence (opt3) from DENV-3__FJ432731__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttatgttcgtgctgctcctgtccggacagatcacttggcgggacatggctcagacacttattatgataggcagtaatgccagcgatagaatgggtatgggggttacctatttggcactgatcgccacgtttaagattcaacccttcttagctctcggatttttcctgaggaaacttacttctcgcgagaacctgctactcggcgtgggcctggcgatgaccacaaccttgcagctgccggaagacatcgagcagatggccaatgggattgcattaggactcatgactctgaagcttatcacacagtttgaaacctaccaactgtggacagctttggtctccctcacttgttcaaacaccatattcacgctgacagtggcctggcgaaccgccactctaatcctggctggtgttagtcttctccctctgtgccagagctcgtccatgcggaagaccgattggttgccaatgacagtggcagccatgggcgtcccccctctgcccttatttattttctctctcaaagacactccaaagcgtagaagctggcctctgaatgagggggtaatggcggtgggacttgtttcaatcctggctagttccttgctcaggaacgatgtgcccatggccggcccactggtcgcaggtgggctactgattgcctgttatgtgatcaccggaacgtctgctgaccttacagtagagaaagcagccgacgtgacctgggaagaggaagcggagcagactggcgtcagccacaacctcatgataacagttgatgacgatggcaccatgcgcattaaggacgatgaaactgagaatatcctgacagtgttgttaaaaaccgctctgctcatcgtgtccgggatttttccgtactcaatacctgccacgctgcttgtctggcatacttggcagaagcaaacccagcggagcggagtgctgtgggacgttcccagtccacccgagacacagaaagcagaattggaggaaggtgtatacagaatcaagcagcaaggcattttcgggaagacccaggtgggagtcggcgtgcagaaagagggtgtttttcacacaatgtggcatgtgactaggggggccgtcctaacccacaacggaaagcgactggagcctaattgggcttctgtgaaaaaggatctcatctcctatggcggcgggtggcgcctgagcgcccaatggcagaaaggagaagaggtacaggtcattgcagtggaaccaggtaagaaccccaagaatttccagacgatgcctggcatcttccaaacaactaccggggagataggagctatcgcccttgactttaaaccgggcacatcgggttcaccaattatcaaccgggaagggaaggttgtgggattatacggcaatggcgtcgtgaccaaaaacgggggatatgtttctggtattgcgcagactaatgccgagcccgatggccctaccccagagctggaagaggaaatgttcaagaaaagaaacctcacaatcatggacttgcaccccgggagtggaaagacgaggaagtacctgcctgcaatagtgcgtgaggctattaaacgccggctcagaactctgatccttgccccgaccagggtcgtggctgcagaaatggaggaggccctgaagggcttgcccatccgatatcagacaaccgccactaaatccgaacatacaggtcgggagattgtagatctaatgtgccacgctacctttacgatgcgcctgctcagcccagtgagagttcctaattacaacttaatcataatggacgaagcgcatttcactgatcccgcatctattgccgctagggggtatatcagcacacgggtcggaatgggcgaggccgcagccatttttatgaccgctaccccacctggcactgcggaagccttcccccagtccaatgcaccaatccaagacgaggagcgagacataccggaaagatcatggaacagtgggaatgagtggattacagattttgtgggaaagaccgtgtggttcgtccctagcatcaaagctggtaacgacatcgccaactgtctgcgcaagaatggcaagaaagtaattcagctttctaggaagacatttgatactgaataccagaaaacgcgtctgaacgactgggatttcgtggttaccacagacatctccgagatgggggcaaattttaaggccgatcgggtgattgaccccagaaggtgcctcaaaccagtcatattgactgatggacccgagcgcgtgatcctggctggccctatgccagttaccgccgcgtcagcagcccagcgaagaggtcgggtggggaggaacccccaaaaggaaaatgaccagtacattttcacaggccagcctctcaacaatgatgaggaccacgctcattggaccgaagccaagatgctgcttgacaacatcaatactccggagggaatcattccagctctattcgaacccgagcgcgagaaaagtgcagccatagatggcgaatatcgtctgaagggggagagcagaaaaacgtttgtcgaattgatgcggaggggagacttacctgtgtggctggctcacaaggtagcctccgagggtatcaaatacaccgatcgcaagtggtgcttcgacggcgaacgaaacaatcagattctcgaggagaacatggatgtggaaatctggacaaaagagggggaaagaaagaagctgcggcccaggtggcttgacgcacgcacttattctgatccactggcgctcaaagagtttaaggacttcgccgctggaagaaaatcgattgccttggatctggttaccgaaatcggcagggtccctagccacctagcataccggacacgtaatgctctggacaacctcgtgatgcttcatacctcagagcacggtgggcgcgcctatcgacatgcagtggaggaactgcccgagactatggaaacattattgctgctcggcctgatgatacttctgacgggaggcgccatgctctttttgatctccgggaagggaattggtaaaaccagtatcggcctgatttgtgtcatcgtttctagcgggatgttatggatggctgatgtgccactacaatggatagcgtccgccattatcctggagttctttatgatggtactccttattcctgagccggaaaagcagagaactccccaggacaatcaactggcatacgtggtcatcggaatattgacactggctgccatcgtggccgcaaacgagatgggcctcctggaaaccaccaagagggatcttggtatgtcaaaagagccaggggttgtgtctcctacaagctatctcgacgtcgacctgcaccccgctagtgcctggactttgtacgcggtagctacgaccgtgattacaccaatgctgcggcacactatcgaaaattccaccgccaacgttagcttagcagccattgctaaccaggcagtggtcctaatgggcctggataagggatggcctatctctaaaatggacctcggcgtgccccttctggccttggggtgctactcacaggtcaatccgctgacactcaccgcggctgtgctgcttttagttactcattatgccataattggaccaggcctgcaggcaaaggccacgcgcgaggctcaaaaaagaacagccgcaggtatcatgaagaaccctaccgtggatgggatcatgactattgacctcgatcccgtaatctacgactccaagttcgagaaacagttgggacaggtgatgctgctagtcctgtgtgctgttcagctccttctgatgaggaccagttgggccttgtgcgaagcgctgacactcgccactggcccaataaccacactgtgggagggtagccccggcaagttttggaatacgaccattgcagtgtcgatggctaacatcttccgggggtcttatttagccggagcaggccttgctttttccattatgaaaagcgtcgggactggacgaagaggcacaggttcacaaggggaaaccctgggagagaagtggaaaaagaagctcaatcagctaagtcgcaaagaattcgatctgtacaagaaatctggcatcactgaggtggacaggacagaggccaaggaaggtttgaaacggggcgagaccacgcaccatgccgtatcccgtgggagcgcgaagctgcagtggtttgtggaaagaaacatggttatacctgagggaagggtgatcgatctcggctgtgggcgcggaggctggtcatattactgcgctggtcttaaaaaggtcaccgaagtgcgggggtatacaaagggaggcccgggccacgaggagcccgtcccaatgagtacttacgggtggaatctggtgaaattgatgagcggaaaggacgttttctacctgcctcccgaaaaatgtgataccctcttatgcgacattggtgagtcctctcctagcccaacagtagaagagtcccgaactatcagagtgctgaagatggtcgagccctggcttaaaaacaatcagttctgtattaaggtgctgaacccttatatgccaaccgttatcgaacatctagagaggctccaacgcaagtacggcgggatgctggtgcggaatcccttgtcaagaaactctacacacgaaatgtattggattagtaatggaaccggcaacatcgtctcgagcgtgaatatggtatcccgtctgctccttaacaggtttactatgacgcaccggcgcccgacaatagagaaagatgtggacctgggtgcagggacccgacatgttaacgccgaacctgagactccaaatatggacgtcattggagagagaatcaagaggatcaaagaagagcactcttcaacctggcattacgatgacgaaaacccctataagacatgggcttaccacggcagctatgaggtgaaagccacgggctccgcaagttctatgattaatggggtggtcaagttactgaccaagccttgggatgttgtgccaatggtaactcagatggccatgacagacaccactcccttcggacagcaacgggtgtttaaagaaaaggtcgatacacgcaccccgagacctatgcccggtacaaggaaagtgatggagataactgctgagtggttgtggcgaaccctcggccggaacaagaaaccacgtctgtgcacgagagaagagttcaccaagaaggttcgcacaaatgcggccatgggggcagtgtttactgaagagaaccagtgggacagcgctagggccgcagtcgaagatgaggagttctggaaactagtggaccgggaaagagagcttcacaagctgggaaaatgtggctcatgcgtatacaatatgatgggtaagcgcgaaaaaaagctcggggagtttggaaaagccaagggctccagggctatctggtacatgtggctgggcgcccgatatttggagttcgaagcgctggggtttctcaacgaggatcattggttcagtcgggaaaatagctactctggagttgagggtgaaggccttcacaagctggggtatattttaagagacatctccaaaattcctggaggcgcaatgtacgccgatgacaccgctggttgggacacaaggatcactgaggatgacctgcataacgaggaaaagataacccagcagatggatcccgagcaccgccaattggccaatgcaatctttaaactcacgtatcagaacaaggtggtcaaagtgcagcgtccaacacccaaggggaccgtgatggacattatctcacggaaggatcagagaggaagcggccaagtcggcacttacgggctgaatacattcaccaacatggaagctcagctagttaggcagatggagggagaaggtgtgctttcgaaagccgacctggagaatcctcatctcctggagaagaaaattactcagtggttggaaaccaagggcgtagagcgcttaaaacgaatggctatctctggggatgactgcgtggtcaagccaatagatgaccggtttgccaacgcactgctcgcgcttaacgatatgggaaaggtgagaaaagacattccgcaatggcagcccagtaagggctggcacgattggcagcaggttcctttctgttcccaccatttccacgaactgatcatgaaagacggtaggaagctagtggtcccatgccgcccccaagacgagctgatcgggagagcccggattagccagggagctggctggtcactcaaagaaacagcctgtttgggcaaggcatatgctcagatgtggtccctgatgtactttcataggcgtgatcttcgactggcctctaatgcaatatgcagcgccgtgcctgtacactggatcccaacgagtcgcaccacttggtccattcacgcgcatcaccaatggatgacaaccgaggacatgctcactgtttggaacagagtgtggatcgaggataatccctggatggaagacaagacacctgtcaccacgtgggaggatgtgccgtacttagggaaacgggaagaccagtggtgtggaagcctgattggtttgacatctagggctacctgggcccagaacatcctgactgcaatacagcaagttcgctcactcatcggcgatgaggagttccttgactatatgccaagtatgaagagatttcggaaagaagaggaatccgagggggccatttggtga

SEQ ID NO: 15579 - RNA, 9873 nt, synthetic construct
  misc_feature 1..9873: note = derived and/or modified CDS sequence (opt3) from DENV-3__FJ562097__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgtgatcaactggaaggggaaggaactcaaatgcggatccggcattttcgtcacaaatgaggttcacacctggactgagcagtacaagtttcaagccgactctcccaaacggctggcaacagccatcgctggtgcctgggaaaacggcgtgtgtgggatacgaagcaccactcgcatggagaatcttttgtggaagcagatcgcaaacgaactgaattatattctctgggagaacaatatcaaactgaccgtggtagtcggagatattatcggcgtgttagaacaggggaagagaacactgacgccacagcctatggagcttaaatactcatggaagacctggggaaaggctaaaatagttactgccgagacacaaaacagttccttcattatcgacggccccaacaccccagaatgccccagcgcgtctagggcctggaatgtgtgggaggtcgaagactatggttttggggtgttcacaactaacatttggttgaagctccgggaggtttacacccagtcatgtgatcatcgcctgatgagtgctgcaatcaaagacgaaagagccgtgcacgctgatatgggatactggatagagagccagaagaatggctcctggaaactagagaaggcctcttttatcgaagtaaagacgtgcacatggcctaaatcgcacaccctgtggagcaacggtgtcctcgagtccgacatgattatcccaaagtcactggcaggcccgattagtcagcataatcacaggcccgggtatcatactcaaaccgcgggaccttggcaccttggcaaattggaactggatttcaactactgcgaggggacaactgtggtgatcaccgagaattgtggaacacgtggcccatctttacggacgaccactgtcagcggtaagctcatacacgaatggtgctgtcgatcctgcacactgccccctcttagatatatgggggaggacggatgttggtacggcatggaaattaggccaatcaacgagaaagaagagaatatggttaagtcactggtgagcgccggttctggcaaggtagataactttaccatgggggtgttgtgcctcgctatcctgttcgaggaagtcatgcgcggaaaattcggcaagaaacatatgattgccggggtgctatttactttcgttctgctcctgtccggacagatcacatggcgggacatggcacacacccttattatgataggcagtaatgctagcgatagaatgggtatgggggtgacgtatttggccctgatcgcaacttttaagattcagcccttcttagccctcggatttttcctgaggaaacttacctctcgcgagaacctgctactcggcgtcggcctggctatggcggccacattgcaactgccggaagacatcgagcagatggcaaatgggattgctttaggactcatgaccctgaagcttatcactcagtttgaaacataccagctgtggaccgccttggtgtccctcacatgttcaaacactatattcaccctgacggttgcctggcgaacagctaccctaatcctggcaggtgtgagtcttctccctctgtgccaaagctcgtccatgcggaagactgattggttgccaatgaccgtcgccgcgatgggcgtaccccctctgcccttatttattttctctctcaaagacacaccaaagcgtagaagctggcctctgaatgagggggtgatggctgttggacttgtgtcaatcctggccagttccttgctcaggaacgatgtccccatggcaggcccactggtggccggtgggctactgattgcttgttatgtaatcactggaacctctgcagaccttacggtggagaaagccgcggacgtcacatgggaagaggaagctgagcagaccggcgttagccataacctcatgataactgtggatgacgatggcacaatgcgcattaaggacgatgaaaccgagaatatcctgactgtgttgttaaaaacagccctgctcatcgtctccggggtgtttccgtactcaattcctgcaaccctgcttgtttggcacacgtggcagaagcagactcaacggagcggagtactgtgggacgtgcccagtccacccgagacccagaaagccgaattggaggaaggtgtctacagaataaagcagcagggcatcttcgggaagacacaagtgggagttggcgtgcagaaagagggtgtctttcataccatgtggcacgtgacaaggggggctgtactaactcacaacggaaagcgactggagcctaattgggcctctgtcaaaaaggatctcatttcctatggcggcgggtggcgcctgagcgcacagtggcaaaaaggagaagaggtgcaggttatcgctgtggaaccaggtaagaaccccaagaatttccagaccatgcctggcattttccagacgacaactggggagatcggagccatagcgcttgactttaaaccgggcacctcgggttcaccaatcattaaccgggaagggaaggtcgtgggattatacggcaatggcgttgtgacaaaaaacgggggatatgtctctggtatcgcccaaaccaatgcagagcccgatggccctactccagagctggaagaggaaatgttcaagaaaagaaacctcaccattatggacttgcatcccgggagtggaaagacaaggaagtacctgcctgctatcgtgcgtgaggccataaaacgccggctcagaacgctgattcttgctccgactagggtagtggcagccgaaatggaggaggccctgaagggcttgcccatccgatatcagaccacagctaccaaatccgaacacactggtcgggagatcgttgatctaatgtgccatgcgacatttaccatgcgcctgctcagcccagtcagagtgcctaattacaacttaattatcatggacgaagcacacttcacggatcccgcctctatagctgccagggggtatattagcactcgggtgggaatgggcgaggcagccgctatctttatgacagcgaccccacctggcaccgccgaagcattcccccagtccaatgctccaattcaggacgaggagcgagacatcccggaaagatcatggaacagtgggaatgagtggataactgattttgtcggaaagacagtatggttcgtgcctagcattaaagccggtaacgacatcgcaaactgtctgcgcaagaatggcaagaaagttatccaactttctaggaagacctttgatacagaataccagaaaactaagctgaacgactgggatttcgtggtcacgaccgacatttccgagatgggggccaattttaaagctgatcgtgtgatcgacccccggagatgcctcaagccagttattttgacagatggacccgagagggtgatactggccggccctatgccagtcactgcggcatcagccgctcagcgccgaggtagagtggggcggaacccccagaaggaaaatgaccaatacatcttcaccggccagcctctcaacaatgatgaggaccatgcccactggacagaagctaaaatgctgcttgacaacattaataccccggagggaatcatcccagcactattcgaacccgagagggagaagagtgccgctattgatggcgaatatcgcctgaaaggggagagccgtaagacttttgtagaattgatgagacggggagacttacctgtgtggctggcccacaaagttgcatccgagggtataaagtacacggataggaaatggtgcttcgacggcgaacgcaacaatcagatcctcgaggagaacatggatgtcgaaatttggaccaaggagggggaacgaaagaaactgagaccccggtggcttgacgcgaggacatattctgatccactggccctcaaggagtttaaagacttcgctgccggacgcaagtcgatcgcattggatctggtgactgaaattggcagagtgcctagccatctagcttacaggacccggaatgccctggacaacctcgtcatgcttcacacatcagagcatggtgggcgtgcatatcgccacgccgttgaggaactgcccgagaccatggaaactttattgctgctcggcctgatgatccttctgacaggaggcgctatgctctttttgatatccgggaaaggaatcggtaagacgagtattggcctgatctgtgtgattgtatctagcgggatgttatggatggcggatgtgccactacagtggatcgcctccgcaatagtcctggagttctttatgatggtgctccttattcctgagccggaaaagcaacgaaccccccaggacaatcagctggcttacgttgtgatcggaattttgactctggccgccatcgtcgcagctaacgagatgggcctcctggaaacaaccaaaagagatcttggtatgtcaaaggagccaggggtagtgtctcctaccagctatctcgacgttgacctgcaccccgccagtgcgtggacattgtacgctgtggccactacggtcataaccccaatgctgaggcatacaatcgaaaattccactgcaaacgtgagcttagccgctattgcaaaccaagccgtcgtgctaatgggcctggataaaggatggcctatctctaagatggacctcggcgttccccttctggcgttggggtgctactcacaggtgaatccgctgaccctcacagctgccgtactgcttttagtgacccactatgcaattatcggaccaggcctgcaggccaaagctactcgggaggcccagaagcgcacggcagctggtataatgaagaaccctacagtcgatgggattatgaccatcgacctcgatcccgttatctacgactccaaattcgagaagcaattgggacaggtgatgctgctagtcctgtgtgccgtgcagctccttctgatgagaactagttgggcgttgtgcgaagccctgaccctcgcaacaggcccaattactaccctgtgggagggtagccccggcaaattttggaatacaacgatcgctgtatcgatggccaacatattcagggggtcttatttagcaggagctggccttgccttttccattatgaagagcgtggggaccggacggcgaggcactggttcacagggggaaacactgggagagaaatggaagaagaaactcaatcaactaagtagaaaggaattcgatctgtacaaaaagtctggcatcaccgaggttgaccgcactgaggccaaagaaggtttgaagaggggcgagacaacccatcacgcggtgtcccgggggagcgctaaactgcagtggtttgtcgaacgtaacatggtgattcctgagggaagagtcatcgatctcggctgtgggaggggaggctggtcatattactgcgcaggtcttaagaaggtgacggaagttcgcgggtataccaaaggaggcccgggccatgaggagcccgtaccaatgagtacatacgggtggaatatagtgaagctgatgagcggaaaagacgtcttctacttgcctcccgaaaagtgtgatactctgctctgcgacatcggtgagtcctctcctagcccaaccgtggaagagtcccggacaattcgagttttaaaaatggtggagccctggctgaagaacaatcagttctgtatcaaggtccttaacccttatatgccaactgtgattgaacacctggagagactacagaggaaatacggcgggatgctcgtacgcaatcccctgtcacggaactctacccacgaaatgtattggatcagtaatggaacaggcaacattgtgtcgagcgttaatatggtctccagattgctgctcaaccgttttaccatgactcataggcggccgacgatcgagaaggatgtggaccttggtgccgggacacgccacgtgaacgctgaacctgagaccccaaatatggacgtcataggagagcgaattaaaagaatcaaggaagagcattcttcaacttggcactacgatgacgaaaacccctataaaacctgggcctaccacggcagctatgaggttaaggcaacaggctccgccagttctatgatcaatggggtggtaaagctgttaacgaaaccttgggatgtggtcccaatggtgacccaaatggctatgactgacacaacccccttcggacagcagagggtttttaaggaaaaagtggatactcggacaccgcgccctatgcccggtaccagaaaggtcatggagattacagcggagtggctgtggaggactttgggccgaaacaaaaagccacggctctgcacccgtgaagagttcacgaagaaagtgagaaccaatgccgcaatgggggctgtatttacagaagagaaccaatgggacagcgcccgcgcagccgttgaagatgaggagttctggaagctggtggacagggaacgggagctacataaacttggaaagtgtggctcatgcgtctacaatatgatgggtaaaagagaaaagaaactgggggagtttggaaaggctaagggctcccgcgccatatggtacatgtggctcggcgcgaggtatctggagttcgaagcattggggtttctgaacgaggatcactggttcagtcgagaaaatagctactctggagtggagggtgaaggcctccataaacttgggtatatcctgcgggacatttccaagatccctggaggcgccatgtacgctgatgacactgccggttgggacaccagaattacagaggatgacttacacaacgaggaaaaaatcactcagcagatggatcccgagcataggcagctggcaaatgctatatttaagttgacctatcaaaacaaagtggtcaaggttcagcgcccaacgcccaaggggacagtgatggacatcatttcacgtaaagatcagcggggaagcggccaggtaggcacctacgggctcaatactttcacaaacatggaagcccaactggtgagacagatggagggagaaggtgtcctatcgaaggctgaccttgagaatcctcacctgctcgagaaaaagatcacccagtggctggaaactaaaggcgtggagaggttgaagcgcatggccatttctggggatgactgcgttgtgaagccaatcgatgaccgatttgcaaacgcgttactggccctcaacgatatgggaaaagtccggaaggacataccgcagtggcaacccagtaaaggctggcacgattggcagcaggtgcctttctgttcccatcacttccatgaacttattatgaaggacggtagaaaactggtagttccatgcaggccccaggacgagctaatcgggcgcgctagaatcagccaaggagccggctggtcactgaaggaaaccgcatgtctcggcaaggcttatgcccagatgtggtccttgatgtactttcaccggagggatctgcgtcttgcatctaatgccatttgcagcgcggtgcctgtccactggataccaacaagtcgaacgacctggtccatccatgctcaccatcagtggatgactacagaggacatgctgaccgtgtggaaccgcgtttggattgaggataatccctggatggaagacaaaactcctgtgacaacctgggaggatgtcccgtacctcgggaagagagaagaccaatggtgtggaagcttaatcggtctgacgtctcgggccacatgggcacagaacattttgaccgccatccagcaggtgaggtcactgataggcgatgaggagttcctcgactatatgccaagtatgaaacgctttagaaaggaagaggaatccgagggggctatctggtga

SEQ ID NO: 15580 - RNA, 9873 nt, synthetic construct
  misc_feature 1..9873: note = derived and/or modified CDS sequence (opt3) from DENV-3__FJ432741__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcgcaaaaaaggaggagcccgtgaacatagaagccgagccgcctttcggcgaatcaaatattgttatcggaatcggcgacaaagctctcaagattaactggtataagaaagggagcagtatcggaaagatgtttgaggccacagcacgcggtgccagaaggatggctattctgggcgatactgcctgggacttcgggtctgtgggaggcgtccttaattccctgggtaaaatggtgcatcagatatttgggagcgcatacaccgcgttgttctcgggcgtatcttggatcatgaagattggaatcggcgtgctcctgacatggatcgggttaaactccaaaaatacttcaatgagttttagctgcattgttataggaatcattaccctgtatctaggcgctgtcgtgcaggccgatatgggttgtgcaatcaactggaaggggaaggaactcaaatgcggatccggcattttcgtgacgaatgaggtccacacatggaccgagcagtacaagtttcaagccgactctcccaaacggctggctactgccatcgcaggtgcttgggaaaacggcgtttgtgggatacgaagcacaacccgcatggagaatcttttgtggaagcagatcgccaacgaactgaattatattctctgggagaacaatatcaaactgactgtggtggtaggagatattatcggcgtcttagaacaggggaagagaaccctgacaccacagcctatggagcttaaatactcatggaagacgtggggaaaggcgaaaatagtgaccgccgagactcaaaacagttccttcattatcgacggccccaacacaccagaatgccccagcgcttctagggcatggaatgtttgggaggtggaagactatggttttggggtcttcaccacaaacatttggttgaagctccgggaggtgcatactcagtcatgtgatcaccgcctgatgagtgccgctatcaaagacgaaagagccgttcacgcagatatgggatactggatagagagccagaagaatggctcctggaaactagagaaggcgtcttttatcgaagtgaagacctgcacgtggcctaaatcgcatacactgtggagcaacggtgtactcgagtccgacatggtcattccaaagtcactggccggcccgatcagtcagcacaatcataggcccgggtaccacacccaaactgctggaccttggcaccttggcaaattggaactggatttcaactattgcgaggggaccacagtggtgattactgagaattgtggaacccgtggcccatctttacggacaacgaccgtcagcggtaagctcatccatgaatggtgctgtcgatcctgcactctgccccctcttagatacatgggggaggacggatgttggtatggcatggaaataaggccaattaacgagaaagaagagaatatggttaagtcactggtgagcgccggttctggcaaggtagataactttacaatgggggtgttgtgcctcgcaatcctgttcgaggaagtcatgcgcggaaaattcggcaagaaacacatgatcgctggggtgctatttaccttcgttctgctcctgtccggacagattacttggcgggacatggcccatacacttatcatgattggcagtaatgcaagcgatagaatgggtatgggggtgacctacttggccctgatagctacgtttaagatccagcccttcttagcgctcggatttttcctgaggaaacttacttctcgcgagaacctgctactcggcgtcggcctggccatggcaaccacattgcaactgccggaagacattgagcagatggctaatgggatcgccttaggactcatgaccctgaagcttattactcagtttgaaacatatcagctgtggaccgccttggtgtccctcacatgttcaaacactatcttcaccctgacggttgcttggcgaacagcaaccctaatactggccggtgtgagtcttctccctctgtgccaaagctcgtccatgcggaagactgattggttgccaatgaccgtcgcggctatgggcgtaccccctctgcccttatttatcttctctctcaaagacacaccaaagcgtagaagctggcctctgaatgagggggtgatggccgttggacttgtgtcaattctggcaagttccttgctcaggaacgatgtccccatggccggcccactggtggctggtgggctactgatcgcatgttacgtaattactggaacctctgccgaccttacggtggagaaagcggctgacgtcacatgggaagaggaagccgagcagaccggcgttagccacaacctcatgatcactgtggatgacgatggcacaatgcgcataaaggacgatgaaaccgagaatattctgactgtgttgttaaaaacagcactgctcatcgtctccgggatctttccgtattcaattcctgccaccctgcttgtgtggcatacgtggcagaagcagactcaacggagcggagttctgtgggacgtacccagtccacccgagacccagaaagctgaattggaggaaggtgtgtacagaataaagcagcagggcatcttcgggaagacacaagtcggagtgggcgttcagaaagagggtgtgtttcacaccatgtggcacgtcacaaggggggccgtgctaactcataacggaaagcgactggagcctaattgggcatctgtaaaaaaggatctcatttcctacggcggcgggtggcgcctgagcgctcagtggcaaaaaggagaagaggtccaggtgatcgccgttgaaccaggtaagaaccccaagaatttccagaccatgcctggcattttccagacgacaactggggagatcggagcgatagcccttgactttaaaccgggcacctcgggttcaccaatcattaaccgggaagggaaggtggtcggattatatggcaatggcgtggttacaaaaaacgggggatacgtgtctggtatcgcacaaaccaatgctgagcccgatggccctactccagagctggaagaggaagtcttcaagaaaagaaacctcaccattatggacttgcaccccgggagtggaaagacaaggaagtatctgcctgccatcgtgcgtgaggctataaaacgccggctcagaacgctgattcttgcaccgactagggtagtggccgccgaaatggaggaggctctgaagggcttgcccatccgataccagaccacagcgaccaaatccgaacatactggtcgggagatcgttgatctaatgtgccacgcaacatttaccatgcgcctgctcagcccagtcagagtgcctaattataacttaattatcatggacgaagcccatttcacggatcccgcttctatagccgcaagggggtacattagcactcgggtgggaatgggcgaggccgctgcgatctttatgacagccaccccacctggcaccgcagaagctttcccccagtccaatgccccaattcaggacgaggagcgagacatcccggaaagatcatggaacagtgggaatgagtggataactgattttgtcggaaagacagtatggttcgtgcctagcattaaagcaggtaacgacatcgccaactgtctgcgcaagaatggcaagaaagttatccaactttctaggaagacctttgatacagaatatcagaaaactcgtctgaacgactgggatttcgtggtcacgaccgacatttccgagatgggggctaattttaaggccgatcgggtgatcgaccccagaaggtgcctcaaaccagttattttgacagatggacccgagcgcgtgatactggcgggccctatgccagtcactgcagcctcagctgcccagcgaagaggtcgggtggggaggaacccccagaaggaaaatgaccaatacatcttcaccggccagcctctcaacaatgatgaggaccacgctcactggacagaagcaaagatgctgcttgacaacattaataccccggagggaatcatcccagccctattcgaacccgagcgcgagaaaagtgctgccattgatggcgaataccgtctgaagggggagagcagaaaaacttttgtagaattgatgcggaggggagacttacctgtgtggctggcacataaggttgcgtccgagggtataaaatatacggatcgcaagtggtgcttcgacggcgaacgaaacaatcagatcctcgaggagaacatggatgtcgaaatttggaccaaagagggggaaagaaagaagctgcggcccaggtggcttgacgcccgcacatactctgatccactggctctcaaagagtttaaggacttcgccgcaggaagaaaatcgatcgctttggatctggtgactgaaattggcagggtgcctagccacctagcctatcggacccgtaatgcactggacaacctcgtcatgcttcatacatcagagcacggtgggcgcgcctaccgacacgctgttgaggaactgcccgagaccatggaaactttattgctgctcggcctgatgatccttctgacaggaggcgcgatgctctttttgatatccgggaagggaatcggtaaaacgagtattggcctgatctgtgtgattgtatctagcgggatgttatggatggccgatgtgccactacagtggatcgcatccgctataattctggagttctttatgatggtcctccttatccctgagccggaaaagcaaagaaccccccaggacaatcagctggcctatgtggttattggaatcttgactctggccgcaatagtggctgccaacgagatgggcctcctggaaacaaccaagagggatcttggtatgtcaaaagagccaggggtcgtatctcctaccagctacctcgacgtggacctgcatcccgcgagtgcttggacattgtatgccgttgcaactacggtgatcaccccaatgctgcggcacacaattgaaaattccactgccaacgtcagcttagctgcaatcgccaaccaagcggtggtcctaatgggcctggataagggatggcctatttctaaaatggacctcggcgtgccccttctggctttggggtgctactcacaggttaatccgctgaccctcacagccgcagtgctgcttttagtaacccattacgccatcataggaccaggcctgcaggctaaggccactcgcgaggcacagaaaagaacggctgccggtattatgaagaaccctacagtggatgggatcatgaccatcgacctcgatcccgtcatttatgactccaagttcgagaaacaattgggacaggttatgctgctagtgctgtgtgcggtccagctccttctgatgaggactagttgggccttgtgcgaagcactgaccctcgctacaggcccaatcactaccctgtgggagggtagccccggcaagttttggaatacaacgatagccgtgtcgatggcaaacattttccgggggtcttacttagctggagccggccttgccttttccatcatgaaaagcgtagggaccggacgaagaggcactggttcacagggggaaacactgggagagaagtggaaaaagaagctcaatcaactaagtcgcaaagaattcgatctgtataagaaatctggcattaccgaggtggacaggactgaggcgaaggaaggtttgaaacggggcgagacaacccaccatgctgtttcccgtgggagcgcaaagctgcagtggtttgtggaaagaaacatggtcatccctgagggaagggtgatagatctcggctgtgggcgcggaggctggtcatactattgcgccggtcttaaaaaggtcacggaagtgcgggggtacaccaagggaggcccgggccacgaggagcccgttccaatgagtacatatgggtggaatctggtaaaattgatgagcggaaaggacgtgttctacctgcctcccgaaaaatgtgatactctcttatgcgacatcggtgagtcctctcctagcccaaccgtcgaagagtcccgaacaattagagtgctgaagatggttgagccctggcttaaaaacaatcagttctgtatcaaggtgctgaacccttacatgccaactgtcattgaacacctagagaggctccagcgcaagtatggcgggatgctggtgcggaatcccttgtcaagaaactctacccatgaaatgtactggatcagtaatggaacaggcaacattgtatcgagcgtgaatatggtttcccgtctgctccttaacaggtttaccatgactcaccggcgcccgacgatcgagaaagatgtcgacctgggtgctgggacacgacatgtgaacgccgaacctgagaccccaaatatggacgtgataggagagagaattaagaggatcaaagaagagcactcttcaacttggcactatgatgacgaaaacccctacaagacctgggcatatcatggcagctacgaggtcaaagccacaggctccgctagttctatgatcaatggggttgtgaagttactgacgaagccttgggatgtagtgccaatggtcacccaaatggcgatgactgacacaacccccttcggacagcagcgggtgtttaaagaaaaggttgatactcgcacaccgagacctatgcccggtaccaggaaagtgatggagattacagccgagtggttgtggcgaactctcggccggaacaagaaaccacgtctgtgcaccagagaagagttcacgaagaaggtccgcaccaatgcagctatgggggccgtgtttacagaagagaaccaatgggacagcgcaagggccgctgtagaagatgaggagttctggaaactagttgaccgggaaagaaagcttcacaaactgggaaagtgtggctcatgcgtgtataatatgatgggtaaacgcgagaagaaactcggggaatttggaaaggccaagggctccagggcgatatggtacatgtggctgggcgcacgatacttggagttcgaggccctggggtttctcaacgaagatcattggttcagtcgggagaatagctattctggagtcgaaggtgagggccttcacaaactggggtacatcttaagagacatttccaagatccctggaggcgctatgtatgccgatgacactgcaggttgggacaccaggattacagaagatgacctgcataacgaggagaaaatcactcagcagatggatcccgaacaccgccagttggctaatgccatatttaagctcacctaccaaaacaaagtggtgaaggtccagcgtccaacgcccaaggggacagttatggacatcatttcacggaaagatcagagaggaagcggccaggtgggcacctatgggctgaatactttcacaaacatggaggctcaactagtaaggcagatggaaggagagggtgtgctttcgaaggccgacctggaaaatcctcacctcctggagaaaaagatcacccagtggttggagactaaaggcgtcgaacgcttaaagcgaatggcaatttctggggatgactgcgtggttaagccaatcgatgaccggtttgcgaacgccctgctcgctcttaacgatatgggaaaagtgagaaaggacataccgcagtggcaacccagtaaaggctggcatgattggcagcaggtccctttctgttcccaccatttccacgagctgattatgaaggacggtaggaaactagtggtaccatgccgcccccaggacgaactgatcgggagagcccggatcagccaaggagcaggctggtcactcaaggagaccgcttgtttgggcaaggcctacgcacagatgtggtccctgatgtattttcacaggcgtgatcttcgactggcctctaatgcgatttgcagcgctgttcctgtgcattggataccaacaagtcgcacgacctggtccatccacgcccatcaccagtggatgactacagaagacatgctcaccgtctggaacagagtgtggattgaggataatccctggatggaggacaaaactcctgttacaacctgggaagatgtgccgtacttagggaagcgggaggaccaatggtgtggaagcctgatcggtttgacgtctagggcaacatgggcccagaacattctgaccgctatccagcaggtccgctcactcataggcgatgaagagttccttgactacatgccaagtatgaaaagatttcggaaggaggaagagtccgaaggggccatctggtga

SEQ ID NO: 15581 - RNA, 9873 nt, synthetic construct
  misc_feature 1..9873: note = derived and/or modified CDS sequence (opt3) from DENV-3__FJ562099__SS-prME
  source 1..9873: mol_type = other RNA
acaagcctgtgcctcatgatgatgcttcccgcaacactggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcagcttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcagtgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgccaagaagcaagaggtcgtggtcctcggctcccaggaaggagctatgcacaccgccctgactggcgctacagagatccaaaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcaccaagaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgtgatcaactggaaggggaaggaactcaaatgcggatccggcattttcgtcacaaatgaggttcacacctggactgagcagtacaagtttcaagccgactctcccaaacggctggcaacagccatcgctggtgcctgggaaaacggcgtgtgtgggatacgaagcaccactcgcatggagaatcttttgtggaagcagatcgcaaacgaactgaattatattctctgggagaacaatatcaaactgaccgtggtagtcggagatattatcggcgtgttagaacaggggaagagaacactgacgccacagcctatggagcttaaatactcatggaagacctggggaaaggctaaaatagttactgccgagacacaaaacagttccttcattatcgacggccccaacaccccagaatgccccagcgcgtctagggcctggaatgtgtgggaggtcgaagactatggttttggggtgttcacaactaacatttggttgaagctccgggaggtttacacccagtcatgtgatcatcgcctgatgagtgctgcaatcaaagacgaaagagccgtgcacgctgatatgggatactggatagagagccagaagaatggctcctggaaactagagaaggcctcttttatcgaagtaaagacgtgcacatggcctaaatcgcacaccctgtggagcaacggtgtcctcgagtccgacatgattatcccaaagtcactggcaggcccgattagtcagcataatcacaggcccgggtatcatactcaaaccgcgggaccttggcaccttggcaaattggaactggatttcaactactgcgaggggacaactgtggtgatcaccgagaattgtggaacacgtggcccatctttacggacgaccactgtcagcggtaagctcatacacgaatggtgctgtcgatcctgcacactgccccctcttagatatatgggggaggacggatgttggtacggcatggaaattaggccaatcaacgagaaagaagagaatatggttaagtcactggtgagcgccggttctggcaaggtagataactttaccatgggggtgttgtgcctcgctatcctgttcgaggaagtcatgcgcggaaaattcggcaagaaacatatgattgccggggtgctatttactttcgttctgctcctgtccggacagatcacatggcgggacatggcacacacccttattatgataggcagtaatgctagcgatagaatgggtatgggggtgacgtatttggccctgatcgcaacttttaagattcagcccttcttagccctcggatttttcctgaggaaacttacctctcgcgagaacctgctactcggcgtcggcctggctatggcgacaaccttgcaactgccggaagacatcgagcagatggccaatgggattgcattaggactcatgactctgaaacttatcacacagtttgaaacctaccagctgtggacagctttggtgtccctcacttgttcaaacaccatattcacgctgacagttgcctggcgaaccgccactctaatcctggctggtgtgagtcttctccctctgtgccaaagctcgtccatgcggaagaccgattggttgccaatgacagtcgcagccatgggcgtaccccctctgcccttatttattttctctctcaaagacactccaaagcgtagaagctggcctctgaatgagggggtgatggcggttggacttgtgtcaatcctggctagttccttgctcaggaacgatgtccccatggccggcccactggtggccggtgggctactgattgcctgttatgtaatcaccggaacgtctgctgaccttacagtggagaaagcagccgacgtcacctgggaagaggaagcggagcagactggcgttagccataacctcatgataacagtggatgacgatggcaccatgcgcattaaggacgatgaaactgagaatatcctgacagtgttgttaaaaaccgctctgctcatcgtctccggggtgtttccgtactcaattcctgccacgctgcttgtttggcacacttggcagaagcagacccaacggagcggagtactgtgggacgtgcccagtccacccgagacacagaaagcagaattggaggaaggtgtctacagaataaagcagcagggcatcttcgggaagacccaagtgggagttggcgtgcagaaagagggtgtctttcatacaatgtggcacgtgactcgaggggcagtactaacccacaacggaaagaggctggagcctaattgggcttctgtcaaaaaggatctcatttcctatggcggcgggtggcgcctgagcgcccagtggcaaaaaggagaagaggtgcaggttatcgcagtggaaccaggtaagaaccccaagaatttccagacgatgcctggcattttccagacaactaccggggagatcggagctatagcccttgactttaaaccgggcacatcgggttcaccaatcattaaccgggaagggaaggtcgtgggattatacggcaatggcgttgtgaccaaaaacgggggatatgtctctggtatcgcgcaaactaatgccgagcccgatggccctaccccagagctggaagaggaaatgttcaagaaaagaaacctcacaattatggacttgcatcccgggagtggaaagacgaggaagtacctgcctgcaatcgtgcgtgaggctataaaacgccggctcagaactctgattcttgccccgaccagggtagtggctgcagaaatggaggaggccctgaagggcttgcccatccgatatcagacaaccgccactaaatccgaacacacaggtcgggagatcgttgatctaatgtgccatgctacctttacgatgcgcctgctcagcccagtcagagtgcctaattacaacttaattatcatggacgaagcgcacttcactgatcccgcatctatagccgctagggggtatattagcacacgggtgggaatgggcgaggccgcagccatctttatgaccgctaccccacctggcactgcggaagccttcccccagtccaatgcaccaattcaggacgaggagcgagacatcccggaaagatcatggaacagtgggaatgagtggataacagattttgtcggaaagaccgtatggttcgtgcctagcattaaagctggtaacgacatcgccaactgtctgcgcaagaatggcaagaaagttatccaactttctaggaagacatttgatactgaataccagaaaacgaagctgaacgactgggatttcgtggtcaccacagacatttccgagatgggggcaaattttaaagccgatcgtgtgatcgacccccggagatgcctcaagccagttattttgactgatggacccgagagggtgatactggctggccctatgccagtcaccgccgcgtcagcagcccagcgccgaggtagagtggggcggaacccccagaaggaaaatgaccaatacatcttcacaggccagcctctcaacaatgatgaggaccatgctcactggaccgaagccaaaatgctgcttgacaacattaatactccggagggaatcatcccagctctattcgaacccgagagggagaagagtgcagccattgatggcgaatatcgcctgaaaggggagagccgtaagacgtttgtagaattgatgagacggggagacttacctgtgtggctggctcacaaagttgcctccgagggtataaagtacaccgataggaaatggtgcttcgacggcgaacgcaacaatcagatcctcgaggagaacatggatgtcgaaatttggacaaaggagggggaacgaaagaaactgagaccccggtggcttgacgcaaggacttattctgatccactggcgctcaaggagtttaaagacttcgccgctggacgcaagtcgatcgccttggatctggtgaccgaaattggcagagtgcctagccatctagcatacaggacacggaatgctctggacaacctcgtcatgcttcacacctcagagcatggtgggcgtgcctatcgccacgcagttgaggaactgcccgagactatggaaacattattgctgctcggcctgatgatccttctgacgggaggcgccatgctctttttgatatccgggaaaggaatcggtaagaccagtattggcctgatctgtgtgattgtatctagcgggatgttatggatggctgatgtgccactacagtggatcgcgtccgccatagtcctggagttctttatgatggtgctccttattcctgagccggaaaagcaacgaactccccaggacaatcagctggcatacgttgtgatcggaattttgacactggctgccatcgtcgccgcaaacgagatgggcctcctggaaaccaccaaaagagatcttggtatgtcaaaggagccaggggtagtgtctcctacaagctatctcgacgttgacctgcaccccgctagtgcctggactttgtacgcggtggctacgaccgtcataacaccaatgctgaggcatactatcgaaaattccaccgccaacgtgagcttagcagccattgctaaccaagcagtcgtgctaatgggcctggataaaggatggcctatctctaagatggacctcggcgttccccttctggccttggggtgctactcacaggtgaatccgctgacactcaccgcggctgtactgcttttagtgactcactatgccattatcggaccaggcctgcaggcaaaagccacgcgggaggctcagaagcgcacagccgcaggtataatgaagaaccctaccgtcgatgggattatgactatcgacctcgatcccgttatctacgactccaaattcgagaagcaattgggacaggtgatgctgctagtcctgtgtgctgtgcagctccttctgatgagaaccagttgggccttgtgcgaagcgctgacactcgccactggcccaattaccacactgtgggagggtagccccggcaaattttggaatacgaccatcgcagtatcgatggctaacatattcagggggtcttatttagccggagcaggccttgctttttccattatgaaaagcgtggggactggacggcgaggcacaggttcacagggggaaaccctgggagagaaatggaagaagaaactcaatcaactaagtagaaaggagttcgatctgtacaaaaagtctggcatcactgaggttgaccgcacagaggccaaagaaggtttgaagaggggcgagaccacgcatcacgccgtgtcccgggggagcgcgaaactgcagtggtttgtcgaacgtaacatggtgattcctgagggaagagtcatcgatctcggctgtgggaggggaggctggtcatattactgcgctggtcttaagaaggtgaccgaagttcgcgggtatacaaaaggaggcccgggccatgaggagcccgtaccaatgagtacttacgggtggaatatagtgaagctgatgagcggaaaagacgtcttctacttgcctcccgaaaagtgtgataccctgctctgcgacatcggtgagtcctctcctagcccaacagtggaagagtcccggactattcgagttttaaaaatggtggagccctggctgaagaacaatcagttctgtatcaaggtccttaacccttatatgccaaccgtgattgaacacctggagagactacagaggaaatacggcgggatgctcgtacgcaatcccctgtcacggaactctacacacgaaatgtattggatcagtaatggaaccggcaacattgtgtcgagcgttaatatggtctccagattgctgctcaaccgttttactatgacgcataggcggccgacaatcgagaaggatgtggaccttggtgcagggacccgccacgtgaacgccgaacctgagactccaaatatggacgtcataggagagcgaattaaaagaatcaaggaagaacactcttcaacctggcactacgatgacgaaaacccctataaaacatgggcttaccacggcagctatgaggttaaggccacgggctccgcaagttctatgatcaatggggtggtaaagctgttaaccaaaccttgggatgtggtcccaatggtgactcaaatggccatgacagacaccactcccttcggacagcagagggtttttaaggaaaaagtggatacacggaccccgcgccctatgcccggtacaagaaaggtcatggagattactgctgagtggctgtggaggaccttgggccgaaacaaaaagccacggctctgcacgcgtgaagagttcaccaagaaagtgagaacaaatgcggccatgggggcagtatttactgaagagaaccaatgggacagcgctcgcgccgcagttgaagatgaggagttctggaagctggtggacagggaacgggagctacataaacttggaaagtgtggctcatgcgtctacaatatgatgggtaaaagagaaaagaaactgggggagtttggaaaggccaagggctcccgcgctatatggtacatgtggctcggcgccaggtatctggagttcgaagcgttggggtttctgaacgaggatcactggttcagtcgagaaaatagctactctggagtggagggtgaaggcctccataaacttgggtatatcctgcgggacatttccaagatccctggaggcgcaatgtacgccgatgacaccgctggttgggacacaagaattactgaggatgacttacacaacgaggagaaaatcacccagcagatggatcccgagcataggcagctggccaatgcaatatttaagttgacgtatcaaaacaaagtggtcaaggttcagcgcccaacacccaaggggaccgtgatggacatcatttcacgtaaagatcagcggggaagcggccaggtaggcacttacgggctcaatacattcaccaacatggaagctcaactggtgagacagatggagggagaaggtgtcctatcgaaggccgaccttgagaatcctcatctgctcgagaaaaagatcactcagtggctggaaaccaaaggcgtggagaggttgaagcgcatggctatttctggggatgactgcgttgtgaagccaatcgatgaccgatttgccaacgcattactggcgctcaacgatatgggaaaagtccggaaggacataccgcagtggcaacccagtaaaggctggcacgattggcaacaggtgcctttctgttcccatcacttccatgaacttattatgaaggacggtagaaaactggtagttccatgcaggccccaggacgagctaatcgggcgcgccagaatcagccaaggagctggctggtcactgaaggaaacagcctgtctcggcaaggcatatgctcagatgtggtccttgatgtactttcaccggagggatctgcgtcttgcctctaatgcaatttgcagcgccgtgcctgtccactggataccaacgagtcgaaccacttggtccatccatgcgcaccatcagtggatgacaaccgaggacatgctgactgtgtggaaccgcgtttggattgaggataatccctggatggaagacaaaacacctgtgaccacgtgggaggatgtcccgtacctcgggaagagagaagaccaatggtgtggcagcttaatcggtctgacatctcgggctacctgggcccagaacattttgactgcaatccaacaggtgaggtcactgataggcgatgaggagttcctcgactatatgccaagtatgaaacgctttagaaaggaagaggaatccgagggggccatctggtga

SEQ ID NO: 15582 - RNA, 9873 nt, synthetic construct
  misc_feature 1..9873: note = derived and/or modified CDS sequence (opt3) from DENV-3__KF955457__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggcaaccgtggagattactcctcaggcttccacggtcgaagccgtgcttccagagtatggaacactgggcttggaatgctctccgcgaaccggtctagatttcaatgagatgatcctgctcactatgaaaaacaaggcgtggatggtacacagacagtggtttttcgacctgccccttccttggaccagcggggccacaaccgagactccaacatggaataggaaagaactgttggttacgtttaagaacgcacatgctaaaaagcaagaggtggtcgtgctcggctcccaggaaggagccatgcacaccgctctgactggcgccacagagatccagaattcagggggaaccagtattttcgcaggtcacttaaagtgtcggctgaaaatggataagctagaactcaaaggcatgagctacgccatgtgcctgaacacatttgtccttaagaaagaggtgtctgagactcagcatgggaccatattgatcaaggttgaatacaagggagaggacgctccctgtaaaattcctttctccacggaagatggccaaggtaaggcgcacaacgggcgtctgatcaccgcaaatccagtggtaacaaaaaaggaggagcccgtcaacatagaagccgagccgcctttcggcgaatcaaatattgtgatcggaatcggcgacaaagctctcaagattaactggtataagaaagggagcagtatcggaaagatgtttgaggccactgcacgcggtgccagaaggatggctattctgggcgataccgcctgggacttcgggtctgttggaggcgtgcttaattccctgggtaaaatggtccatcagatatttgggagcgcatacacagcgttgttctcgggcgtgtcttggatcatgaagattggaatcggcgtactcctgacttggatcgggttaaactccaaaaatacctcaatgagttttagctgcattgtgataggaatcattacgctgtatctaggcgctgttgtccaggccgatatgggttgtgcaatcaactggaaggggaaggaactcaaatgcggatccggcattttcgtgacaaatgaggtgcacacctggactgagcagtacaagtttcaagccgactctcccaaacggctggctacagccatcgcaggtgcttgggaaaacggcgtctgtgggatacgaagcaccactcgcatggagaatcttttgtggaagcagatcgccaacgaactgaattatattctctgggagaacaatatcaaactgaccgttgtggtgggagatattatcggcgtattagaacaggggaagagaacactgacgccacagcctatggagcttaaatactcatggaagacctggggaaaggcgaaaatagtcactgccgagacacaaaacttcagttttattatcgacggccccaacaccccagaatgcccctccgctagcagggcatggaatgtgtgggaggttgaagactatggtttcggggtgtttacaactaacatttggttgaagctccgggaggtctacacccagtcttgtgatcatcgcctgatgtcagccgctatcaaagacgaaagagccgtgcacgcagatatgggatactggatagagagtcagaagaatggcagctggaaactagagaaggcgtccttcatcgaagttaagacgtgcacatggcctaaatctcacaccctgtggtcgaacggtgtgctcgagagcgacatgattatcccaaagtccctggccggcccgatttcacagcataatcacaggcccgggtatcatactcaaaccgctggaccttggcaccttggcaaattggaactggattttaactactgcgaggggacaactgtagtcatcaccgaggactgtggaacacgtggcccaagtttacggacgaccactgtgtctggtaagctcatacacgaatggtgctgtcgaagctgcacactgccccctcttagatatatgggggaggatggatgttggtacggcatggaaattaggccaatcaatgagaaagaagagaacatggtgaagtccctggtctcagccggtagcggcaaggttgacaatttcaccatgggggtgttgtgcctcgcaatcctgttcgaggaagtaatgcgcggaaaatttggcaagaaacatatgattgctggggtgctattcacttttgtcctgctcctgtctggacagatcacatggcgggatatggcccacacccttattatgataggctccaacgcaagtgacagaatgggtatgggggtgacgtatttggccctgatcgctactttcaagattcagccctttttagcgctcggattctttctgaggaaacttaccagccgcgagaatctgctactcggcgttggcctggccatggcaacaaccttgcaactgccggaagatatcgagcagatggctaacgggattgccttaggactcatgactctgaagcttatcacacagttcgaaacctaccagctgtggacagccttggtgtctctcacttgttccaataccatatttacgctgacagtcgcttggcgaaccgcaactctaatcctggccggtgtgtcacttctccctctgtgccaaagtagctcgatgcggaagaccgactggttgccaatgacagttgcggctatgggcgtgccccctctgcccttattcattttttccctcaaagatactccaaagcgtagatcttggcctctgaacgagggggtcatggccgtaggacttgtgagcatcctggcatcaagtttgctcaggaatgacgttcccatggccggcccactggtggctggtgggctactgattgcatgttatgtcatcaccggaacgtccgccgaccttacagtggagaaagcggctgatgtaacctgggaagaggaagccgagcagactggcgtgtctcataacctcatgataacagtcgacgatgacggcaccatgcgcattaaggatgacgaaactgagaacatcctgacagttttgttaaaaaccgcactgctcatcgtgagcgggattttcccgtactccatacctgccacgctgcttgtgtggcacacttggcagaagcagacccaacggtcaggagtcctgtgggatgtgcccagcccacccgagacacagaaagctgaattggaggaaggtgtttacagaatcaagcagcagggcatttttgggaagacccaagtaggagtgggcgtccagaaagagggtgtgttccatacaatgtggcacgttactaggggggccgtgctaacccacaatggaaagcgactggagcctaactgggcaagtgtcaaaaaggacctcatctcttatggcggcgggtggcgcctgtccgctcagtggcaaaaaggagaagaggtgcaggtaattgccgtcgaaccaggtaagaatcccaagaacttccagacgatgcctggcatctttcagacaactaccggggagataggagcgatcgcccttgatttcaaaccgggcacaagcggttcgccaattatcaatcgggaagggaaggtggttggattatacggcaacggcgtggtcaccaaaaatgggggatatgtgtcaggtattgcacaaactaacgctgagcccgacggccctaccccagagctggaagaggaaatgtttaagaaaagaaatctcacaatcatggatttgcatcccgggtctggaaagacgaggaagtacctgcctgccatagttcgtgaggctattaaacgccggctcagaactctgatccttgcaccgaccagggtggtcgccgccgaaatggaggaggctctgaagggcttgcccatccgatatcagacaaccgcgactaaaagtgaacacacaggtcgggagattgtggacctaatgtgccatgcaaccttcacgatgcgcctgctctccccagtaagagtgcctaactacaatttaatcataatggatgaagcccactttactgaccccgctagcattgccgcaagggggtatatctctacacgggttggaatgggcgaggccgctgcgattttcatgaccgccaccccacctggcactgcagaagcttttccccagagcaacgccccaatccaggacgaggagcgagatataccggaaagatcctggaattcagggaacgagtggattacagacttcgtcggaaagaccgtgtggtttgtgcctagtatcaaagcaggtaatgatatcgccaactgtctgcgcaagaacggcaagaaagtcattcaacttagcaggaagacattcgacactgaataccagaaaacgcgtctgaatgattgggactttgtagtgaccacagatatctctgagatgggggctaacttcaaggccgaccgggttattgatcccagaaggtgcctcaaaccagtgatattgactgacggacccgagcgcgtcatcctggcgggccctatgccagtgaccgcagcctccgctgcccagcgaagaggtcgggttgggaggaatccccagaaggaaaacgatcaatacattttcacaggccagcctctcaataacgacgaggaccatgctcactggaccgaagcaaagatgctgcttgataatatcaacactccggagggaatcattccagccctatttgaacccgagcgcgagaaatcagctgccatagacggcgaatatcgtctgaagggggagagtagaaaaacgttcgtggaattgatgcggaggggagatttacctgtctggctggcacacaaggtggcgagcgagggtatcaaatacaccgaccgcaagtggtgctttgatggcgaacgaaataaccagattctcgaggagaatatggacgtagaaatctggacaaaagagggggaaagaaagaagctgcggcccaggtggcttgatgcccgcacttattccgacccactggctctcaaagagttcaaggattttgccgcaggaagaaaatctattgctttggacctggtgaccgaaatcggcagggttccttcgcatctagcctaccggacacgtaacgcactggataatctcgtcatgcttcacaccagcgagcatggtgggcgcgcctatcgacacgctgtggaggaactgcccgagactatggaaacattattgctgctcggcctgatgatacttctgacgggaggcgcgatgctcttcttgatctcagggaagggaattggtaaaacctccatcggcctgatttgtgtgatcgtcagttctgggatgttatggatggccgacgttccactacagtggatagcaagcgctattgtgctggagtttttcatgatggtactccttatccctgagccggaaaagcaaagaactccccaggataaccagctggcctacgtggtcattggaatcttgacactggccgcaatagtggctgccaatgagatgggcctcctggaaaccaccaagagggaccttggtatgtccaaagagccaggggttgtgtcacctacatcttatctcgacgtcgatctgcaccccgcgagcgcttggactttgtacgccgtagcaacgaccgtgatcacaccaatgctgcggcatactattgaaaacagtaccgccaatgtttccttagctgcaatcgccaaccaagcggtggtcctaatgggcctggacaagggatggcctattagcaaaatggatctcggcgtgccccttctggctttggggtgctactctcaggtcaacccgctgacactcaccgccgcagtgctgcttttagttactcactatgccatcataggaccaggcctgcaggctaaggccacgcgcgaggcacagaaaagaacagctgccggtattatgaagaatcctaccgtggacgggatcatgactatcgatctcgaccccgtaatttacgattcaaagtttgagaaacaattgggacaggtgatgctgctagtcctgtgtgcggttcagctccttctgatgaggacctcctgggccttgtgcgaagcactgacactcgctactggcccaatcaccacactgtgggagggtagtcccggcaagttctggaacacgaccatagccgtgagcatggcaaatatttttcgggggtcgtatttagctggagccggccttgccttctctatcatgaaatccgtcgggactggacgaagaggcacaggtagccagggggaaaccctgggagagaagtggaaaaagaagctcaaccaactatcacgcaaagaatttgacctgtacaagaaaagtggcattactgaggtggataggacagaggcgaaggaaggtttgaaacggggcgagaccacgcatcacgctgtatctcgtgggtccgcaaagctgcagtggttcgtggacagaaatatggttatccctgaaggaagggtgatagatctcggctgtgggcgcggaggctggagctattactgcgccggtcttaaaaaggtcaccgaggtgcgggggtatacaaagggaggcccgggccatgaagagcccgtcccaatgtcaacttacgggtggaacctggtgaaattgatgagtggaaaggacgttttctacctgcctcccgagaaatgtgataccctcttatgcgacatcggtgaaagctccccttctccaacagtagaggaaagccgaactattagagtgctgaagatggtcgagccctggcttaaaaataaccagttttgtatcaaggtgctgaatccttatatgccaaccgttattgagcacctagaaaggctccagcgcaagtacggcgggatgctggtgcggaaccccttgtccagaaattcaacacacgagatgtattggatctctaacggaaccggcaatattgtcagttcggtgaacatggtaagccgtctgctccttaataggttcactatgacgcatcggcgcccgacaatcgaaaaagacgtggatctgggtgctgggacccgacacgttaacgccgagcctgaaactccaaacatggacgtcataggagagagaattaagaggatcaaagaggaacattcctctacctggcactacgatgacgagaatccctataagacatgggcataccacggctcatatgaagtgaaagccacgggcagcgcttccagtatgatcaacggggtggtcaagttactgaccaagccttgggatgttgtgccaatggtaactcaaatggcgatgacagacaccactccctttggacagcagcgggtgttcaaagagaaggtcgatacacgcaccccgagacctatgcccggtacaaggaaagtgatggaaattactgccgagtggttgtggcgaaccctcggccggaataagaaaccacgtctgtgcacgagagaggaatttaccaagaaggttcgcacaaacgcagctatgggggccgtgttcactgaggaaaatcaatgggactctgcaagggccgctgtcgaggatgaagagttttggaaactagtggaccgggagagagaacttcataagctgggaaaatgtggcagctgcgtatacaacatgatgggtaagcgcgagaaaaagctcggggaattcggaaaagccaagggctcaagggcgatatggtacatgtggctgggcgcacgatatttggagtttgaggccctggggttcctcaatgaagatcactggttttcccgggagaacagttacagcggagttgaaggtgagggccttcataagctggggtatatcttaagagacatttctaaaatccctggaggcgctatgtacgccgacgataccgcaggttgggacacaaggattactgaagatgacctgcacaatgaggagaagatcacccagcagatggatcccgaacatcgccagttggctaacgccatattcaaactcacgtatcaaaataaggtggtcaaagtgcagcgtccaacacccaaggggaccgtgatggacatcatttcccggaaggatcagagaggatcaggccaggtcggcacttacgggctgaacacatttaccaatatggaggctcaactagttaggcagatggaaggagagggtgtgcttagcaaagccgacctggaaaaccctcacctcctggagaagaaaatcactcagtggttggagaccaagggcgtagaacgcttaaaacgaatggcaatttcgggggatgactgcgtggtcaagccaatcgatgaccggttcgcgaatgccctgctcgctcttaacgatatgggaaaggtgagaaaagacataccgcagtggcaaccctctaagggctggcacgactggcagcaggttcctttctgtagtcatcactttcatgagctgattatgaaagatggtaggaagctagtggtcccatgccgcccccaggacgaactgatcgggagagcccggatctcccaaggagcaggctggagcctcaaagagacagcttgtttgggcaaggcctatgcacagatgtggtcactgatgtacttccacaggcgtgatcttcgactggcctccaacgcgatttgctctgctgtgcctgtacactggataccaacgagccgcaccacttggagtatccatgcccaccatcagtggatgacaaccgaagacatgctcactgtttggaatagagtgtggattgaggataacccctggatggaggacaagacacctgtcaccacgtgggaagatgtgccgtacttagggaaacgggaggaccaatggtgtggatccctgatcggtttgacaagcagggcaacctgggcccagaatattctgactgctatccagcaggttcgctctctcataggcgatgaagagtttcttgactatatgccatcaatgaagagattccggaaagaggaagagagtgaaggggccatctggtga

SEQ ID NO: 15583 - RNA, 9873 nt, synthetic construct
  misc_feature 1..9873: note = derived and/or modified CDS sequence (opt3) from DENV-3__FJ562100__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctatccttccagagtatggaacactgggcttggaatgctctccgcgaaccggtctagatttcaatgagatgatcctgctcactatgaaaaacaaggcctggatggtacacagacagtggtttttcgacctgccccttccttggaccagcggggcgacaaccgagactccaacatggaataggaaagaactgttggttacgtttaagaacgcccatgcaaaaaagcaagaggtggtcgtgctcggctcccaggaaggagctatgcacaccgccctgactggcgctacagagattcagaattcagggggaaccagtatattcgccggtcacttaaagtgtcggctgaaaatggataagctagaactcaaaggcatgagctacgcaatgtgcctgaacacatttgtccttaagaaagaggtgtctgagactcagcatgggaccatcttgattaaggttgaatacaagggagaggacgccccctgtaaaatccctttctccacggaagatggccaaggtaaggctcacaacgggcgtctgataaccgcgaatccagtggtaacaaaaaaggaggagcccgtcaacattgaagcagagccgcctttcggcgaatcaaatatcgtgatcggaattggcgacaaagccctcaagatcaactggtataagaaagggagcagtattggaaagatgtttgaggctactgcccgcggtgcaagaaggatggccatactgggcgataccgcttgggacttcgggtctgttggaggcgtgcttaattccctgggtaaaatggtccatcagatctttgggagcgcctacacagcattgttctcgggcgtgtcttggattatgaagatcggaatcggcgtactcctgacttggattgggttaaactccaaaaatacctcaatgagttttagctgcatagtgatcggaattatcacgctgtatctaggcgcggttgtccaggctgatatgggttgtgccattaactggaaggggaaggaactcaaatgcggatccggcatcttcgtgacaaatgaggtgcacacctggactgagcagtacaagtttcaagcagactctcccaaacggctggccacagctatagccggtgcatgggaaaacggcgtctgtgggatccgaagcaccactcgcatggagaatcttttgtggaagcagattgctaacgaactgaattatatcctctgggagaacaatattaaactgaccgttgtggtgggagatatcataggcgtattagaacaggggaagagaacactgacgccacagcctatggagcttaaatactcatggaagacctggggaaaggccaaaattgtcactgcggagacacaaaacagttccttcatcattgacggccccaacaccccagaatgccccagcgcctctagggcttggaatgtgtgggaggttgaagactatggttttggggtgttcacaactaacatctggttgaagctccgggaggtctacacccagtcatgtgatcatcgcctgatgagtgcagccataaaagacgaaagagctgtgcacgccgatatgggatactggatcgagagccagaagaatggctcctggaaactagagaaggcatcttttattgaagttaagacgtgcacatggcctaaatcgcacaccctgtggagcaacggtgtgctcgagtccgacatgatcattccaaagtcactggcgggcccgatcagtcagcataatcacaggcccgggtatcatactcaaaccgccggaccttggcaccttggcaaattggaactggatttcaactactgcgaggggacaactgtagtcataaccgagaattgtggaacacgtggcccatctttacggacgaccactgtgagcggtaagctcattcacgaatggtgctgtcgatcctgcacactgccccctcttagatatatgggggaggacggatgttggtacggcatggaaatcaggccaatcaacgagaaagaagagaatatggtgaagtcactggtcagcgctggttctggcaaggttgataactttaccatgggggtgttgtgcctcgccattctgttcgaggaagtaatgcgcggaaaattcggcaagaaacatatgatcgcaggggtgctatttactttcgtcctgctcctgtccggacagattacatggcgggacatggctcacacccttataatgatcggcagtaatgccagcgatagaatgggtatgggggtgacgtatttggcactgattgccacttttaagatccagcccttcttagctctcggatttttcctgaggaaacttacctctcgcgagaacctgctactcggcgttggcctggcgatggccacaaccttgcaactgccggaagacattgagcagatggcaaatgggatcgctttaggactcatgactctgaagcttataacacagtttgaaacctaccagctgtggacagccttggtgtccctcacttgttcaaacaccatcttcacgctgacagtcgcctggcgaaccgctactctaattctggcaggtgtgagtcttctccctctgtgccaaagctcgtccatgcggaagaccgattggttgccaatgacagttgccgcgatgggcgtgccccctctgcccttatttatcttctctctcaaagacactccaaagcgtagaagctggcctctgaatgagggggtcatggctgtaggacttgtgtcaattctggccagttccttgctcaggaacgatgttcccatggcaggcccactggtggccggtgggctactgatcgcttgttatgtcataaccggaacgtctgcagaccttacagtggagaaagccgcggacgtaacctgggaagaggaagctgagcagactggcgtgagccataacctcatgattacagtcgatgacgatggcaccatgcgcatcaaggacgatgaaactgagaatatcctgacagttttgttaaaaaccgccctgctcattgtgtccgggatatttccgtactcaatccctgcaacgctgcttgtgtggcacacttggcagaagcagacccaacggagcggagtcctgtgggacgtgcccagtccacccgagacacagaaagccgaattggaggaaggtgtttacagaattaagcagcagggcatcttcgggaagacccaagtaggagtgggcgtccagaaagagggtgtgtttcatacaatgtggcacgttactaggggggctgtgctaacccacaacggaaagcgactggagcctaattgggcctctgtcaaaaaggatctcatttcctatggcggcgggtggcgcctgagcgcacagtggcaaaaaggagaagaggtgcaggtaatcgctgtcgaaccaggtaagaaccccaagaatttccagacgatgcctggcatattccagacaactaccggggagatcggagccattgcgcttgactttaaaccgggcacatcgggttcaccaatcattaaccgggaagggaaggtggttggattatacggcaatggcgtggtcaccaaaaacgggggatatgtgtctggtatcgcccaaactaatgcagagcccgatggccctaccccagagctggaagaggaaatgttcaagaaaagaaacctcacaataatggacttgcatcccgggagtggaaagacgaggaagtacctgcctgctattgttcgtgaggccatcaaacgccggctcagaactctgatccttgctccgaccagggtggtcgcagccgaaatggaggaggccctgaagggcttgcccattcgatatcagacaaccgctactaaatccgaacacacaggtcgggagatcgtggatctaatgtgccatgcgacctttacgatgcgcctgctcagcccagtaagagtgcctaattacaacttaataattatggacgaagcacacttcactgatcccgcctctatcgctgccagggggtatattagcacacgggttggaatgggcgaggcagccgctatctttatgaccgcgaccccacctggcactgccgaagcattcccccagtccaatgctccaatacaggacgaggagcgagacattccggaaagatcatggaacagtgggaatgagtggatcacagattttgtcggaaagaccgtgtggttcgtgcctagcatcaaagccggtaacgacattgcaaactgtctgcgcaagaatggcaagaaagtcatccaactttctaggaagacatttgatactgaataccagaaaacgcgtctgaacgactgggatttcgtagtgaccacagacatttccgagatgggggccaattttaaggctgatcgggttatagaccccagaaggtgcctcaaaccagtgatcttgactgatggacccgagcgcgtcattctggccggccctatgccagtgaccgcggcatcagccgctcagcgaagaggtcgggttgggaggaacccccagaaggaaaatgaccaatacatcttcacaggccagcctctcaacaatgatgaggaccatgcccactggaccgaagctaagatgctgcttgacaacatcaatactccggagggaattataccagcactattcgaacccgagcgcgagaaaagtgccgctatcgatggcgaatatcgtctgaagggggagagcagaaaaacgtttgtggaattgatgcggaggggagacttacctgtctggctggcccacaaggtggcatccgagggtattaaatacaccgatcgcaagtggtgcttcgacggcgaacgaaacaatcagatcctcgaggagaacatggatgtagaaatttggacaaaagagggggaaagaaagaagctgcggcccaggtggcttgacgcgcgcacttattctgatccactggccctcaaagagtttaaggacttcgctgccggaagaaaatcgatcgcattggatctggtgaccgaaataggcagggttcctagccatctagcttaccggacacgtaatgccctggacaacctcgtcatgcttcacacctcagagcatggtgggcgcgcatatcgacacgccgtggaggaactgcccgagactatggaaacattattgctgctcggcctgatgatccttctgacgggaggcgctatgctctttttgatttccgggaagggaatcggtaaaaccagtattggcctgatctgtgtgactgtctctagcgggatgttatggatggcggatgttccactacagtggatagcctccgcaattgtgctggagttctttatgatggtactccttatccctgagccggaaaagcaaagaacaccccaggacaatcagctggcttacgtggtcattggaatcttgaccctggccgccatagtggcagctaacgagatgggcctcctggaaaccacaaagagggatcttggtatgtcaaaagagccaggggttgtgtctcctactagctatctcgacgtcgacctgcaccccgccagtgcgtggacgttgtacgctgtagccaccacagtgatcactccaatgctgcggcataccattgaaaattccacagcaaacgttagcttagccgctatcgcaaaccaagccgtggtcctaatgggcctggataagggatggcctatttctaaaatggacctcggcgtgccccttctggcgttggggtgctactcacaggtcaatccgctgaccctcactgctgccgtgctgcttttagttacgcactatgcaatcataggaccaggcctgcaggccaaggctacacgcgaggcccagaaaagaaccgcagctggtattatgaagaaccctactgtggatgggatcatgaccatcgacctcgatcccgtaatttacgactccaagttcgagaaacaattgggacaggtgatgctgctagtcctgtgtgccgttcagctccttctgatgaggacaagttgggcgttgtgcgaagccctgactctcgcaaccggcccaatcacaacgctgtgggagggtagccccggcaagttttggaataccactatagctgtgtcgatggccaacattttccgggggtcttatttagcaggagctggccttgccttttccatcatgaaaagcgtcgggacaggacgaagaggcaccggttcacagggggaaactctgggagagaagtggaaaaagaagctcaatcaactaagtcgcaaagaattcgatctgtacaagaaatctggcattacagaggtggacaggaccgaggccaaggaaggtttgaaacggggcgagacgacccatcacgcggtatcccgtgggagcgctaagctgcagtggtttgtggaaagaaacatggttatccctgagggaagggtgatagatctcggctgtgggcgcggaggctggtcatattactgcgcaggtcttaaaaaggtcacagaagtgcgggggtatactaagggaggcccgggccatgaggagcccgtcccaatgagtacctacgggtggaatctggtgaaattgatgagcggaaaggacgttttctacctgcctcccgaaaaatgtgatacactcttatgcgacatcggtgagtcctctcctagcccaactgtagaagagtcccgaaccattagagtgctgaagatggtcgagccctggcttaaaaacaatcagttctgtatcaaggtgctgaacccttatatgccaacagttattgaacacctagagaggctccagcgcaagtacggcgggatgctggtgcggaatcccttgtcaagaaactctacccacgaaatgtattggatcagtaatggaactggcaacattgtctcgagcgtgaatatggtatcccgtctgctccttaacaggtttacgatgacacatcggcgcccgaccatcgagaaagatgtggacctgggtgccgggactcgacacgttaacgctgaacctgagaccccaaatatggacgtcataggagagagaattaagaggatcaaagaagagcattcttcaacatggcactacgatgacgaaaacccctataagacgtgggcctaccacggcagctatgaggtgaaagcaaccggctccgccagttctatgatcaatggggtggtcaagttactgactaagccttgggatgttgtgccaatggtaacacaaatggctatgaccgacactacacccttcggacagcagcgggtgtttaaagaaaaggtcgatacccgcacaccgagacctatgcccggtactaggaaagtgatggagattaccgcggagtggttgtggcgaacgctcggccggaacaagaaaccacgtctgtgcaccagagaagagttcacaaagaaggttcgcactaatgccgcaatgggggctgtgtttaccgaagagaaccaatgggacagcgccagggcagccgtcgaagatgaggagttctggaaactagtggaccgggaaagagagcttcataagctgggaaaatgtggctcatgcgtatacaatatgatgggtaagcgcgaaaaaaagctcggggagtttggaaaagctaagggctccagggccatatggtacatgtggctgggcgcgcgatatttggagttcgaagcactggggtttctcaacgaggatcactggttcagtcgggaaaatagctactctggagttgagggtgaaggccttcataagctggggtatatcttaagagacatttccaaaatccctggaggcgccatgtacgctgatgacacagccggttgggacactaggattaccgaggatgacctgcacaacgaggaaaagatcacgcagcagatggatcccgagcatcgccagttggcaaatgctatatttaaactcacatatcaaaacaaggtggtcaaagtgcagcgtccaacccccaaggggactgtgatggacatcatttcacggaaggatcagagaggaagcggccaggtcggcacatacgggctgaataccttcactaacatggaagcccaactagttaggcagatggagggagaaggtgtgctttcgaaagctgacctggagaatcctcacctcctggagaagaaaatcacccagtggttggaaacaaagggcgtagagcgcttaaaacgaatggccatttctggggatgactgcgtggtcaagccaatcgatgaccggtttgcaaacgcgctgctcgcccttaacgatatgggaaaggtgagaaaagacataccgcagtggcaacccagtaagggctggcacgattggcagcaggttcctttctgttcccatcacttccatgaactgattatgaaagacggtaggaagctagtggtcccatgccgcccccaggacgagctgatcgggagagctcggatcagccaaggagccggctggtcactcaaagaaacggcatgtttgggcaaggcttatgcccagatgtggtccctgatgtactttcacaggcgtgatcttcgactggcatctaatgccatttgcagcgcggtgcctgtacactggataccaaccagtcgcactacatggtccatccatgctcaccatcagtggatgaccactgaggacatgctcacagtttggaacagagtgtggattgaggataatccctggatggaagacaagacccctgtcacgacatgggaggatgtgccgtacttagggaaacgggaagaccaatggtgtggaagcctgatcggtttgacctctagggccacttgggcacagaacattctgaccgccatccagcaggttcgctcactcataggcgatgaggagttccttgactatatgccaagtatgaagagatttcggaaagaagaggaatccgagggggctatctggtga

SEQ ID NO: 15584 - RNA, 9873 nt, synthetic construct
  misc_feature 1..9873: note = derived and/or modified CDS sequence (opt3) from DENV-3__FJ547062__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacatttctacatcgttaactcagaaggttgtgatcttcatactgcttatgttggtcaccccatcaatgacaatgcgctgtgtgggcgtaggcaacagagactttgttgaagggctgagcggagccacctgggtggatgtcgtgctagagcatggtggctgcgtgacgactatggcgaagaataaacccacactcgacatcgagctgcagaagaccgaagcaactcaacttgccacactgaggaaattgtgtattgaggggaagatcaccaacattacgaccgatagtcggtgccctacacagggagaagctatcctcccagaggaacaggaccagaattatgtctgtaaacacacttacgttgatcgcggctggggtaacgggtgcggactgttcggcaagggctccttagtgacctgcgccaagtttcaatgtctggagcccatagaggggaaagtagtgcagtatgaaaatctcaagtacacagtcattatcactgtgcacaccggagaccagcatcaggttggtaacgacacacaaggcgtgaccgtcgagattactcctcaggcatctacggtggaagctatccttccagagtatgggacactgggattggaatgcagcccgcgaaccggcctagatttcaatgagatgatcctgctcactatgaaaaacaaggcctggatggtacacagacagtggtttttcgacctgccccttccttggacctccggtgcgacaaccgagactccaacatggaataggaaagaactgttggttacgtttaagaacgcccatgcaaaaaagcaagaggtggtcgtgctcgggtcacaggaaggcgctatgcacaccgccctgactggagctacagagattcagaatagtggcgggaccagcatattcgccggacacttaaagtgtcggctgaaaatggataagctagaactcaaaggtatgtcttacgcaatgtgcctgaacacatttgtccttaagaaagaggtgtccgagactcagcatggcaccatcttgattaaggttgaatacaagggggaggacgccccctgtaaaatccctttctcaacggaagatggacaaggcaaggctcacaacggtcgtctgataaccgcgaatccagtggtaacaaaaaaggaggagcccgtcaacattgaagcagagccgcctttcggggaaagcaatatcgtgatcggcattggagacaaagccctcaagatcaactggtataagaaaggcagttctattgggaagatgtttgaggctactgcccgcggagcaagaaggatggccatactgggtgataccgcttgggacttcggctccgttgggggagtgcttaatagcctgggcaaaatggtccatcagatctttggttcggcctacacagcattgttctctggggtgtcctggattatgaagatcggcatcggagtactcctgacttggattggcttaaactcaaaaaataccagtatgagcttttcctgcatagtgatcgggattatcacgctgtatctaggagcggttgtccaggctgatatgggctgtgccattaactggaagggtaaggaactcaaatgcgggtctggaatcttcgtgacaaatgaggtgcacacctggactgagcagtacaagtttcaagcagacagccccaaacggctggccacagctatagccggcgcatgggaaaacggtgtctgtggcatccgatcaaccactcgcatggagaatcttttgtggaagcagattgctaacgaactgaattatatcctctgggagaacaatattaaactgaccgttgtggtgggggatatcataggagtattagaacagggcaagagaacactgacgccacagcctatggagcttaaatacagttggaagacctgggggaaggccaaaattgtcactgcggagacacaaaactccagcttcatcattgacggacccaacaccccagaatgcccctctgcctcaagggcttggaatgtgtgggaggttgaagactatggctttggtgtgttcacaactaacatctggttgaagctccgggaggtctacacccagagttgtgatcatcgcctgatgagcgcagccataaaagacgaaagagctgtgcacgccgatatggggtactggatcgagtcccagaagaatggatcttggaaactagagaaggcatcgtttattgaagttaagacgtgcacatggcctaaaagccacaccctgtggtccaacggcgtgctcgagtcagacatgatcattccaaagagtctggcgggtccgatctctcagcataatcacaggcccggctatcatactcaaaccgccgggccttggcaccttggaaaattggaactggatttcaactactgcgagggcacaactgtagtcataaccgagaattgtgggacacgtggaccaagcttacggacgaccactgtgtccggcaagctcattcacgaatggtgctgtcgatcatgcacactgccccctcttagatatatgggtgaggacgggtgttggtacggaatggaaatcaggccaatcaacgagaaagaagagaatatggtgaagagcctggtctctgctggctccggtaaggttgataactttaccatgggcgtgttgtgcctcgccattctgttcgaggaagtaatgcgcgggaaattcggaaagaaacatatgatcgcaggcgtgctatttactttcgtcctgctcctgagtgggcagattacatggcgggacatggctcacacccttataatgatcggaagcaatgcctctgatagaatgggcatgggtgtgacgtatttggcactgattgccacttttaagatccagcccttcttagctctcgggtttttcctgaggaaacttacctcccgcgagaacctgctactcggagttggcctggcgatggccacaaccttgcaactgccggaagacattgagcagatggcaaatggcatcgctttagggctcatgactctgaagcttataacacagtttgaaacctaccagctgtggacagccttggtgtcactcacttgtagtaacaccatcttcacgctgacagtcgcctggcgaaccgctactctaattctggcaggagtgagccttctccctctgtgccaatcgtcctctatgcggaagaccgattggttgccaatgacagttgccgcgatgggtgtgccccctctgcccttatttatcttcagcctcaaagacactccaaagcgtagatcatggcctctgaatgagggcgtcatggctgtagggcttgtgagtattctggcctcctctttgctcaggaacgatgttcccatggcaggaccactggtggccggcggtctactgatcgcttgttatgtcataaccgggacgagcgcagaccttacagtggagaaagccgcggacgtaacctgggaagaggaagctgagcagactggagtgtcccataacctcatgattacagtcgatgacgatggcaccatgcgcatcaaggacgatgaaactgagaatatcctgacagttttgttaaaaaccgccctgctcattgtgtcaggcatatttccgtacagcatccctgcaacgctgcttgtgtggcacacttggcagaagcagacccaacggagtggggtcctgtgggacgtgccctctccacccgagacacagaaagccgaattggaggaaggagtttacagaattaagcagcagggtatcttcggcaagacccaagtaggggtgggagtccagaaagagggcgtgtttcatacaatgtggcacgttactaggggtgctgtgctaacccacaacgggaagcgactggagcctaattgggcctccgtcaaaaaggatctcattagctatggaggcggctggcgcctgtcggcacagtggcaaaaaggggaagaggtgcaggtaatcgctgtcgaaccaggaaagaaccccaagaatttccagacgatgcctggtatattccagacaactaccggcgagatcggggccattgcgcttgactttaaaccgggaacatcaggctctccaatcattaaccgggaaggtaaggtggttgggttatacggaaatggcgtggtcaccaaaaacggcgggtatgtgagtggaatcgcccaaactaatgcagagcccgatggtcctaccccagagctggaagaggaaatgttcaagaaaagaaacctcacaataatggacttgcatcccggctccgggaagacgaggaagtacctgcctgctattgttcgtgaggccatcaaacgccggctcagaactctgatccttgctccgaccagggtggtcgcagccgaaatggaggaggccctgaagggattgcccattcgatatcagacaaccgctactaaaagcgaacacacaggccgggagatcgtggatctaatgtgccatgcgacctttacgatgcgcctgctctctccagtaagagtgcctaattacaacttaataattatggacgaagcacacttcactgatcccgccagcatcgctgccaggggttatatttccacacgggttgggatgggagaggcagccgctatctttatgaccgcgaccccacctggcactgccgaagcattcccccagtcaaatgctccaatacaggacgaggagcgagacattccggaaagaagttggaacagcggcaatgagtggatcacagattttgtcgggaagaccgtgtggttcgtgccttctatcaaagccggaaacgacattgcaaactgtctgcgcaagaatggtaagaaagtcatccaactttccaggaagacatttgatactgaataccagaaaacgcgtctgaacgactgggatttcgtagtgaccacagacatttcagagatgggcgccaattttaaggctgatcgggttatagaccccagaaggtgcctcaaaccagtgatcttgactgatgggcccgagcgcgtcattctggccggacctatgccagtgaccgcggcaagtgccgctcagcgaagaggccgggttggtaggaacccccagaaggaaaatgaccaatacatcttcacagggcagcctctcaacaatgatgaggaccatgcccactggaccgaagctaagatgctgcttgacaacatcaatactccggagggcattataccagcactattcgaacccgagcgcgagaaaagcgccgctatcgatggagaatatcgtctgaagggcgagtccagaaaaacgtttgtggaattgatgcggaggggggacttacctgtctggctggcccacaaggtggcatctgagggaattaaatacaccgatcgcaagtggtgcttcgacggtgaacgaaacaatcagatcctcgaggagaacatggatgtagaaatttggacaaaagagggcgaaagaaagaagctgcggcccaggtggcttgacgcgcgcacttattcggatccactggccctcaaagagtttaaggacttcgctgccgggagaaaaagcatcgcattggatctggtgaccgaaataggaagggttccttcacatctagcttaccggacacgtaatgccctggacaacctcgtcatgcttcacacctccgagcatggcggtcgcgcatatcgacacgccgtggaggaactgcccgagactatggaaacattattgctgctcgggctgatgatccttctgacgggcggagctatgctctttttgattagtggcaaggggatcggaaaaacctctattggtctgatctgtgtgatagtcagctccggcatgttatggatggcggatgttccactacagtggattgcctcagcaatcgtgctggagttctttatgatggtactccttattcctgagccggaaaagcaaagaactccccaggacaatcagctggcttacgtggtcatcgggatattgacactggccgccatcgtggcagctaacgagatgggactcctggaaaccaccaagagggatcttggcatgtctaaagagccaggtgttgtgagccctacaagttatctcgacgtcgacctgcaccccgcctccgcgtggactttgtacgctgtagccacgaccgtgattacaccaatgctgcggcatactatcgaaaatagcaccgcaaacgtttctttagccgctattgcaaaccaagccgtggtcctaatggggctggataagggctggcctatctcaaaaatggacctcggagtgccccttctggcgttgggctgctactcccaggtcaatccgctgacactcaccgctgccgtgctgcttttagttactcactatgcaataattgggccaggactgcaggccaaggctacgcgcgaggcccagaaaagaacagcagctggcatcatgaagaaccctaccgtggatggtatcatgactattgacctcgatcccgtaatctacgacagtaagttcgagaaacaattggggcaggtgatgctgctagtcctgtgtgccgttcagctccttctgatgaggaccagctgggcgttgtgcgaagccctgacactcgcaactggaccaataaccacactgtgggagggctcgcccggtaagttttggaatacgaccattgctgtgtctatggccaacatcttccggggctcctatttagcaggggctggacttgcctttagcattatgaaatcagtcggcactgggcgaagaggaacaggcagtcagggtgaaaccctgggggagaagtggaaaaagaagctcaatcaactatctcgcaaagaattcgatctgtacaagaaatccggaatcactgaggtggacaggacagaggccaaggaaggcttgaaacggggtgagaccacgcatcacgcggtaagccgtggctcagctaagctgcagtggtttgtggaaagaaacatggttatacctgaggggagggtgatcgatctcggatgtggccgcgggggatggagttattactgcgcaggccttaaaaaggtcaccgaagtgcggggttatacaaaggggggaccgggccatgaggagcccgtcccaatgagcacttacggctggaatctggtgaaattgatgtccgggaaggacgttttctacctgcctcccgaaaaatgtgataccctcttatgcgacattggagagtctagcccttccccaacagtagaagagtcacgaactatcagagtgctgaagatggtcgagccctggcttaaaaacaatcagttctgtattaaggtgctgaacccttatatgccaaccgttatcgaacacctagagaggctccagcgcaagtacggtggcatgctggtgcggaatcccttgtctagaaacagtacacacgaaatgtattggatttcgaatgggaccggaaacatcgtcagctccgtgaatatggtatctcgtctgctccttaacaggtttactatgacgcatcggcgcccgacaatagagaaagatgtggacctgggcgccggtacccgacacgttaacgctgaacctgagactccaaatatggacgtcattggggagagaatcaagaggatcaaagaagagcattcaagcacctggcactacgatgacgaaaacccctataagacatgggcctaccacggatcctatgaggtgaaagcaacgggcagtgcctctagcatgattaatggcgtggtcaagttactgaccaagccttgggatgttgtgccaatggtaactcaaatggctatgacagacaccactcccttcgggcagcagcgggtgtttaaagaaaaggtcgatacacgcaccccgagacctatgcccggaacaaggaaagtgatggagataactgcggagtggttgtggcgaaccctcggtcggaacaagaaaccacgtctgtgcacgagagaagagttcaccaagaaggttcgcacaaatgccgcaatgggcgctgtgtttactgaagagaaccaatgggactcagccagggcagccgtcgaagatgaggagttctggaaactagtggaccgggaaagagagcttcataagctggggaaatgtggatcctgcgtatacaatatgatgggcaagcgcgaaaaaaagctcggtgagtttgggaaagctaagggaagtagggccatctggtacatgtggctgggcgcgcgatatttggagttcgaagcactgggctttctcaacgaggatcactggttcagccgggaaaattcttactccggggttgagggagaaggtcttcataagctgggctatattttaagagacatctcaaaaattcctgggggagccatgtacgctgatgacaccgccggctgggacacaaggatcactgaggatgacctgcacaacgaggaaaagataacccagcagatggatcccgagcatcgccagttggcaaatgctatctttaaactcacgtatcaaaacaaggtggtcaaagtgcagcgtccaacacccaagggtaccgtgatggacattatcagccggaaggatcagagagggtcgggacaggtcggcacttacggcctgaatacattcaccaacatggaagcccaactagttaggcagatggagggggaaggagtgctttctaaagctgacctggagaatcctcacctcctggagaagaaaattactcagtggttggaaaccaagggtgtagagcgcttaaaacgaatggccatcagtggcgatgactgcgtggtcaagccaatagatgaccggtttgcaaacgcgctgctcgcccttaacgatatggggaaggtgagaaaagacattccgcagtggcaaccctccaagggatggcacgattggcagcaggttcctttctgtagccatcacttccatgaactgatcatgaaagacggcaggaagctagtggtcccatgccgcccccaggacgagctgatcggtagagctcggatttcacaaggggccggatggtccctcaaagaaacagcatgtttgggcaaggcttatgcccagatgtggtctctgatgtactttcacaggcgtgatcttcgactggcaagcaatgccatatgcagtgcggtgcctgtacactggatcccaacgtcccgcaccacttggagcattcatgctcaccatcagtggatgacaaccgaggacatgctcactgtttggaacagagtgtggatcgaggataatccctggatggaagacaagacacctgtcaccacgtgggaggatgtgccgtacttaggcaaacgggaagaccaatggtgtgggtctctgattggattgacatcaagggccacctgggcacagaacatcctgactgccatacagcaggttcgcagtctcatcggtgatgaggagttccttgactatatgccatccatgaagagatttcggaaagaagaggaaagcgagggcgctatttggtga

SEQ ID NO: 15585 - RNA, 9873 nt, synthetic construct
  misc_feature 1..9873: note = derived and/or modified CDS sequence (opt3) from DENV-3__FJ461322__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaatgccagcgatagaatgggtatgggggttacgtatttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaagcttatcacacagtttgaaacctaccagctgtggacagccttggtctccctcacttgttcaaacaccatattcacgctgacagtggcctggcgaaccgctactctaatcctggcaggtgttagtcttctccctctgtgccaaagctcgtccatgcggaagaccgattggttgccaatgacagtggccgcgatgggcgtcccccctctgcccttatttattttctctctcaaagacactccaaagcgtagaagctggcctctgaatgagggggtaatggctgtgggacttgtttcaatcctggccagttccttgctcaggaacgatgtgcccatggcaggcccactggtcgccggtgggctactgattgcttgttatgtgatcaccggaacgtctgcagaccttacagtagagaaagccgcggacgtgacctgggaagaggaagctgagcagactggcgtcagccataacctcatgataacagttgatgacgatggcaccatgcgcattaaggacgatgaaactgagaatatcctgacagtgttgttaaaaaccgccctgctcatcgtgtccgggatttttccgtactcaatacctgcaacgctgcttgtctggcacacttggcagaagcagacccaacggagcggagtgctgtgggacgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaacggaaagcgactggagcctaattgggcctctgtgaaaaaggatctcatctcctatggcggcgggtggcgcctgagcgcacagtggcaaaaaggagaagaggtacaggtcattgctgtggaaccaggtaagaaccccaagaatttccagacgatgcctggcatcttccagacaactaccggggagataggagccatcgcgcttgactttaaaccgggcacatcgggttcaccaattatcaaccgggaagggaaggttgtgggattatacggcaatggcgtcgtgaccaaaaacgggggatatgtttctggtattgcccaaactaatgcagagcccgatggccctaccccagagctggaagaggaaatgttcaagaaaagaaacctcacaatcatggacttgcatcccgggagtggaaagacgaggaagtacctgcctgctatagtgcgtgaggccattaaacgccggctcagaactctgatccttgctccgaccagggtcgtggcagccgaaatggaggaggccctgaagggcttgcccatccgatatcagacaaccgctactaaatccgaacacacaggtcgggagattgtagatctaatgtgccatgcgacctttacgatgcgcctgctcagcccagtgagagttcctaattacaacttaatcataatggacgaagcacacttcactgatcccgcctctattgctgccagggggtatatcagcacacgggtcggaatgggcgaggcagccgctatttttatgaccgcgaccccacctggcactgccgaagcattcccccagtccaatgctccaatccaggacgaggagcgagacataccggaaagatcatggaacagtgggaatgagtggattacagattttgtgggaaagaccgtgtggttcgtccctagcatcaaagccggtaacgacatcgcaaactgtctgcgcaagaatggcaagaaagtaattcaactttctaggaagacatttgatactgaataccagaaaacgcgtctgaacgactgggatttcgtggttaccacagacatctccgagatgggggccaattttaaggctgatcgggtgattgaccccagaaggtgcctcaaaccagtcatattgactgatggacccgagcgcgtgatcctggccggccctatgccagttaccgcggcatcagccgctcagcgaagaggtcgggtggggaggaacccccagaaggaaaatgaccaatacattttcacaggccagcctctcaacaatgatgaggaccatgcccactggaccgaagctaagatgctgcttgacaacatcaatactccggagggaatcattccagcactattcgaacccgagcgcgagaaaagtgccgctatagatggcgaatatcgtctgaagggggagagcagaaaaacgtttgtcgaattgatgcggaggggagacttacctgtgtggctggcccacaaggtagcatccgagggtatcaaatacaccgatcgcaagtggtgcttcgacggcgaacgaaacaatcagattctcgaggagaacatggatgtggaaatctggacaaaagagggggaaagaaagaagctgcggcccaggtggcttgacgcgcgcacttattctgatccactggccctcaaagagtttaaggacttcgctgccggaagaaaatcgattgcattggatctggttaccgaaatcggcagggtccctagccatctagcttaccggacacgtaatgccctggacaacctcgtgatgcttcacacctcagagcatggtgggcgcgcatatcgacacgccgtggaggaactgcccgagactatggaaacattattgctgctcggcctgatgatacttctgacgggaggcgctatgctctttttgatctccgggaagggaattggtaaaaccagtatcggcctgatttgtgtcatcgtttctagcgggatgttatggatggcggaggtgccactacagtggatagcctccgcaattgtactggagttctttatgatggtgctccttatccctgaaccggagaagcaaagaactccccaggataatcagctggcttacgtcgtgattggaatcttgacactggccgccatagttgcagctaacgaaatgggcctcctggagaccaccaagagggaccttggtatgtcaaaagaaccaggggtggtctctcctacaagctatctcgatgtagacctgcaccccgccagtgcgtggactttgtacgctgtggccacgaccgttatcacaccaatgctgcggcatactattgagaattccaccgcaaacgtgagcttagccgctatcgcaaaccaagccgtcgtgctaatgggcctggacaagggatggcctatttctaaaatggatctcggcgtcccccttctggcgttggggtgctactcacaggtgaatccgctgacactcaccgctgccgttctgcttttagtgactcactatgcaatcataggaccaggcctgcaggccaaggctacgcgcgaggcccagaaaagaacagcagctggtattatgaagaaccctaccgtagacgggatcatgactatcgatctcgaccccgtgatttacgattccaagttcgaaaaacaattgggacaggtcatgctgctagttctgtgtgccgtgcagctccttctgatgaggaccagttgggcgttgtgcgaggccctgacactcgcaactggcccaatcaccacactgtgggaaggtagccccggcaagttttggaatacgaccatagctgtctcgatggccaacattttccgggggtcttatttagcaggagctggccttgccttttccatcatgaaaagcgtggggactggacgaagaggcacaggttcacagggggagaccctgggagaaaagtggaaaaagaagctcaatcaactaagtcgcaaagagttcgacctgtacaagaaatctggcattactgaggtagataggacagaagccaaggagggtttgaaacggggcgaaaccacgcatcacgcggtgtcccgtgggagcgctaagctgcagtggtttgttgagagaaacatggtgatccctgaaggaagggtcatagacctcggctgtgggcgcggaggctggtcatattactgcgcaggtcttaaaaaggtgaccgaggtccgggggtatacaaagggaggcccgggccatgaggaacccgtgccaatgagtacttacgggtggaatatcgttaaactgatgagcggaaaggatgtattctacttgcctcccgagaaatgtgacaccctgctctgcgatattggtgaatcctctcctagcccaacagtggaggagtcccgaactatcagagtcttaaagatggtggaaccctggctgaaaaacaatcagttctgtattaaggttcttaacccttatatgccaaccgtgatcgagcacctggaaaggctacagcgcaagtacggcgggatgctcgtccggaatcccctgtcaagaaactctacacacgagatgtattggattagtaatggaaccggcaacatcgtgtcgagcgtaaatatggtgtcccgtttgctgctcaacaggtttactatgacgcatcggcgcccgacaatagaaaaagacgttgatcttggtgccgggacccgacacgtcaacgctgagcctgagactccaaatatggacgtgattggagaaagaatcaagaggatcaaagaggaacattcttcaacctggcactacgacgatgagaacccctataagacatgggcctaccacggcagctatgaagtgaaagcaacgggctccgccagttctatgattaatggggtcgttaagctgttaaccaagccttgggacgtggtaccaatggtgactcaaatggctatgacagataccactcccttcggacagcagcgggtctttaaagagaaggtggacacacgcaccccgagacctatgcccggtacaaggaaagttatggagataactgcggaatggctgtggcgaaccttgggccggaacaagaaaccacgtctctgcacgagagaggaattcaccaagaaggtgcgcacaaatgccgcaatgggggctgtctttactgaggaaaaccaatgggatagcgccagggcagccgtggaggacgaggaattctggaaactggtagatcgggagagagaactacataagcttggaaaatgtggctcatgcgtttacaatatgatgggtaagcgcgagaaaaagctgggggagtttggaaaagctaagggctccagggccatctggtacatgtggctcggcgcgcgatatctggaattcgaggcattggggtttctgaacgaagaccactggttcagtcgggagaatagctactctggagtggaaggtgagggcctccataagcttgggtatattctgagagatatctccaaaattcctggaggcgccatgtacgctgacgataccgccggttgggacacaaggatcactgaggacgatttacacaacgaagagaagataacccagcagatggaccccgaacatcgccagctggcaaatgctatctttaaattgacgtatcaaaacaaggtcgtgaaagtgcagcgtccaacacccaaggggaccgtcatggatattatctcacggaaggaccagagaggaagcggccaggttggcacttacgggctcaatacattcaccaacatggaggcccaactggtgaggcagatggaaggagagggtgtactatcgaaagctgatcttgagaatcctcacctgctcgaaaagaaaattactcagtggctggagaccaagggcgtggaacgcttgaaacgaatggccatctctggggacgattgcgtcgtgaagccaatagacgatcggtttgcaaacgcgttactggccctcaacgacatgggaaaggttagaaaagatattccgcagtggcaacccagtaagggctggcacgactggcagcaggtgcctttctgttcccatcacttccatgagcttatcatgaaagatggtaggaagctggtcgtgccatgccgcccccaggacgaactaatcgggagagctcggattagccaaggagccggctggtcactgaaagagacagcatgtctcggcaaggcttatgcccagatgtggtccttgatgtactttcacaggcgtgacctgcgacttgcatctaatgccatatgcagcgcggtacctgttcactggatcccaacgagtcgcaccacttggtccattcatgctcaccatcagtggatgacaaccgaggatatgctgactgtgtggaacagagtctggatcgaagacaatccctggatggaggataagacacctgtgaccacgtgggaagacattccgtacctcgggaaacgggaggatcaatggtgtggaagcttaatcggtctgacatctagggccacctgggcacagaacatattgactgccatccagcaggttcgctcactgattggcgacgaggaattcctcgattatatgccaagtatgaagagatttcggaaagaggaagagtccgaaggggctatctggtga

SEQ ID NO: 15586 - RNA, 9873 nt, synthetic construct
  misc_feature 1..9873: note = derived and/or modified CDS sequence (opt3) from DENV-3__KF955458__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgaatacccagtcatgtgatcatcgcctgatgagtgcagccatcaaagacgaaagagctgttcacgccgatatgggatactggatagagagccagaagaacggctcctggaaactagagaaggcatcttttatcgaagtgaagacgtgcacatggcctaaatcgcacaccctgtggagcaatggtgtactcgagtccgacatgattatcccaaagtcactggcgggcccgattagtcagcataaccacaggcccgggtaccatactcaaaccgccggaccttggcaccttggcaaattggaactggatttcaattattgcgaggggacaactgtcgtgatcaccgagaactgtggaacacgtggcccatctttacggacgaccactgtgagcggtaagctcatacacgaatggtgctgtcgatcctgcacactgccccctcttagatacatgggggaggacggatgttggtatggcatggaaattaggccaatcaatgagaaagaagagaacatggtcaagtcactggttagcgctggttctggcaaggtggataattttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaacgccagcgatagaatgggtatgggggttacgtacttggcactgatcgccacttttaagattcagcccttcttagctctcggatttttcctgaggaaacttacctctcgcgagaatctgctactcggcgtgggcctggcgatggccacaaccttgcaactgccggaagacatcgagcagatggcaaacgggattgctttaggactcatgactctgaagcttatcacacagtttgaaacctatcagctgtggacagccttggtctccctcacttgttcaaataccatattcacgctgacagtggcctggcgaaccgctactctaatcctggcaggtgttagtcttctccctctgtgccaaagctcgtccatgcggaagaccgattggttgccaatgacagtggccgcgatgggcgtcccccctctgcccttatttattttctctctcaaagacactccaaagcgtagaagctggcctctgaacgagggggtaatggctgtgggacttgtttcaatcctggccagttccttgctcaggaacgatgtgcccatggcaggcccactggtcgccggtgggctactgattgcttgttacgtgatcaccggaacgtctgcagaccttacagtagagaaagccgcggacgtgacctgggaagaggaagctgagcagactggcgtcagccataatctcatgataacagttgatgacgatggcaccatgcgcattaaggacgatgaaactgagaacatcctgacagtgttgttaaaaaccgccctgctcatcgtgtccgggatttttccgtattcaatacctgcaacgctgcttgtctggcacacttggcagaagcagacccaacggagcggagtgctgtgggacgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaatggaaagcgactggagcctaactgggcctctgtgaaaaaggatctcatctcctacggcggcgggtggcgcctgagcgcacagtggcaaaaaggagaagaggtacaggtcattgctgtggaaccaggtaagaatcccaagaacttccagacgatgcctggcatcttccagacaactaccggggagataggagccatcgcgcttgactttaaaccgggcacatcgggttcaccaattatcaatcgggaagggaaggttgtgggattatatggcaacggcgtcgtgaccaaaaatgggggatacgtttctggtattgcccaaactaacgcagagcccgatggccctaccccagagctggaagaggaaatgttcaagaaaagaaatctcacaatcatggacttgcatcccgggagtggaaagacgaggaagtatctgcctgctatagtgcgtgaggccattaaacgccggctcagaactctgatccttgctccgaccagggtcgtggcagccgaaatggaggaggccctgaagggcttgcccatccgataccagacaaccgctactaaatccgaacacacaggtcgggagattgtagatctaatgtgccatgcgacctttacgatgcgcctgctcagcccagtgagagttcctaactataatttaatcataatggacgaagcacacttcactgatcccgcctctattgctgccagggggtacatcagcacacgggtcggaatgggcgaggcagccgctatttttatgaccgcgaccccacctggcactgccgaagcattcccccagtccaacgctccaatccaggacgaggagcgagacataccggaaagatcatggaatagtgggaacgagtggattacagattttgtgggaaagaccgtgtggttcgtccctagcatcaaagccggtaacgacatcgcaaattgtctgcgcaagaacggcaagaaagtaattcaactttctaggaagacatttgatactgaatatcagaaaacgcgtctgaatgactgggatttcgtggttaccacagacatctccgagatgggggccaactttaaggctgatcgggtgattgaccccagaaggtgcctcaaaccagtcatattgactgatggacccgagcgcgtgatcctggccggccctatgccagttaccgcggcatcagccgctcagcgaagaggtcgggtggggaggaatccccagaaggaaaacgaccaatacattttcacaggccagcctctcaataacgatgaggaccatgcccactggaccgaagctaagatgctgcttgacaatatcaacactccggagggaatcattccagcactattcgaacccgagcgcgagaaaagtgccgctatagatggcgaataccgtctgaagggggagagcagaaaaacgtttgtcgaattgatgcggaggggagacttacctgtgtggctggcccacaaggtagcatccgagggtatcaaatataccgatcgcaagtggtgcttcgacggcgaacgaaataaccagattctcgaggagaatatggatgtggaaatctggacaaaagagggggaaagaaagaagctgcggcccaggtggcttgacgcgcgcacttactctgatccactggccctcaaagagtttaaggacttcgctgccggaagaaaatcgattgcattggatctggttaccgaaatcggcagggtccctagccatctagcttatcggacacgtaacgccctggacaatctcatgatgcttcacacctcagagcatggtgggcgcgcataccgacacgccgtggaggaactgcccgagactatggaaacattattgctgctcggcctgatgatacttctgacgggaggcgctatgctctttttgatctccgggaagggaattggtaaaaccagtatcggcctgatttgtgtgatcgtctctagcgggatgttatggatggcggatgttccactacagtggatagcctccgcaattgtgctggagttctttatgatggtactccttatccctgagccggaaaagcaaagaactccccaggacaaccagctggcttatgtggtcattggaatcttgacactggccgccatagtggcagctaatgagatgggcctcctggaaaccaccaagagggatcttggtatgtcaaaagagccaggggttgtgtctcctacaagctacctcgacgtcgacctgcaccccgccagtgcgtggactttgtatgctgtagccacgaccgtgatcacaccaatgctgcggcatactattgaaaactccaccgcaaacgttagcttagccgctatcgcaaatcaagccgtggtcctaatgggcctggataagggatggcctatttctaaaatggacctcggcgtgccccttctggcgttggggtgctactcacaggtcaacccgctgacactcaccgctgccgtgctgcttttagttactcactacgcaatcataggaccaggcctgcaggccaaggctacgcgcgaggcccagaaaagaacagcagctggtattatgaagaatcctaccgtggatgggatcatgactatcgacctcgatcccgtaatttatgactccaagttcgagaaacaattgggacaggtgatgctgctagtcctgtgtgccgttcagctccttctgatgaggaccagttgggcgttgtgcgaagccctgacactcgcaactggcccaatcaccacactgtgggagggtagccccggcaagttttggaacacgaccatagctgtgtcgatggccaatattttccgggggtcttacttagcaggagctggccttgccttttccatcatgaaaagcgtcgggactggacgaagaggcacaggttcacagggggaaaccctgggagagaagtggaaaaagaagctcaaccaactaagtcgcaaagaattcgatctgtataagaaatctggcattactgaggtggacaggacagaggccaaggaaggtttgaaacggggcgagaccacgcatcacgcggtatcccgtgggagcgctaagctgcagtggtttgtggaaagaaatatggttatccctgagggaagggtgatagatctcggctgtgggcgcggaggctggtcatactattgcgcaggtcttaaaaaggtcaccgaagtgcgggggtacacaaagggaggcccgggccatgaggagcccgtcccaatgagtacttatgggtggaacctggtgaaattgatgagcggaaaggacgttttctacctgcctcccgaaaaatgtgataccctcttatgcgacatcggtgagtcctctcctagcccaacagtagaagagtcccgaactattagagtgctgaagatggtcgagccctggcttaaaaataaccagttctgtatcaaggtgctgaatccttacatgccaaccgttattgaacacctagagaggctccagcgcaagtatggcgggatgctggtgcggaaccccttgtcaagaaattctacacacgaaatgtactggatcagtaacggaaccggcaatattgtctcgagcgtgaacatggtatcccgtctgctccttaacaggtttactatgacgcatcggcgcccgacaatcgagaaagatgtggacctgggtgccgggacccgacacgttaatgctgaacctgagactccaaacatggacgtcataggagagagaattaagaggatcaaagaagagcattcttcaacctggcactatgatgacgaaaatccctacaagacatgggcctatcacggcagctacgaggtgaaagcaacgggctccgccagttctatgatcaacggggtggtcaagttactgaccaagccttgggatgttgtgccaatggtaactcaaatggctatgacagacaccactcccttcggacagcagcgggtgtttaaagaaaaggtcgatacacgcaccccgagacctatgcccggtacaaggaaagtgatggagattactgcggagtggttgtggcgaaccctcggccggaataagaaaccacgtctgtgcacgagagaagagttcaccaagaaggttcgcacaaacgccgcaatgggggctgtgtttactgaagagaatcaatgggacagcgccagggcagccgtcgaagatgaggagttctggaaactagtggaccgggaaagagagcttcataagctgggaaaatgtggctcatgcgtatataacatgatgggtaagcgcgaaaaaaagctcggggagtttggaaaagctaagggctccagggccatatggtacatgtggctgggcgcgcgatacttggagttcgaagcactggggtttctcaatgaggatcactggttcagtcgggaaaacagctattctggagttgagggtgaaggccttcataagctggggtacatcttaagagacatttccaaaatccctggaggcgccatgtatgctgatgacaccgccggttgggacacaaggattactgaggatgacctgcacaatgaggaaaagatcacccagcagatggatcccgagcatcgccagttggcaaacgctatatttaaactcacgtaccaaaataaggtggtcaaagtgcagcgtccaacacccaaggggaccgtgatggacatcatttcacggaaggatcagagaggaagcggccaggtcggcacttatgggctgaacacattcaccaatatggaagcccaactagttaggcagatggagggagaaggtgtgctttcgaaagctgacctggagaaccctcacctcctggagaagaaaatcactcagtggttggaaaccaagggcgtagagcgcttaaaacgaatggccatttctggggatgactgcgtggtcaagccaatcgatgaccggtttgcaaacgcgctgctcgcccttaatgatatgggaaaggtgagaaaagacataccgcagtggcaacccagtaagggctggcacgattggcagcaggttcctttctgttcccatcacttccatgaactgattatgaaagacggtaggaagctagtggtcccatgccgcccccaggacgagctgatcgggagagctcggatcagccaaggagccggctggtcactcaaagaaacagcatgtttgggcaaggcttacgcccagatgtggtccctgatgtattttcacaggcgtgatcttcgactggcatctaacgccatttgcagcgcggtgcctgtacactggataccaacgagtcgcaccacttggtccatccatgctcaccatcagtggatgacaaccgaggacatgctcactgtttggaatagagtgtggattgaggataacccctggatggaagacaagacacctgtcaccacgtgggaggatgtgccgtacttagggaaacgggaagaccaatggtgtggaagcctgatcggtttgacatctagggccacctgggcacagaatattctgactgccatccagcaggttcgctcactcataggcgatgaggagttccttgactacatgccaagtatgaagagatttcggaaagaagaggaatccgagggggctatctggtga

SEQ ID NO: 15587 - RNA, 9873 nt, synthetic construct
  misc_feature 1..9873: note = derived and/or modified CDS sequence (opt3) from DENV-3__FJ562102__SS-prME
  source 1..9873: mol_type = other RNA
acaagcctgtgcctcatgatgatgcttcccgcaacactggctttccacttgacttccagggacggagaacctaggatgatcgtggggaagaacgaacggggaaaatctttactgtttaagacggcatcaggtattaatatgtgtaccctaattgcaatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtcgccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgccaagaagcaagaggtcgtggtcctcggctcccaggaaggagctatgcacaccgccctgactggcgctacagagatccaaaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcaccaagaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacctttattatgataggcagtaatgccagcgatagaatgggtatgggggttacgtatcttgcattgatcgccactttcaagattcagccctttctggctttaggattctttctcaggaaactgacctctcgcgagaaccttctgctaggcgtgggcctcgcgatggccacaaccctgcaattgccggaagacatcgagcagatggcaaatgggattgctctgggattaatgactctcaagctgatcacacagttcgaaacctaccagctttggacagccctggtctccttgacttgttcaaacaccatatttacgctcacagtggcctggcgaaccgctactctgatcctagccggtgttagtctgcttcctctctgccaaagctcgtccatgcggaagaccgattggctgccaatgacagtggccgcgatgggcgtaccccctttgcccctgttcatattttctttaaaagacactccaaagcgtagaagctggcctctcaatgagggggtaatggctgtgggactggtttcaatccttgccagttccctgttgaggaacgatgtgcccatggcaggcccactcgtcgccggtgggctgctaattgcttgttatgtgatcaccggaacgtctgcagacctgacagtagagaaagccgcggacgtgacctgggaagaggaagctgagcagactggcgtcagccataaccttatgataacagttgatgacgatggcaccatgcgcattaaggacgatgaaactgagaatatcctcacagtgctgttgaaaaccgccttactgatcgtgtccgggattttcccgtactcaatacctgcaacgctcctggtctggcacacttggcagaagcagacccaacggagcggagtgctttgggacgttcccagtccacccgagacacagaaagccgaactggaggaaggtgtatacagaatcaagcagcagggcatttttgggaagacccaagtgggagtcggcgtgcagaaagagggtgttttccatacaatgtggcacgtgactagaggggctgtcttgacccacaacggaaagcgactagagcctaattgggcctctgtgaaaaaggatctgatctcctatggcggcgggtggcgcctcagcgcacagtggcaaaaaggagaagaggtacaggtcattgctgtggaaccaggtaagaaccccaagaatttccagacgatgcctggcatctttcagacaactaccggggagataggagccatcgcgctggacttcaaaccgggcacatcgggttcaccaattatcaaccgggaagggaaggttgtgggactttacggcaatggcgtcgtgaccaaaaacgggggatatgtttctggtattgcccaaactaatgcagagcccgatggccctaccccagagttagaagaggaaatgtttaagaaaagaaacctgacaatcatggacctccatcccgggagtggaaagacgaggaagtacttgcctgctatagtgcgtgaggccattaaacgccggctgagaactctcatcctggctccgaccagggtcgtggcagccgaaatggaggaggcccttaagggcctgcccatccgatatcagacaaccgctactaaatccgaacacacaggtcgggagattgtagatttgatgtgccatgcgaccttcacgatgcgcctactgagcccagtgagagttcctaattacaacctcatcataatggacgaagcacactttactgatcccgcctctattgctgccagggggtatatcagcacacgggtcggaatgggcgaggcagccgctattttcatgaccgcgaccccacctggcactgccgaagcatttccccagtccaatgctccaatccaggacgaggagcgagacataccggaaagatcatggaacagtgggaatgagtggattacagatttcgtgggaaagaccgtgtggtttgtccctagcatcaaagccggtaacgacatcgcaaactgtttacgcaagaatggcaagaaagtaattcaactgtctaggaagacattcgatactgaataccagaaaacgcgtcttaacgactgggattttgtggttaccacagacatctccgagatgggggccaatttcaaggctgatcgggtgattgaccccagaaggtgcctgaaaccagtcatactcactgatggacccgagcgcgtgatcttggccggccctatgccagttaccgcggcatcagccgctcagcgaagaggtcgggtggggaggaacccccagaaggaaaatgaccaatacattttcacaggccagcctctgaacaatgatgaggaccatgcccactggaccgaagctaagatgctcctggacaacatcaatactccggagggaatcattccagcactttttgaacccgagcgcgagaaaagtgccgctatagatggcgaatatcgtctaaagggggagagcagaaaaacgttcgtcgaactgatgcggaggggagacttgcctgtgtggttagcccacaaggtagcatccgagggtatcaaatacaccgatcgcaagtggtgctttgacggcgaacgaaacaatcagattctggaggagaacatggatgtggaaatctggacaaaagagggggaaagaaagaagctccggcccaggtggctggacgcgcgcacttattctgatccacttgccctgaaagagttcaaggactttgctgccggaagaaaatcgattgcactcgatttggttaccgaaatcggcagggtccctagccatctggcttaccggacacgtaatgccctagacaacctggtgatgctccacacctcagagcatggtgggcgcgcatatcgacacgccgtggaggaacttcccgagactatggaaacactgttattgctgggcctcatgatactgcttacgggaggcgctatgctgttcctcatctccgggaagggaattggtaaaaccagtatcggcttgatttgtgtcatcgtttctagcgggatgctgtggatggcggatgtgccattacagtggatagcctccgcaattatcctagagtttttcatgatggtactgctcattcctgagccggaaaagcaaagaactccccaggacaatcagcttgcttacgtggtcatcggaatactgacattggccgccatcgtggcagctaacgagatgggcctgctcgaaaccaccaagagggatctgggtatgtcaaaagagccaggggttgtgtctcctacaagctatcttgacgtcgacctccaccccgccagtgcgtggactctgtacgctgtagccacgaccgtgattacaccaatgttgcggcatactatcgaaaattccaccgcaaacgttagcctggccgctattgcaaaccaagccgtggtcttaatgggcctagataagggatggcctatctctaaaatggacctgggcgtgcccctccttgcgctggggtgctactcacaggtcaatccgttgacactgaccgctgccgtgctcctgcttgttactcactatgcaataattggaccaggcttacaggccaaggctacgcgcgaggcccagaaaagaacagcagctggtatcatgaagaaccctaccgtggatgggatcatgactattgacctggatcccgtaatctacgactccaagtttgagaaacaactcggacaggtgatgttgctggtcctatgtgccgttcagctgctccttatgaggaccagttgggcgctgtgcgaagccttgacactggcaactggcccaataaccacactctgggagggtagccccggcaagttctggaatacgaccattgctgtgtcgatggccaacatctttcgggggtcttatctggcaggagctggcttagccttctccattatgaaaagcgtcgggactggacgaagaggcacaggttcacagggggaaacccttggagagaagtggaaaaagaagctgaatcaactcagtcgcaaagaatttgatctatacaagaaatctggcatcactgaggtggacaggacagaggccaaggaaggtctgaaacggggcgagaccacgcatcacgcggtatcccgtgggagcgctaagttgcagtggttcgtggaaagaaacatggttatacctgagggaagggtgatcgatctgggctgtgggcgcggaggctggtcatattactgcgcaggtctcaaaaaggtcaccgaagtgcgggggtatacaaagggaggcccgggccatgaggagcccgtcccaatgagtacttacgggtggaatcttgtgaaactgatgagcggaaaggacgttttctacttgcctcccgaaaaatgtgataccctgctctgcgacattggtgagtcctctcctagcccaacagtagaagagtcccgaactatcagagtgttaaagatggtcgagccctggctgaaaaacaatcagttttgtattaaggtgcttaacccttatatgccaaccgttatcgaacacctggagaggctacagcgcaagtacggcgggatgctcgtgcggaatcccctgtcaagaaactctacacacgaaatgtattggattagtaatggaaccggcaacatcgtctcgagcgtgaatatggtatcccgtttgctgctcaacaggttcactatgacgcatcggcgcccgacaatagagaaagatgtggaccttggtgccgggacccgacacgttaacgctgaacctgagactccaaatatggacgtcattggagagagaatcaagaggatcaaagaggaacactcttcaacctggcactacgatgacgaaaacccctataagacatgggcctaccacggcagctatgaggtgaaagcaacgggctccgccagttctatgattaatggggtggtcaagctgttaaccaagccttgggatgttgtgccaatggtaactcaaatggctatgacagacaccactccctttggacagcagcgggtgttcaaagaaaaggtcgatacacgcaccccgagacctatgcccggtacaaggaaagtgatggagataactgcggagtggctgtggcgaaccttgggccggaacaagaaaccacgtctctgcacgagagaagagtttaccaagaaggttcgcacaaatgccgcaatgggggctgtgttcactgaagagaaccaatgggacagcgccagggcagccgtcgaagatgaggagttttggaaactggtggaccgggaaagagagctacataaacttggaaaatgtggctcatgcgtatacaatatgatgggtaagcgcgagaaaaagctgggggagttcggaaaagctaagggctccagggccatctggtacatgtggctcggcgcgcgatatctggagtttgaagcattggggttcctgaacgaggatcactggtttagtcgggaaaatagctactctggagttgagggtgaaggcctccataaacttgggtatattctgagagacatctccaaaattcctggaggcgccatgtacgctgatgacaccgccggttgggacacaaggatcactgaggatgacttacacaacgaggaaaagataacccagcagatggatcccgagcatcgccagctggcaaatgctatcttcaaattgacgtatcaaaacaaggtggtcaaagtgcagcgtccaacacccaaggggaccgtgatggacattatctcacggaaggatcagagaggaagcggccaggtcggcacttacgggctcaatacatttaccaacatggaagcccaactggttaggcagatggagggagaaggtgtgctatcgaaagctgaccttgagaatcctcatctgctcgagaagaaaattactcagtggctggaaaccaagggcgtagagcgcttgaaacgaatggccatctctggggatgactgcgtggtcaagccaatagatgaccggttcgcaaacgcgttactggccctcaacgatatgggaaaggtgagaaaagacattccgcagtggcaacccagtaagggctggcacgattggcagcaggttcctttctgttcccatcactttcatgaacttatcatgaaagacggtaggaagctggtggtcccatgccgcccccaggacgagctaatcgggagagctcggattagccaaggagccggctggtcactgaaagaaacagcatgtctcggcaaggcttatgcccagatgtggtccttgatgtacttccacaggcgtgatctgcgacttgcatctaatgccatatgcagcgcggtgcctgtacactggatcccaacgagtcgcaccacttggtccattcatgctcaccatcagtggatgacaaccgaggacatgctgactgtttggaacagagtgtggatcgaggataatccctggatggaagacaagacacctgtcaccacgtgggaggatgtgccgtacctcgggaaacgggaagaccaatggtgtggcagcttaattggtctgacatctagggccacctgggcacagaacatcttgactgccatacagcaggttcgctcactgatcggcgatgaggagtttctcgactatatgccaagtatgaagagattccggaaagaagaggaatccgagggggctatttggtga

SEQ ID NO: 15588 - RNA, 9873 nt, synthetic construct
  misc_feature 1..9873: note = derived and/or modified CDS sequence (opt3) from DENV-3__FJ410229__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaatgccagcgatagaatgggtatgggggttacgtatttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaagcttatcacacagtttgaaacctaccagctgtggacagccttggtctccctcacttgttcaaacaccatattcacgctgacagtggcctggcgaaccgctactctaatcctggcaggtgttagtcttctccctctgtgccaaagctcgtccatgcggaagaccgattggttgccaatgacagtggccgcgatgggcgtcccccctctgcccttatttattttctctctcaaagacactccaaagcgtagaagctggcctctgaatgagggggtaatggctgtgggacttgtttcaatcctggccagttccttgctcaggaacgatgtgcccatggcaggcccactggtcgccggtgggctactgattgcttgttatgtgatcaccggaacgtctgcagaccttacagtagagaaagccgcggacgtgacctgggaagaggaagctgagcagactggcgtcagccataacctcatgataacagttgatgacgatggcaccatgcgcattaaggacgatgaaactgagaatatcctgacagtgttgttaaaaaccgccctgctcatcgtgtccgggatttttccgtactcaatacctgcaacgctgcttgtctggcacacttggcagaagcagacccaacggagcggagtgctgtgggacgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaacggaaagcgactggagcctaattgggcctctgtgaaaaaggatctcatctcctatggcggcgggtggcgcctgagcgcacagtggcaaaaaggagaagaggtacaggtcattgctgtggaaccaggtaagaaccccaagaatttccagacgatgcctggcatcttccagacaactaccggggagataggagccatcgcgcttgactttaaaccgggcacatcgggttcaccaattatcaaccgggaagggaaggttgtgggattatacggcaatggcgtcgtgaccaaaaacgggggatatgtttctggtattgcccaaactaatgcagagcccgatggccctaccccagagctggaagaggaaatgttcaagaaaagaaacctcacaatcatggacttgcatcccgggagtggaaagacgaggaagtacctgcctgctatagtgcgtgaggccattaaacgccggctcagaactctgatccttgctccgaccagggtcgtggcagccgaaatggaggaggccctgaagggcttgcccatccgatatcagacaaccgctactaaatccgaacacacaggtcgggagattgtagatctaatgtgccatgcgacctttacgatgcgcctgctcagcccagtgagagttcctaattacaacttaatcataatggacgaagcacacttcactgatcccgcctctattgctgccagggggtatatcagcacacgggtcggaatgggcgaggcagccgctatttttatgaccgcgaccccacctggcactgccgaagcattcccccagtccaatgctccaatccaggacgaggagcgagacataccggaaagatcatggaacagtgggaatgagtggattacagattttgtgggaaagaccgtgtggttcgtccctagcatcaaagccggtaacgacatcgcaaactgtctgcgcaagaatggcaagaaagtaattcaactttctaggaagacatttgatactgaataccagaaaacgcgtctgaacgactgggatttcgtggttaccacagacatctccgagatgggggccaattttaaggctgatcgggtgattgaccccagaaggtgcctcaaaccagtcatattgactgatggacccgagcgcgtgatcctggccggccctatgccagttaccgcggcatcagccgctcagcgaagaggtcgggtggggaggaacccccagaaggaaaatgaccaatacattttcacaggccagcctctcaacaatgatgaggaccatgcccactggaccgaagctaagatgctgcttgacaacatcaatactccggagggaatcattccagcactattcgaacccgagcgcgagaaaagtgccgctatagatggcgaatatcgtctgaagggggagagcagaaaaacgtttgtcgaattgatgcggaggggagacttacctgtgtggctggcccacaaggtagcatccgagggtatcaaatacaccgatcgcaagtggtgcttcgacggcgaacgaaacaatcagattctcgaggagaacatggatgtggaaatctggacaaaagagggggaaagaaagaagctgcggcccaggtggcttgacgcgcgcacttattctgatccactggccctcaaagagtttaaggacttcgctgccggaagaaaatcgattgcattggatctggttaccgaaatcggcagggtccctagccatctagcttaccggacacgtaatgccctggacaacctcgtgatgcttcacacctcagagcatggtgggcgcgcatatcgacacgccgtggaggaactgcccgagactatggaaacattattgctgctcggcctgatgatacttctgacgggaggcgctatgctctttttgatctccgggaagggaattggtaaaaccagtatcggcctgatttgtgtcatcgtttctagcgggatgttatggatggcggatgtgccactacagtggatagcctccgcaattatcctggagttctttatgatggtactccttattcctgagccggaaaagcaaagaactccccaggacaatcagctggcttacgtggtcatcggaatattgacactggccgccatcgtggcagctaacgagatgggcctcctggaaaccaccaagagggatcttggtatgtcaaaagagccaggggttgtgtctcctacaagctatctcgacgtcgacctgcaccccgccagtgcgtggactttgtacgctgtagccacgaccgtgattacaccaatgctgcggcatactatcgaaaattccaccgcaaacgttagcttagccgctattgcaaaccaagccgtggtcctaatgggcctggataagggatggcctatctctaaaatggacctcggcgtgccccttctggcgttggggtgctactcacaggtcaatccgctgacactcaccgctgccgtgctgcttttagttactcactatgcaataattggaccaggcctgcaggccaaggctacgcgcgaggcccagaaaagaacagcagctggtatcatgaagaaccctaccgtggatgggatcatgactattgacctcgatcccgtaatctacgactccaagttcgagaaacaattgggacaggtgatgctgctagtcctgtgtgccgttcagctccttctgatgaggaccagttgggcgttgtgcgaagccctgacactcgcaactggcccaataaccacactgtgggagggtagccccggcaagttttggaatacgaccattgctgtgtcgatggccaacatcttccgggggtcttatttagcaggagctggccttgccttttccattatgaaaagcgtcgggactggacgaagaggcacaggttcacagggggaaaccctgggagagaagtggaaaaagaagctcaatcaactaagtcgcaaagaattcgatctgtacaagaaatctggcatcactgaggtggacaggacagaggccaaggaaggtttgaaacggggcgagaccacgcatcacgcggtatcccgtgggagcgctaagctgcagtggtttgtggaaagaaacatggttatacctgagggaagggtgatcgatctcggctgtgggcgcggaggctggtcatattactgcgcaggtcttaaaaaggtcaccgaagtgcgggggtatacaaagggaggcccgggccatgaggagcccgtcccaatgagtacttacgggtggaatctggtgaaattgatgagcggaaaggacgttttctacctgcctcccgaaaaatgtgataccctcttatgcgacattggtgagtcctctcctagcccaacagtagaagagtcccgaactatcagagtgctgaagatggtcgagccctggcttaaaaacaatcagttctgtattaaggtgctgaacccttatatgccaaccgttatcgaacacctagagaggctccagcgcaagtacggcgggatgctggtgcggaatcccttgtcaagaaactctacacacgaaatgtattggattagtaatggaaccggcaacatcgtctcgagcgtgaatatggtatcccgtctgctccttaacaggtttactatgacgcatcggcgcccgacaatagagaaagatgtggacctgggtgccgggacccgacacgttaacgctgaacctgagactccaaatatggacgtcattggagagagaatcaagaggatcaaagaagagcattcttcaacctggcactacgatgacgaaaacccctataagacatgggcctaccacggcagctatgaggtgaaagcaacgggctccgccagttctatgattaatggggtggtcaagttactgaccaagccttgggatgttgtgccaatggtaactcaaatggctatgacagacaccactcccttcggacagcagcgggtgtttaaagaaaaggtcgatacacgcaccccgagacctatgcccggtacaaggaaagtgatggagataactgcggagtggttgtggcgaaccctcggccggaacaagaaaccacgtctgtgcacgagagaagagttcaccaagaaggttcgcacaaatgccgcaatgggggctgtgtttactgaagagaaccaatgggacagcgccagggcagccgtcgaagatgaggagttctggaaactagtggaccgggaaagagagcttcataagctgggaaaatgtggctcatgcgtatacaatatgatgggtaagcgcgaaaaaaagctcggggagtttggaaaagctaagggctccagggccatctggtacatgtggctgggcgcgcgatatttggagttcgaagcactggggtttctcaacgaggatcactggttcagtcgggaaaatagctactctggagttgagggtgaaggccttcataagctggggtatattttaagagacatctccaaaattcctggaggcgccatgtacgctgatgacaccgccggttgggacacaaggatcactgaggatgacctgcacaacgaggaaaagataacccagcagatggatcccgagcatcgccagttggcaaatgctatctttaaactcacgtatcaaaacaaggtggtcaaagtgcagcgtccaacacccaaggggaccgtgatggacattatctcacggaaggatcagagaggaagcggccaggtcggcacttacgggctgaatacattcaccaacatggaagcccaactagttaggcagatggagggagaaggtgtgctttcgaaagctgacctggagaatcctcacctcctggagaagaaaattactcagtggttggaaaccaagggcgtagagcgcttaaaacgaatggccatctctggggatgactgcgtggtcaagccaatagatgaccggtttgcaaacgcgctgctcgcccttaacgatatgggaaaggtgagaaaagacattccgcagtggcaacccagtaagggctggcacgattggcagcaggttcctttctgttcccatcacttccatgaactgatcatgaaagacggtaggaagctagtggtcccatgccgcccccaggacgagctgatcgggagagctcggattagccaaggagccggctggtcactcaaagaaacagcatgtttgggcaaggcttatgcccagatgtggtccctgatgtactttcacaggcgtgatcttcgactggcatctaatgccatatgcagcgcggtgcctgtacactggatcccaacgagtcgcaccacttggtccattcatgctcaccatcagtggatgacaaccgaggacatgctcactgtttggaacagagtgtggatcgaggataatccctggatggaagacaagacacctgtcaccacgtgggaggatgtgccgtacttagggaaacgggaagaccaatggtgtggaagcctgattggtttgacatctagggccacctgggcacagaacatcctgactgccatacagcaggttcgctcactcatcggcgatgaggagttccttgactatatgccaagtatgaagagatttcggaaagaagaggaatccgagggggctatttggtga

SEQ ID NO: 15589 - RNA, 9873 nt, synthetic construct
  misc_feature 1..9873: note = derived and/or modified CDS sequence (opt3) from DENV-3__FJ461326__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacatttctacatcgttaactcagaaggttgtgatcttcatactgcttatgttggtcaccccatcaatgacaatgcgctgtgtgggcgtaggcaacagagactttgttgaagggctgagcggagccacctgggtggatgtcgtgctagagcatggtggctgcgtgacgactatggcgaggaataagcccacactcgacatcgagctgcagaaaaccgaagcaactcaacttgccacactgcggaagttgtgtattgaggggaaaatcaccaacattacgaccgatagtcgctgccctacacagggagaagctatcctcccagaggaacaggaccagaattatgtctgtaagcacacttacgttgatcgaggctggggtaacgggtgcggactgttcggcaaaggctccttagtgacctgcgccaagtttcaatgtctggagcccatagaggggaaggtagtgcagtatgaaaatctcaaatacacagtcattatcactgtgcacaccggagaccagcatcaggttggtaacgacacacaaggcgtgaccgtcgagattactcctcaggcatctacggtggaagctgtacttccagagtatgggacactgggattggaatgcagcccgagaaccggcctagatttcaatgagatgatcctgctcactatgaagaacaaagcctggatggttcacaggcagtggtttttcgacctgccccttccttggacctccggtgcgacaaccgagactccaacatggaatcggaaggaactgttggtgacgtttaaaaacgcccatgcaaagaaacaagaggtcgtggtcctcgggtcacaggaaggcgctatgcacaccgccctgactggagctacagagatccagaatagtggcgggaccagcattttcgccggacacttaaagtgtcgtctgaagatggataaactagaactcaagggtatgtcttacgcaatgtgcctgaacacatttgtgcttaaaaaggaggtttccgagactcagcatggcaccatattgatcaaagtggaatacaagggggaggacgccccctgtaagattcctttctcaacggaagatggacaaggcaaagctcacaacggtcgcctgatcaccgcgaatccagtagtcacaaagaaagaggagcccgtgaacatagaagcagagccgcctttcggggaaagcaatattgttatcggcatcggagacaaggccctcaaaattaactggtataagaagggcagttctatcgggaaaatgtttgaggctactgccagaggagcaaggcggatggccattctgggtgataccgcttgggacttcggctccgtggggggagtccttaatagcctgggcaagatggtgcatcagatatttggttcggcctacacagcattgttctctggggtatcctggatcatgaaaattggcatcggagtgctcctgacttggatcggcttaaactcaaagaataccagtatgagcttttcctgcattgttatagggatcattacgctgtatctaggagcggtcgtgcaggctgatatgggctgtgccatcaactggaaaggtaaggaactcaagtgcgggtctggaattttcgtgacaaatgaggtccacacctggactgagcagtacaaatttcaagcagacagccccaagcgactggccacagctatcgccggcgcatgggaaaacggtgtttgtggcatacgctcaaccactagaatggagaatcttttgtggaaacagatcgctaacgaactgaattatattctctgggagaacaatatcaagctgaccgtggtggtaggggatattatcggagtcttagaacagggcaaaaggacactgacgccacagcctatggagcttaagtacagttggaaaacctgggggaaggccaagatagtgactgcggagacacaaaactccagcttcattatcgacggacccaacaccccagaatgcccctctgcctcacgggcttggaatgtttgggaggtggaagactatggctttggtgtcttcacaactaacatttggttgaaactccgcgaggtgtacacccagagttgtgatcatagactgatgagcgcagccatcaaggacgaaagggctgttcacgccgatatggggtactggatagagtcccagaaaaatggatcttggaagctagagaaagcatcgtttatcgaagtgaagacgtgcacatggcctaagagccacaccctgtggtccaacggcgtactcgagtcagacatgattatcccaaaaagtctggcgggtccgatttctcagcataatcaccgtcccggctatcatactcaaaccgccgggccttggcaccttggaaagttggaactggatttcaactactgcgagggcacaactgtcgtgatcaccgagaattgtgggacacggggaccaagcttacgaacgaccactgtgtccggcaaactcatacacgaatggtgctgtagatcatgcacactgccccctcttaggtatatgggtgaggacgggtgttggtacggaatggaaattcgcccaatcaacgagaaggaagagaatatggtcaaaagcctggtttctgctggctccggtaaggtggataactttaccatgggcgtattgtgcctcgccatcctgttcgaggaagtgatgcgggggaagttcggaaaaaagcatatgattgcaggcgtcctatttactttcgtgctgctcctgagtgggcagatcacatggagagacatggctcacacccttattatgataggaagcaatgcctctgataggatgggcatgggtgttacgtatttggcactgatcgccacttttaaaattcagcccttcttagctctcgggtttttcctgcgcaagcttacctcccgagagaacctgctactcggagtgggcctggcgatggccacaaccttgcaactgccggaagacatcgagcagatggcaaatggcattgctttagggctcatgactctgaaacttatcacacagtttgaaacctaccagctgtggacagccttggtctcactcacttgtagtaacaccatattcacgctgacagtggcctggcggaccgctactctaatcctggcaggagttagccttctccctctgtgccaatcgtcctctatgcgtaagaccgattggttgccaatgacagtggccgcgatgggtgtcccccctctgcccttatttattttcagcctcaaggacactccaaaaagaaggtcatggcctctgaatgagggcgtaatggctgtggggcttgttagtatcctggcctcctctttgctccgcaacgatgtgcccatggcaggaccactggtcgccggcggtctactgattgcttgttatgtgatcaccgggacgagcgcagaccttacagtagagaaggccgcggacgtgacctgggaagaggaagctgagcagactggagtctcccataacctcatgataacagttgatgacgatggcaccatgcggattaaagacgatgaaactgagaatatcctgacagtgttgttaaagaccgccctgctcatcgtgtcaggcatttttccgtacagcatacctgcaacgctgcttgtctggcacacttggcagaaacagacccaaagaagtggggtgctgtgggacgttccctctccacccgagacacagaaggccgaattggaggaaggagtatacaggatcaaacagcagggtattttcggcaagacccaagtgggggtcggagtgcagaaggagggcgtttttcatacaatgtggcacgtgactcgaggtgctgtcctaacccacaacgggaaacgcctggagcctaattgggcctccgtgaagaaagatctcatcagctatggaggcggctggcggctgtcggcacagtggcaaaagggggaagaggtacaggtcattgctgtggaaccaggaaaaaaccccaagaatttccagacgatgcctggtatcttccagacaactaccggcgagataggggccatcgcgcttgactttaagccgggaacatcaggctctccaattatcaacagagaaggtaaagttgtggggttatacggaaatggcgtcgtgaccaagaacggcgggtatgttagtggaattgcccaaactaatgcagagcccgatggtcctaccccagagctggaagaggaaatgttcaaaaagaggaacctcacaatcatggacttgcatcccggctccgggaaaacgcgtaagtacctgcctgctatagtgcgcgaggccattaagcggagactcaggactctgatccttgctccgacccgagtcgtggcagccgaaatggaggaggccctgaaaggattgcccatccggtatcagacaaccgctactaagagcgaacacacaggccgcgagattgtagatctaatgtgccatgcgacctttacgatgagactgctctctccagtgagggttcctaattacaacttaatcataatggacgaagcacacttcactgatcccgccagcattgctgcccggggttatatctccacacgagtcgggatgggagaggcagccgctatttttatgaccgcgaccccacctggcactgccgaagcattcccccagtcaaatgctccaatccaggacgaggagagagacataccggaacgcagttggaacagcggcaatgagtggattacagattttgtggggaaaaccgtgtggttcgtcccttctatcaaggccggaaacgacatcgcaaactgtctgaggaaaaatggtaagaaggtaattcaactttcccgtaaaacatttgatactgaataccagaagacgcggctgaacgactgggatttcgtggttaccacagacatctcagagatgggcgccaattttaaagctgatagagtgattgaccccaggcgctgcctcaagccagtcatattgactgatgggcccgagcgagtgatcctggccggacctatgccagttaccgcggcaagtgccgctcagagacggggcagggtgggtcgcaacccccagaaagaaaatgaccaatacattttcacagggcagcctctcaacaatgatgaggaccatgcccactggaccgaagctaagatgctgcttgacaacatcaatactccggagggcatcattccagcactattcgaacccgagcgtgagaagagcgccgctatagatggagaatatagactgaaaggcgagtcccggaagacgtttgtcgaattgatgaggcgcggggacttacctgtgtggctggcccacaaagtagcatctgagggaatcaagtacaccgatcgaaaatggtgcttcgacggtgaaagaaacaatcagattctcgaggagaacatggatgtggaaatctggacaaaggagggcgaacggaaaaagctgaggccccgctggcttgacgcgagaacttattcggatccactggccctcaaggagtttaaagacttcgctgccgggaggaagagcattgcattggatctggttaccgaaatcggacgggtcccttcacatctagcttaccgtacacgcaatgccctggacaacctcgtgatgcttcacacctccgagcatggcggtcgagcatatagacacgccgtggaggaactgcccgagactatggaaacattattgctgctcgggctgatgatacttctgacgggcggagctatgctctttttgatcagtggcaaagggattggaaagacctctatcggtctgatttgtgtcatcgcgagctccggcatgttatggatggccgatgttccactacagtggatagcatcagctattatcctggagttctttatgatggtgctccttattcctgagccggaaaaacaaaggactccccaggacaatcagctggcctacgtagtgatcgggatattgacactggccgcaatcgtcgctgccaacgagatgggactcctggaaaccaccaagcgggatcttggcatgtctaaggagccaggtgtggttagccctacaagttatctcgacgtggacctgcaccccgcgtccgcttggactttgtacgccgtcgcaacgaccgtaattacaccaatgctgcgccatactatcgaaaatagcaccgccaacgtgtctttagctgcaattgccaaccaagcggttgtgctaatggggctggataaaggctggcctatctcaaagatggacctcggagtcccccttctggctttgggctgctactcccaggtgaatccgctgacactcaccgccgcagtcctgcttttagtgactcactatgccataattgggccaggactgcaggctaaagccacgagagaggcacagaagaggacagctgccggcatcatgaaaaaccctaccgttgatggtatcatgactattgacctcgatcccgtgatctacgacagtaagttcgagaagcaattggggcaggtaatgctgctagtgctgtgtgcggtccagctccttctgatgcggaccagctgggccttgtgcgaagcactgacactcgctactggaccaataaccacactgtgggagggctcgcccggtaaattttggaatacgaccattgccgtttctatggcaaacatcttccgaggctcctatttagctggggccggacttgcctttagcattatgaagtcagtgggcactgggagacgcggaacaggcagtcagggtgaaaccctgggggagaaatggaagaaaaagctcaatcaactatctaggaaggaattcgatctgtacaaaaagtccggaatcactgaggtcgaccggacagaggcgaaagaaggcttgaagcgtggtgagaccacgcatcacgctgtgagcagaggctcagcaaaactgcagtggtttgtagaaaggaacatggtgatacctgaggggcgcgttatcgatctcggatgtggccgggggggatggagttattactgcgccggccttaagaaagtgaccgaagtccgaggttatacaaaggggggaccgggccatgaggagcccgtgccaatgagcacttacggctggaatctggtcaagttgatgtccgggaaagacgtgttctacctgcctcccgaaaagtgtgataccctcttatgcgacattggagagtctagcccttccccaacagttgaagagtcaagaactatcagggtactgaaaatggtggagccctggcttaagaacaatcagttctgtattaaagtcctgaacccttatatgccaaccgtgatcgaacacctagagcgcctccagcggaagtacggtggcatgctggttagaaatcccttgtctcgtaacagtacacacgaaatgtattggatttcgaatgggaccggaaacatcgtgagctccgtcaatatggtgtctaggctgctccttaaccggtttactatgacgcatcgccgaccgacaatagagaaggatgtagacctgggcgctggtaccagacacgtgaacgccgaacctgagactccaaatatggacgttattggggagaggatcaaacggatcaaggaagagcattcaagcacctggcactacgatgacgaaaacccctataaaacatgggcataccacggatcctatgaggtcaaggccacgggcagtgcttctagcatgattaatggcgtggtgaaattactgaccaagccttgggatgtcgttccaatggtgactcaaatggcgatgacagacaccactcccttcgggcagcagcgcgtatttaaggaaaaagtggatacaagaaccccgaggcctatgcccggaacacgaaaggtcatggagataactgccgagtggttgtggcggaccctcggtcgtaacaaaaagccaagactgtgcacgcgcgaagagttcaccaaaaaggtgaggacaaatgcagctatgggcgccgtttttactgaagagaaccaatgggactcagcacgggccgctgtggaagatgaggagttctggaagctagtcgacagagaacgcgagcttcataaactggggaagtgtggatcctgcgtgtacaatatgatgggcaaaagggaaaagaaactcggtgagtttgggaaggccaaaggaagtcgagcgatctggtacatgtggctgggcgcacggtatttggagttcgaagccctgggctttctcaacgaggatcactggttcagcagagaaaattcttactccggggtagagggagaaggtcttcataagctgggctatattttaagggacatctcaaagattcctgggggagctatgtacgccgatgacaccgcaggctgggacacacgcatcactgaggatgacctgcacaacgaggaaaaaataacccagcagatggatcccgagcatcgtaagttggctaatgccatctttaaactcacgtatcagaacaaggttgtgaaagtccaacggccaacacccaagggtaccgtgatggacattatcagcagaaaggatcagagggggtcgggacaggtgggcacttacggcctgaatacattcaccaacatggaagctcagctagtccgccaaatggagggggaaggagttctttctaaagccgacctggagaatcctcacctcctggagaagaaaattactcagtggttggaaaccaagggtgtggagcgattaaaacggatggcaatcagtggcgatgactgcgtagtgaagccaatagatgacagatttgcgaacgccctgctcgctcttaacgatatggggaaggtcaggaaagacattccgcagtggcagccctccaagggatggcacgattggcaacaggtgcctttctgtagccatcacttccatgaactgatcatgaaagacggccgcaagctagttgtgccatgcagaccccaggacgagctgatcggtcgggccaggatttcacagggggcaggatggtccctcaaagaaacagcttgtttgggcaaggcctatgcacaaatgtggtctctgatgtactttcaccgtcgagatcttcgcctggccagcaatgcgatatgcagtgctgtccctgtgcactggatcccaacgtccagaaccacttggagcattcatgcccaccatcagtggatgacaaccgaggacatgctcactgtatggaaccgggtttggatcgaggataatccctggatggaagacaagacacctgtgaccacgtgggaggatgtcccgtacttaggcaaaagggaagaccagtggtgtgggtctctgattggattgacatcacgcgcaacctgggcccaaaacatcctgactgctatacagcaggtgagaagtctcatcggtgatgaggagttccttgactatatgccatccatgaagcggtttaggaaagaagaggaaagcgagggcgccatttggtga

SEQ ID NO: 15590 - RNA, 9873 nt, synthetic construct
  misc_feature 1..9873: note = derived and/or modified CDS sequence (opt3) from DENV-3__FJ461329__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgaggactgtggaacacgtggcccatctttacggacgaccactgtgagcggtaagctcatacacgaatggtgctgtcgatcctgcacactgccccctcttagatatatgggggaggatggatgttggtacggcatggaaattaggccaatcaatgagaaagaagagaacatggtcaagtcactggttagcgctggttctggcaaggtggacaattttaccatgggggtattgtgcctcgccatcctgttcgaggaagtgatgcgcggaaaattcggcaagaaacatatgattgcaggggtcctatttactttcgtgctgctcctgtccggacagatcacatggcgggatatggctcacacccttattatgataggcagtaacgccagcgacagaatgggtatgggggttacgtatttggcactgatcgccacttttaagattcagcccttcttagctctcggatttttcctgaggaaacttacctctcgcgagaatctgctactcggcgtgggcctggcgatggccacaaccttgcaactgccggaagatatcgagcagatggcaaacgggattgctttaggactcatgactctgaagcttatcacacagtttgaaacctaccagctgtggacagccttggtctccctcacttgttcaaataccatattcacgctgacagtggcctggcgaaccgctactctaatcctggcaggtgttagtcttctccctctgtgccaaagctcgtccatgcggaagaccgactggttgccaatgacagtggccgcgatgggcgtcccccctctgcccttatttattttctctctcaaagatactccaaagcgtagaagctggcctctgaacgagggggtaatggctgtgggacttgtttcaatcctggccagttccttgctcaggaatgacgtgcccatggcaggcccactggtcgccggtgggctactgattgcttgttatgtgatcaccggaacgtctgcagaccttacagtagagaaagccgcggatgtgacctgggaagaggaagctgagcagactggcgtcagccataacctcatgataacagttgacgatgacggcaccatgcgcattaaggatgacgaaactgagaacatcctgacagtgttgttaaaaaccgccctgctcatcgtgtccgggatttttccgtactcaatacctgcaacgctgcttgtctggcacacttggcagaagcagacccaacggagcggagtgctgtgggatgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaatggaaagcgactggagcctaactgggcctctgtgaaaaaggacctcatctcctatggcggcgggtggcgcctgagcgcacagtggcaaaaaggagaagaggtacaggtcattgctgtggaaccaggtaagaatcccaagaacttccagacgatgcctggcatcttccagacaactaccggggagataggagccatcgcgcttgattttaaaccgggcacatcgggttcaccaattatcaatcgggaagggaaggttgtgggattatacggcaacggcgtcgtgaccaaaaatgggggatatgtttctggtattgcccaaactaacgcagagcccgacggccctaccccagagctggaagaggaaatgttcaagaaaagaaatctcacaatcatggatttgcatcccgggagtggaaagacgaggaagtacctgcctgctatagtgcgtgaggccattaaacgccggctcagaactctgatccttgctccgaccagggtcgtggcagccgaaatggaggaggccctgaagggcttgcccatccgatatcagacaaccgctactaaatccgaacacacaggtcgggagattgtagacctaatgtgccatgcgacctttacgatgcgcctgctcagcccagtgagagttcctaactacaatttaatcataatggatgaagcacacttcactgaccccgcctctattgctgccagggggtatatcagcacacgggtcggaatgggcgaggcagccgctatttttatgaccgcgaccccacctggcactgccgaagcattcccccagtccaacgctccaatccaggacgaggagcgagatataccggaaagatcatggaatagtgggaacgagtggattacagactttgtgggaaagaccgtgtggttcgtccctagcatcaaagccggtaatgatatcgcaaactgtctgcgcaagaacggcaagaaagtaattcaactttctaggaagacatttgacactgaataccagaaaacgcgtctgaatgattgggacttcgtggttaccacagatatctccgagatgggggccaactttaaggctgaccgggtgattgatcccagaaggtgcctcaaaccagtcatattgactgacggacccgagcgcgtgatcctggccggccctatgccagttaccgcggcatcagccgctcagcgaagaggtcgggtggggaggaatccccagaaggaaaacgatcaatacattttcacaggccagcctctcaataacgacgaggaccatgcccactggaccgaagctaagatgctgcttgataatatcaacactccggagggaatcattccagcactattcgaacccgagcgcgagaaaagtgccgctatagacggcgaatatcgtctgaagggggagagcagaaaaacgtttgtcgaattgatgcggaggggagatttacctgtgtggctggcccacaaggtagcatccgagggtatcaaatacaccgaccgcaagtggtgcttcgatggcgaacgaaataaccagattctcgaggagaatatggacgtggaaatctggacaaaagagggggaaagaaagaagctgcggcccaggtggcttgatgcgcgcacttattctgacccactggccctcaaagagtttaaggatttcgctgccggaagaaaatcgattgcattggacctggttaccgaaatcggcagggtccctagccatctagcttaccggacacgtaacgccctggataatctcgtgatgcttcacacctcagagcatggtgggcgcgcatatcgacacgccgtggaggaactgcccgagactatggaaacattattgctgctcggcctgatgatacttctgacgggaggcgctatgctctttttgatctccgggaagggaattggtaaaaccagtatcggcctgatttgtgtcatcgtttctagcgggatgttatggatggcggacataccactacagtggattgcctccgcaatcgtgctggagttctttatgatggtactccttattcctgagccggaaaagcaaagaactccccaggataaccagctggcttacgtggtcatcggaatattgacactggccgccatcgtggcagctaatgagatgggcctcctggaaaccaccaagagggaccttggtatgtcaaaagagccaggggttgtgtctcctacaagctatctcgacgtcgatctgcaccccgccagtgcgtggactttgtacgctgtagccacgaccgtgattacaccaatgctgcggcatactatcgaaaactccaccgcaaatgttagcttagccgctattgcaaaccaagccgtggtcctaatgggcctggacaagggatggcctatctctaaaatggatctcggcgtgccccttctggcgttggggtgctactcacaggtcaacccgctgacactcaccgctgccgtgctgcttttagttactcactatgcaataattggaccaggcctgcaggccaaggctacgcgcgaggcccagaaaagaacagcagctggtatcatgaagaatcctaccgtggacgggatcatgactattgatctcgaccccgtaatctacgattccaagttcgagaaacaattgggacaggtgatgctgctagtcctgtgtgccgttcagctccttctgatgaggaccagttgggcgttgtgcgaagccctgacactcgcaactggcccaataaccacactgtgggagggtagccccggcaagttttggaacacgaccattgctgtgtcgatggccaatatcttccgggggtcttatttagcaggagctggccttgccttttccattatgaaaagcgtcgggactggacgaagaggcacaggttcacagggggaaaccctgggagagaagtggaaaaagaagctcaaccaactaagtcgcaaagaattcgacctgtacaagaaatctggcatcactgaggtggataggacagaggccaaggaaggtttgaaacggggcgagaccacgcatcacgcggtatcccgtgggagcgctaagctgcagtggtttgtggaaagaaatatggttatacctgagggaagggtgatcgacctcggctgtgggcgcggaggctggtcatattactgcgcaggtcttaaaaaggtcaccgaagtgcgggggtatacaaagggaggcccgggccatgaggagcccgtcccaatgagtacttacgggtggaacctggtgaaattgatgagcggaaaggatgttttctacctgcctcccgaaaaatgtgacaccctcttatgcgatattggtgagtcctctcctagcccaacagtagaagagtcccgaactatcagagtgctgaagatggtcgagccctggcttaaaaataaccagttctgtattaaggtgctgaatccttatatgccaaccgttatcgaacacctagagaggctccagcgcaagtacggcgggatgctggtgcggaaccccttgtcaagaaattctacacacgaaatgtattggattagtaacggaaccggcaatatcgtctcgagcgtgaacatggtatcccgtctgctccttaataggtttactatgacgcatcggcgcccgacaatagagaaagacgtggacctgggtgccgggacccgacacgttaacgctgaacctgagactccaaacatggatgtcattggagagagaatcaagaggatcaaagaagagcattcttcaacctggcactacgacgatgaaaatccctataagacatgggcctaccacggcagctatgaggtgaaagcaacgggctccgccagttctatgattaacggggtggtcaagttactgaccaagccttgggacgttgtgccaatggtaactcaaatggctatgacagataccactcccttcggacagcagcgggtgtttaaagaaaaggtcgacacacgcaccccgagacctatgcccggtacaaggaaagtgatggagataactgcggagtggttgtggcgaaccctcggccggaataagaaaccacgtctgtgcacgagagaagagttcaccaagaaggttcgcacaaacgccgcaatgggggctgtgtttactgaagagaatcaatgggatagcgccagggcagccgtcgaagacgaggagttctggaaactagtggatcgggaaagagagcttcataagctgggaaaatgtggctcatgcgtatacaacatgatgggtaagcgcgaaaaaaagctcggggagtttggaaaagctaagggctccagggccatctggtacatgtggctgggcgcgcgatatttggagttcgaagcactggggtttctcaatgaggaccactggttcagtcgggaaaacagctactctggagttgagggtgaaggccttcataagctggggtatattttaagagatatctccaaaattcctggaggcgccatgtacgctgacgacaccgccggttgggatacaaggatcactgaggacgatctgcacaatgaggaaaagataacccagcagatggaccccgagcatcgccagttggcaaacgctatctttaaactcacgtatcaaaataaggtggtcaaagtgcagcgtccaacacccaaggggaccgtgatggatattatctcacggaaggaccagagaggaagcggccaggtcggcacttacgggctgaacacattcaccaatatggaagcccaactagttaggcagatggagggagaaggtgtgctttcgaaagctgatctggagaaccctcacctcctggagaagaaaattactcagtggttggaaaccaagggcgtagagcgcttaaaacgaatggccatctctggggacgattgcgtggtcaagccaatagacgatcggtttgcaaatgcgctgctcgcccttaacgacatgggaaaggtgagaaaagatattccgcagtggcaacccagtaagggctggcacgactggcagcaggttcctttctgttcccatcacttccatgaactgatcatgaaagacggtaggaagctagtggtcccatgccgcccccaggatgagctgatcgggagagctcggattagccaaggagccggctggtcactcaaagaaacagcatgtttgggcaaggcttatgcccagatgtggtccctgatgtactttcacaggcgtgaccttcgactggcatctaacgccatatgcagcgcggtgcctgtacactggatcccaacgagtcgcaccacttggtccattcatgctcaccatcagtggatgacaaccgaggatatgctcactgtttggaatagagtgtggatcgaggacaacccctggatggaagataagacacctgtcaccacgtgggaggacgtgccgtacttagggaaacgggaagatcaatggtgtggaagcctgattggtttgacatctagggccacctgggcacagaatatcctgactgccatacagcaggttcgctcactcatcggcaacgaggagttccttgactatatgccaagtatgaagagatttcggaaagaagaggaatccgagggggctatttggtga

SEQ ID NO: 15591 - RNA, 9873 nt, synthetic construct
  misc_feature 1..9873: note = derived and/or modified CDS sequence (opt3) from DENV-3__KF955459__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcgctacccgcatggagaatcttttgtggaagcagatcgccaacgaactgaattatattctctgggagaacaatatcaaactgactgtggtggtaggagatattatcggcgtcttagaacaggggaagagaaccctgacaccacagcctatggagcttaaatactcatggaagacgtggggaaaggcgaaaatagtgaccgccgagactcaaaacagttccttcattatcgacggccccaacacaccagaatgccccagcgcttctagggcatggaatgtttgggaggtggaagactatggttttggggtcttcaccacaaacatttggttgaagctccgggaggtgtacactcagtcatgtgatcatcgcctgatgagtgccgctatcaaagacgaaagagccgttcacgcagatatgggatactggatagagagccagaagaatggctcctggaaactagagaaggcgtcttttatcgaagtgaagacctgcacgtggcctaaatcgcacacactgtggagcaacggtgtactcgagtccgacatgattatcccaaagtcactggccggcccgattagtcagcataatcacaggcccgggtatcatacccaaactgctggaccttggcaccttggcaaattggaactggatttcaactactgcgaggggaccacagtcgtgatcactgagaattgtggaacccgtggcccatctttacggacaacgaccgtgagcggtaagctcatacacgaatggtgctgtcgatcctgcactctgccccctcttagatatatgggggaggacggatgttggtacggcatggaaattaggccaatcaacgagaaagaagagaatatggtcaagtcactggttagcgccggttctggcaaggtggataactttacaatgggggtattgtgcctcgcaatcctgttcgaggaagtgatgcgcggaaaattcggcaagaaacatatgattgctggggtcctatttaccttcgtgctgctcctgtccggacagatcacttggcgggacatggcccacacacttattatgataggcagtaatgcaagcgatagaatgggtatgggggttacctatttggccctgatcgctacgtttaagattcagcccttcttagcgctcggatttttcctgaggaaacttacttctcgcgagaacctgctactcggcgtgggcctggccatggcaaccacattgcaactgccggaagacatcgagcagatggctaatgggattgccttaggactcatgaccctgaagcttatcactcagtttgaaacataccagctgtggaccgccttggtctccctcacatgttcaaacactatattcaccctgacggtggcttggcgaacagcaaccctaatcctggccggtgttagtcttctccctctgtgccaaagctcgtccatgcggaagactgattggttgccaatgaccgtggcggctatgggcgtcccccctctgcccttatttattttctctctcaaagacacaccaaagcgtagaagctggcctctgaatgagggggtaatggccgtgggacttgtttcaatcctggcaagttccttgctcaggaacgatgtgcccatggccggcccactggtcgctggtgggctactgattgcatgttatgtgatcactggaacctctgccgaccttacggtagagaaagcggctgacgtgacatgggaagaggaagccgagcagaccggcgtcagccataacctcatgataactgttgatgacgatggcacaatgcgcattaaggacgatgaaaccgagaatatcctgactgtgttgttaaaaacagcactgctcatcgtgtccgggatttttccgtactcaatacctgccaccctgcttgtctggcacacgtggcagaagcagactcaacggagcggagtgctgtgggacgttcccagtccacccgagacccagaaagctgaattggaggaaggtgtatacagaatcaagcagcagggcattttcgggaagacacaagtgggagtcggcgtgcagaaagagggtgtttttcataccatgtggcacgtgacaaggggggccgtcctaactcacaacggaaagcgactggagcctaattgggcatctgtgaaaaaggatctcatctcctatggcggcgggtggcgcctgagcgctcagtggcaaaaaggagaagaggtacaggtcattgccgtggaaccaggtaagaaccccaagaatttccagaccatgcctggcatcttccagacgacaactggggagataggagcgatcgcccttgactttaaaccgggcacctcgggttcaccaattatcaaccgggaagggaaggttgtgggattatacggcaatggcgtcgtgacaaaaaacgggggatatgtttctggtattgcacaaaccaatgctgagcccgatggccctactccagagctggaagaggaaatgttcaagaaaagaaacctcaccatcatggacttgcatcccgggagtggaaagacaaggaagtacctgcctgccatagtgcgtgaggctattaaacgccggctcagaacgctgatccttgcaccgactagggtcgtggccgccgaaatggaggaggctctgaagggcttgcccatccgatatcagaccacagcgaccaaatccgaacacactggtcgggagattgtagatctaatgtgccatgcaacatttaccatgcgcctgctcagcccagtgagagttcctaattacaacttaatcataatggacgaagcccacttcacggatcccgcttctattgccgcaagggggtatatcagcactcgggtcggaatgggcgaggccgctgcgatttttatgacagccaccccacctggcaccgcagaagctttcccccagtccaatgccccaatccaggacgaggagcgagacataccggaaagatcatggaacagtgggaatgagtggattactgattttgtgggaaagacagtgtggttcgtccctagcatcaaagcaggtaacgacatcgccaactgtctgcgcaagaatggcaagaaagtaattcaactttctaggaagacctttgatacagaataccagaaaactcgtctgaacgactgggatttcgtggttacgaccgacatctccgagatgggggctaattttaaggccgatcgggtgattgaccccagaaggtgcctcaaaccagtcatattgacagatggacccgagcgcgtgatcctggcgggccctatgccagttactgcagcctcagctgcccagcgaagaggtcgggtggggaggaacccccagaaggaaaatgaccaatacattttcaccggccagcctctcaacaatgatgaggaccatgctcactggacagaagcaaagatgctgcttgacaacatcaataccccggagggaatcattccagccctattcgaacccgagcgcgagaaaagtgctgccatagatggcgaatatcgtctgaagggggagagcagaaaaacttttgtcgaattgatgcggaggggagacttacctgtgtggctggcacacaaggtagcgtccgagggtatcaaatacacggatcgcaagtggtgcttcgacggcgaacgaaacaatcagattctcgaggagaacatggatgtggaaatctggaccaaagagggggaaagaaagaagctgcggcccaggtggcttgacgcccgcacatattctgatccactggctctcaaagagtttaaggacttcgccgcaggaagaaaatcgattgctttggatctggttactgaaatcggcagggtccctagccatctagcctaccggacccgtaatgcactggacaacctcgtgatgcttcacacatcagagcatggtgggcgcgcctatcgacacgctgtggaggaactgcccgagaccatggaaactttattgctgctcggcctgatgatacttctgacaggaggcgcgatgctctttttgatctccgggaagggaattggtaaaacgagtatcggcctgatttgtgtcatcgtttctagcgggatgttatggatggccgatgtgccactacagtggatagcatccgctattatcctggagttctttatgatggtactccttattcctgagccggaaaagcaaagaaccccccaggacaatcagctggcctacgtggtcatcggaatattgactctggccgcaatcgtggctgccaacgagatgggcctcctggaaacaaccaagagggatcttggtatgtcaaaagagccaggggttgtgtctcctaccagctatctcgacgtcgacctgcaccccgcgagtgcttggacattgtacgccgtagcaactacggtgattaccccaatgctgcggcatacaatcgaaaattccactgccaacgttagcttagctgcaattgccaaccaagcggtggtcctaatgggcctggataagggatggcctatctctaaaatggacctcggcgtgccccttctggctttggggtgctactcacaggtcaatccgctgaccctcacagccgcagtgctgcttttagttacccactatgccataattggaccaggcctgcaggctaaggccactcgcgaggcacagaaaagaacggctgccggtatcatgaagaaccctacagtggatgggatcatgaccattgacctcgatcccgtaatctacgactccaagttcgagaaacaattgggacaggtgatgctgctagtcctgtgtgcggttcagctccttctgatgaggactagttgggccttgtgcgaagcactgaccctcgctacaggcccaataactaccctgtgggagggtagccccggcaagttttggaatacaacgattgccgtgtcgatggcaaacatcttccgggggtcttatttagctggagccggccttgccttttccattatgaaaagcgtcgggaccggacgaagaggcactggttcacagggggaaacactgggagagaagtggaaaaagaagctcaatcaactaagtcgcaaagaattcgatctgtacaagaaatctggcatcaccgaggtggacaggactgaggcgaaggaaggtttgaaacggggcgagacaacccatcacgctgtatcccgtgggagcgcaaagctgcagtggtttgtggaaagaaacatggttatacctgagggaagggtgatcgatctcggctgtgggcgcggaggctggtcatattactgcgccggtcttaaaaaggtcacggaagtgcgggggtataccaagggaggcccgggccatgaggagcccgtcccaatgagtacatacgggtggaatctggtgaaattgatgagcggaaaggacgttttctacctgcctcccgaaaaatgtgatactctcttatgcgacattggtgagtcctctcctagcccaaccgtagaagagtcccgaacaatcagagtgctgaagatggtcgagccctggcttaaaaacaatcagttctgtattaaggtgctgaacccttatatgccaactgttatcgaacacctagagaggctccagcgcaagtacggcgggatgctggtgcggaatcccttgtcaagaaactctacccacgaaatgtattggattagtaatggaacaggcaacatcgtctcgagcgtgaatatggtatcccgtctgctccttaacaggtttaccatgactcatcggcgcccgacgatagagaaagatgtggacctgggtgctgggacacgacacgttaacgccgaacctgagaccccaaatatggacgtcattggagagagaatcaagaggatcaaagaagagcattcttcaacttggcactacgatgacgaaaacccctataagacctgggcataccacggcagctatgaggtgaaagccacaggctccgctagttctatgattaatggggtggtcaagttactgacgaagccttgggatgttgtgccaatggtaacccaaatggcgatgactgacacaacccccttcggacagcagcgggtgtttaaagaaaaggtcgatactcgcacaccgagacctatgcccggtaccaggaaagtgatggagataacagccgagtggttgtggcgaactctcggccggaacaagaaaccacgtctgtgcaccagagaagagttcacgaagaaggttcgcaccaatgcagctatgggggccgtgtttacagaagagaaccaatgggacagcgcaagggccgctgtcgaagatgaggagttctggaaactagtggaccgggaaagagagcttcataagctgggaaaatgtggctcatgcgtatacaatatgatgggtaagcgcgaaaaaaagctcggggagtttggaaaagccaagggctccagggcgatctggtacatgtggctgggcgcacgatatttggagttcgaagccctggggtttctcaacgaggatcactggttcagtcgggaaaatagctactctggagttgagggtgaaggccttcataagctggggtatattttaagagacatctccaaaattcctggaggcgctatgtacgccgatgacactgcaggttgggacaccaggatcacagaggatgacctgcacaacgaggaaaagataactcagcagatggatcccgagcatcgccagttggctaatgccatctttaaactcacctatcaaaacaaggtggtcaaagtgcagcgtccaacgcccaaggggacagtgatggacattatctcacggaaggatcagagaggaagcggccaggtcggcacctacgggctgaatactttcacaaacatggaagctcaactagttaggcagatggagggagaaggtgtgctttcgaaagccgacctggagaatcctcacctcctggagaagaaaattacccagtggttggaaactaagggcgtagagcgcttaaaacgaatggcaatctctggggatgactgcgtggtcaagccaatagatgaccggtttgcgaacgccctgctcgctcttaacgatatgggaaaggtgagaaaagacattccgcagtggcaacccagtaagggctggcacgattggcagcaggttcctttctgttcccatcacttccatgaactgatcatgaaagacggtaggaagctagtggtcccatgccgcccccaggacgagctgatcgggagagcccggattagccaaggagcaggctggtcactcaaagaaaccgcttgtttgggcaaggcctatgcacagatgtggtccctgatgtactttcacaggcgtgatcttcgactggcctctaatgcgatatgcagcgctgtgcctgtacactggatcccaacaagtcgcacgacctggtccattcatgcccaccatcagtggatgactacagaggacatgctcaccgtttggaacagagtgtggatcgaggataatccctggatggaagacaagactcctgtcacaacctgggaggatgtgccgtacttagggaaacgggaagaccaatggtgtggaagcctgattggtttgacgtctagggcaacatgggcccagaacatcctgaccgctatacagcaggttcgctcactcatcggcgatgaggagttccttgactatatgccaagtatgaagagatttcggaaagaagaggaatccgagggggccatttggtga

SEQ ID NO: 15592 - RNA, 9873 nt, synthetic construct
  misc_feature 1..9873: note = derived and/or modified CDS sequence (opt3) from DENV-3__FJ547066__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaaatggagccggaagacattgattgctggtgtaaccttaccagtacatgggttacctatgggacttgcaatcaggctggagagcatcgccgagacaagcgtagcgtggccctggcaccccacgtaggcatgggtttggatacaagaacccaaacgtggatgtccgccgagggggcttggaggcaggtggaaaaagtcgagacttgggcactccggcatcctggattcaccatcctggccctgtttctcgctcactacattggcacatctttaactcagaaggtggttatcttcatactgcttatgttggtgaccccatcgatgacaatgcgctgtgtcggcgtggggaacagagactttgtagaaggactgtcaggtgccacctgggttgatgtggtcctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtgtgtaaacacacttacgtcgatcgcggttgggggaacggatgcggcctgttcggcaaggggagtttagttacctgcgccaagtttcaatgtctggagcccatagagggaaaagtggtacagtatgaaaatctcaagtacacagtgattatcactgtccacaccggtgaccagcatcaggtgggcaacgacacacaaggggttaccgtggagattactcctcaggcatccacggtcgaagctgtgcttccagagtatggaacactgggcttggaatgctctccgcgaaccggtctagatttcaatgagatgatcctgctcactatgaaaaacaaggcctggatggtacacagacagtggtttttcgacctgccccttccttggaccagcggggcgacaaccgagactccaacatggaataggaaagaactgttggttacgtttaagaacgcccatgcaaaaaagcaagaggtggtcgtgctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtccttaagaaagaggtgtctgagactcagcatgggaccatattgatcaaggttgaatacaagggagaggacgccccctgtaaaattcctttctccacggaagatggccaaggtaaggctcacaacgggcgtctgatcaccgcgaatccagtggtaacaaaaaaggaggagcccgtcaacatagaagcagagccgcctttcggcgaatcaaatattgtgatcggaatcggcgacaaagccctcaagattaactggtataagaaagggagcagtatcggaaagatgtttgaggctactgcccgcggtgcaagaaggatggccattctgggcgataccgcttgggacttcgggtctgttggaggcgtgcttaattccctgggtaaaatggtccatcagatatttgggagcgcctacacagcattgttctcgggcgtgtcttggatcatgaagattggaatcggcgtactcctgacttggatcgggttaaactccaaaaatacctcaatgagttttagctgcattgtgataggaatcattacgctgtatctaggcgcggttgtccaggctgatatgggttgtgccatcaactggaaggggaaggaactcaaatgcggatccggcattttcgtgacaaatgaggtgcacacctggactgagcagtacaagtttcaagcagactctcccaaacggctggccacagctatcgccggtgcatgggaaaacggcgtctgtgggatacgaagcaccactcgcatggagaatcttttgtggaagcagatcgctaacgaactgaattatattctctgggagaacaatatcaaactgaccgttgtggtgggagatattatcggcgtattagaacaggggaagagaacactgacgccacagcctatggagcttaaatactcatggaagacctggggaaaggccaaaatagtcactgcggagacacaaaacagttccttcattatcgacggccccaacaccccagaatgccccagcgcctctagggcttggaatgtgtgggaggttgaagactatggttttggggtgttcacaactaacatttggttgaagctccgggaggtctacacccagtcatgtgatcatcgcctgatgagtgcagccatcaaagacgaaagagctgtgcacgccgatatgggatactggatagagagccagaagaatggctcctggaaactagagaaggcatcttttatcgaagttaagacgtgcacatggcctaaatcgcacaccctgtggagcaacggtgtgctcgagtccgacatgattatcccaaagtcactggcgggcccgattagtcagcataatcacaggcccgggtatcatactcaaaccgccggaccttggcaccttggcaaattggaactggatttcaactactgcgaggggacaactgtagtcatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtgaagtcactggtcagcgctggttctggcaaggttgataactttaccatgggggtgttgtgcctcgccatcctgttcgaggaagtaatgcgcggaaaattcggcaagaaacatatgattgcaggggtgctatttactttcgtcctgctcctgtccggacagatcacatggcgggacatggctcacacccttattatgataggcagtaatgccagcgatagaatgggtatgggggtgacgtatttggcactgatcgccacttttaagattcagcccttcttagctctcggatttttcctgaggaaacttacctctcgcgagaacctgctactcggcgttggcctggcgatggccacaaccttgcaactgccggaagacatcgagcagatggcaaatgggattgctttaggactcatgactctgaagcttatcacacagtttgaaacctaccagctgtggacagccttggtgtccctcacttgttcaaacaccatattcacgctgacagtcgcctggcgaaccgctactctaatcctggcaggtgtgagtcttctccctctgtgccaaagctcgtccatgcggaagaccgattggttgccaatgacagttgccgcgatgggcgtgccccctctgcccttatttattttctctctcaaagacactccaaagcgtagaagctggcctctgaatgagggggtcatggctgtaggacttgtgtcaatcctggccagttccttgctcaggaacgatgttcccatggcaggcccactggtggccggtgggctactgattgcttgttatgtcatcaccggaacgtctgcagaccttacagtggagaaagccgcggacgtaacctgggaagaggaagctgagcagactggcgtgagccataacctcatgataacagtcgatgacgatggcaccatgcgcattaaggacgatgaaactgagaatatcctgacagttttgttaaaaaccgccctgctcatcgtgtccgggatttttccgtactcaatacctgcaacgctgcttgtgtggcacacttggcagaagcagacccaacggagcggagtcctgtgggacgtgcccagtccacccgagacacagaaagccgaattggaggaaggtgtttacagaatcaagcagcagggcattttcgggaagacccaagtaggagtgggcgtccagaaagagggtgtgtttcatacaatgtggcacgttactaggggggctgtgctaacccacaacggaaagcgactggagcctaattgggcctctgtcaaaaaggatctcatctcctatggcggcgggtggcgcctgagcgcacagtggcaaaaaggagaagaggtgcaggtaattgctgtcgaaccaggtaagaaccccaagaatttccagacgatgcctggcatcttccagacaactaccggggagataggagccatcgcgcttgactttaaaccgggcacatcgggttcaccaattatcaaccgggaagggaaggtggttggattatacggcaatggcgtggtcaccaaaaacgggggatatgtgtctggtattgcccaaactaatgcagagcccgatggccctaccccagagctggaagaggaaatgttcaagaaaagaaacctcacaatcatggacttgcatcccgggagtggaaagacgaggaagtacctgcctgctatagttcgtgaggccattaaacgccggctcagaactctgatccttgctccgaccagggtggtcgcagccgaaatggaggaggccctgaagggcttgcccatccgatatcagacaaccgctactaaatccgaacacacaggtcgggagattgtggatctaatgtgccatgcgacctttacgatgcgcctgctcagcccagtaagagtgcctaattacaacttaatcataatggacgaagcacacttcactgatcccgcctctattgctgccagggggtatatcagcacacgggttggaatgggcgaggcagccgctatttttatgaccgcgaccccacctggcactgccgaagcattcccccagtccaatgctccaatccaggacgaggagcgagacataccggaaagatcatggaacagtgggaatgagtggattacagattttgtcggaaagaccgtgtggttcgtgcctagcatcaaagccggtaacgacatcgcaaactgtctgcgcaagaatggcaagaaagtcattcaactttctaggaagacatttgatactgaataccagaaaacgcgtctgaacgactgggatttcgtagtgaccacagacatctccgagatgggggccaattttaaggctgatcgggttattgaccccagaaggtgcctcaaaccagtgatattgactgatggacccgagcgcgtcatcctggccggccctatgccagtgaccgcggcatcagccgctcagcgaagaggtcgggttgggaggaacccccagaaggaaaatgaccaatacattttcacaggccagcctctcaacaatgatgaggaccatgcccactggaccgaagctaagatgctgcttgacaacatcaatactccggagggaatcattccagcactattcgaacccgagcgcgagaaaagtgccgctatagatggcgaatatcgtctgaagggggagagcagaaaaacgtttgtggaattgatgcggaggggagacttacctgtctggctggcccacaaggtggcatccgagggtatcaaatacaccgatcgcaagtggtgcttcgacggcgaacgaaacaatcagattctcgaggagaacatggatgtagaaatctggacaaaagagggggaaagaaagaagctgcggcccaggtggcttgacgcgcgcacttattctgatccactggccctcaaagagtttaaggacttcgctgccggaagaaaatcgattgcattggatctggtgaccgaaatcggcagggttcctagccatctagcttaccggacacgtaatgccctggacaacctcgtcatgcttcacacctcagagcatggtgggcgcgcatatcgacacgccgtggaggaactgcccgagactatggaaacattattgctgctcggcctgatgatacttctgacgggaggcgctatgctctttttgatctccgggaagggaattggtaaaaccagtatcggcctgatttgtgtgatcgtctctagcgggatgttatggatggcggatgttccactacagtggatagcctccgcaattatcctggagttctttatgatggtgctccttattcctgagccggaaaagcaaagaactccccaggacaatcagctggcttacgtagtgatcggaatattgacactggccgccatcgtcgcagctaacgagatgggcctcctggaaaccaccaagagggatcttggtatgtcaaaagagccaggggtggtttctcctacaagctatctcgacgtggacctgcaccccgccagtgcgtggactttgtacgctgtcgccacgaccgtaattacaccaatgctgcggcatactatcgaaaattccaccgcaaacgtgagcttagccgctattgcaaaccaagccgttgtgctaatgggcctggataagggatggcctatctctaaaatggacctcggcgtcccccttctggcgttggggtgctactcacaggtgaatccgctgacactcaccgctgccgtcctgcttttagtgactcactatgcaataattggaccaggcctgcaggccaaggctacgcgcgaggcccagaaaagaacagcagctggtatcatgaagaaccctaccgttgatgggatcatgactattgacctcgatcccgtgatctacgactccaagttcgagaaacaattgggacaggtaatgctgctagtgctgtgtgccgtccagctccttctgatgaggaccagttgggcgttgtgcgaagccctgacactcgcaactggcccaataaccacactgtgggagggtagccccggcaagttttggaatacgaccattgctgtttcgatggccaacatcttccgggggtcttatttagcaggagctggccttgccttttccattatgaaaagcgtggggactggacgaagaggcacaggttcacagggggaaaccctgggagagaagtggaaaaagaagctcaatcaactaagtcgcaaagaattcgatctgtacaagaaatctggcatcactgaggtcgacaggacagaggccaaggaaggtttgaaacggggcgagaccacgcatcacgcggtgtcccgtgggagcgctaagctgcagtggtttgtagaaagaaacatggtgatacctgagggaagggttatcgatctcggctgtgggcgcggaggctggtcatattactgcgcaggtcttaaaaaggtgaccgaagtccgggggtatacaaagggaggcccgggccatgaggagcccgtgccaatgagtacttacgggtggaatctggtcaaattgatgagcggaaaggacgtgttctacctgcctcccgaaaaatgtgataccctcttatgcgacattggtgagtcctctcctagcccaacagttgaagagtcccgaactatcagagtactgaagatggtggagccctggcttaaaaacaatcagttctgtattaaggtcctgaacccttatatgccaaccgtgatcgaacacctagagaggctccagcgcaagtacggcgggatgctggttcggaatcccttgtcaagaaactctacacacgaaatgtattggattagtaatggaaccggcaacatcgtgtcgagcgtcaatatggtgtcccgtctgctccttaacaggtttactatgacgcatcggcgcccgacaatagagaaagatgtagacctgggtgccgggacccgacacgtgaacgctgaacctgagactccaaatatggacgttattggagagagaatcaagaggatcaaagaagagcattcttcaacctggcactacgatgacgaaaacccctataagacatgggcctaccacggcagctatgaggtcaaagcaacgggctccgccagttctatgattaatggggtggtgaagttactgaccaagccttgggatgtcgttccaatggtgactcaaatggctatgacagacaccactcccttcggacagcagcgggtatttaaagaaaaggtggatacacgcaccccgagacctatgcccggtacaaggaaagtcatggagataactgcggagtggttgtggcgaaccctcggccggaacaagaaaccacgtctgtgcacgagagaagagttcaccaagaaggtgcgcacaaatgccgcaatgggggctgtttttactgaagagaaccaatgggacagcgccagggcagccgtggaagatgagggattctggaaactagtcgaccgggagagagaacttcataagctgggcaaatgtggttcatgcgtgtacaatatgatggggaagcgcgagaaaaagctcggagaatttggcaaagctaagggctccagggccatctggtacatgtggctgggggcgcgatatttggagttcgaggcactgggatttctcaacgaagatcactggttcagtcgggagaatagctactctggtgtagaaggcgaggggcttcataagctgggatatattttaagagacatctccaaaattcctggcggtgccatgtacgctgatgacaccgccgggtgggacacaaggatcactgaagatgacctgcacaacgaggagaagataacccagcagatggatcccgaacatcgccagttggcaaatgctatctttaaactcacgtatcaaaacaaggttgtgaaagtccagcgtccaacacccaagggaaccgtgatggacattatctcacggaaggatcagagaggcagcggccaggtggggacttacggactgaatacattcaccaacatggaggcccaactagtcaggcagatggaaggtgagggcgttctttcgaaagctgacctggaaaatcctcacctcctggagaagaaaattactcagtggttggagaccaagggggtggaacgcttaaaacgaatggccatctctggagatgactgcgtagtgaagccaatagatgaccggtttgcaaacgcgctgctcgcccttaacgatatgggcaaggtcagaaaagacattccgcagtggcaacccagtaagggttggcacgattggcagcaggtgcctttctgttcccatcacttccatgagctgatcatgaaagacgggaggaagctagttgtgccatgccgcccccaggacgaactgatcggaagagctcggattagccaaggcgccggctggtcactcaaagagacagcatgtttggggaaggcttatgcccagatgtggtccctgatgtactttcacaggcgtgatcttcgactggcatctaatgccatatgcagcgcggtccctgtgcactggatcccaacgagtcgcaccacttggtccattcatgctcaccatcagtggatgacaaccgaagacatgctcactgtatggaacagagtttggatcgaggataatccctggatggaggacaagacacctgtgaccacgtgggaagatgtcccgtacttaggaaaacgggaggaccaatggtgtggtagcctgattggcttgacatctagggccacctgggcacagaacatcctgactgccatacagcaggtgcgctcactcatcggggatgaagagttccttgactatatgccaagtatgaagagatttcggaaagaggaagagtccgaaggagctatttggtga

SEQ ID NO: 15593 - RNA, 9873 nt, synthetic construct
  misc_feature 1..9873: note = derived and/or modified CDS sequence (opt3) from DENV-3__KF955460__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcaccctgcttatgttggtcacaccatcgatgaccatgcgctgtgtgggcgtagggaacagagactttgttgaaggactgtcaggtgccacgtgggtggatgtcgtgctagagcatggcgggtgcgtgactacaatggcgaagaataaacccaccctcgacatagagctgcagaagactgaagcaacacaacttgccaccctgaggaaattgtgtatcgagggaaagattacgaacatcaccacagatagccggtgccctactcagggcgaagctattctcccagaggaacaggaccagaattatgtctgtaaacacacctacgttgatcgcggttgggggaacggatgcggcctgttcggcaaggggagtttagtgacatgcgccaagtttcaatgtctggagcccatcgagggaaaagtagtgcagtatgaaaatctcaagtacactgtcataattaccgtgcacacaggtgaccagcatcaggttggcaacgacacccaaggggtgactgtcgagatcacgcctcaggcatccacagtggaagctgtacttccagagtatggaaccctgggcttggaatgctctccgcgaactggtctagatttcaatgagatgattctgctcaccatgaaaaacaaggcctggatggttcacagacagtggtttttcgacctgccccttccttggacaagcggggcgaccactgagacaccaacgtggaataggaaagaactgttggtgacctttaagaacgcccatgcaaaaaagcaagaggtcgtggtcctcggctcccaggaaggagctatgcacactgccctgacaggcgctaccgagatccagaattcagggggaacaagtatcttcgccggtcacttaaagtgtcggctgaaaatggataagctagaactcaaaggcatgagctacgcaatgtgcctgaacacttttgtgcttaagaaagaggtttctgagacccagcatgggacgattttgataaaggtggaatacaagggagaggacgccccctgtaaaatccctttctccaccgaagatggccaaggtaaggctcacaacgggcgtctgattacagcgaatccagtagtcactaaaaaggaggagcccgtgaacatcgaagcagagccgcctttcggcgaatcaaatatagttattggaatcggcaacaaagccctcaagatcaattggtataagaaagggagcagtattggaaagatgtttgaggctaccgcccgcggtgcaagaaggatggccatcctgggcgacacagcttgggatttcgggtctgtgggaggcgtccttaactccctgggtaaaatggtgcatcagatttttgggagcgcctacactgcattgttctcgggcgtatcttggataatgaagatcggaattggcgtgctcctgacctggatcgggttaaattccaaaaacacgtcaatgagttttagctgcatcgttattggaataatcacactgtatctaggcgcggtcgtgcaggctgacatgggttgtgccattaattggaaggggaaggaactcaaatgcggatccggcatcttcgtgaccaacgaggtccacacttggacagagcagtacaagtttcaagcagattctcccaaacggctggccaccgctattgccggtgcatgggaaaatggcgtttgtgggatccgaagcactacccgcatggagaaccttttgtggaagcagatagctaatgaactgaactatatcctctgggagaataacattaaactgacagtggtggtaggagacatcattggcgtcttagaacaggggaagagaacgctgaccccacagcctatggagcttaaatactcatggaagacttggggaaaggccaaaatcgtgacagcggagacccaaaacagttccttcataattgatggccccaatacaccagaatgccccagcgcctctagggcttggaacgtttgggaggtggaagactatggttttggggtcttcactaccaatatctggttgaagctccgggaggtgtacacgcagtcatgtgaccatcgcctgatgagtgcagccattaaagatgaaagagctgttcacgccgacatgggatactggatcgagagccagaagaacggctcctggaaactagagaaggcatcttttatagaagtgaagacatgcacctggcctaaatcgcacactctgtggagcaatggtgtactcgagtccgatatgatcattccaaagtcactggcgggcccgatcagtcagcataaccacaggcccgggtatcatacccaaacagccggaccttggcaccttggcaaattggaactggacttcaattactgcgaggggactaccgtcgtgattacagagaactgtggaacgcgtggcccatctttacggaccactacagtgagcggtaagctcatccacgaatggtgctgtcgatcctgcaccctgccccctcttagatatatgggggaggatggatgttggtacggcatggaaataaggccaattaatgagaaagaagagaacatggtcaagtcactggttagcgctggttctggcaaggtggacaattttactatgggggtattgtgcctcgccatcctgttcgaggaagtgatgcgcggaaaattcggcaagaaacatatgatcgcaggggtcctatttacattcgtgctgctcctgtccggacagattacctggcgggatatggctcacacgcttatcatgattggcagtaacgccagcgacagaatgggtatgggggttacttatttggcactgatagccacctttaagatccagcccttcttagctctcggatttttcctgaggaaacttacatctcgcgagaatctgctactcggcgtgggcctggcgatggccaccactttgcaactgccggaagatattgagcagatggcaaacgggatcgctttaggactcatgacactgaagcttattacccagtttgaaacataccagctgtggactgccttggtctccctcacctgttcaaatacgatcttcacactgaccgtggcctggcgaactgctaccctaatactggcaggtgttagtcttctccctctgtgccaaagctcgtccatgcggaagacagactggttgccaatgactgtggccgcgatgggcgtcccccctctgcccttatttatcttctctctcaaagataccccaaagcgtagaagctggcctctgaacgagggggtaatggctgtgggacttgtttcaattctggccagttccttgctcaggaacgacgtgcccatggcaggcccactggtcgccggtgggctactgatcgcttgttatgtgattacgggaacatctgcagatcttaccgtagagaaagccgcggacgtgacttgggaagaggaagctgagcagacaggcgtcagccataatctcatgatcaccgttgacgatgacggcactatgcgcataaaggatgacgaaacagagaacattctgaccgtgttgttaaaaacggccctgctcatcgtgtccgggatctttccgtactcaattcctgcaactctgcttgtctggcacacctggcagaagcagacacaacggagcggagtgctgtgggatgttcccagtccacccgagacccagaaagccgaattggaggaaggtgtatacagaataaagcagcagggcatcttcgggaagacacaagtgggagtcggcgtgcagaaagagggtgtttttcatactatgtggcacgtgaccaggggggctgtcctaacgcacaatggaaagcgactggagcctaactgggcctctgtgaaaaaggacctcatttcctatggcggcgggtggcgcctgagcgcacagtggcaaaaaggagaagaggtacaggtcatcgctgtggaaccaggtaagaatcccaagaacttccagacaatgcctggcattttccagactaccacaggggagatcggagccatagcgcttgattttaaaccgggcacctcgggttcaccaatcattaatcgggaagggaaggttgtgggattatacggcaacggcgtcgtgactaaaaatgggggatatgtttctggtatcgcccaaaccaacgcagagcccgacggccctacaccagagctggaagaggaaatgttcaagaaaagaaatctcacgattatggatttgcatcccgggagtggaaagactaggaagtacctgcctgctatcgtgcgtgaggccataaaacgccggctcagaaccctgattcttgctccgacaagggtcgtggcagccgaaatggaggaggccctgaagggcttgcccatccgatatcagaccactgctacaaaatccgaacacaccggtcgggagatcgtagacctaatgtgccatgcgacgtttactatgcgcctgctcagcccagtgagagttcctaactacaatttaattatcatggatgaagcacacttcacagaccccgcctctatagctgccagggggtatattagcacccgggtcggaatgggcgaggcagccgctatctttatgaccgcgactccacctggcacagccgaagcattcccccagtccaacgctccaattcaggatgaggagaaggacatcccggaacgatcatggaatagtgggaacgagtggataaccgactttgtgggaaaaacagtgtggttcgtccctagcattaaggccggtaacgatatcgcaaattgtctgagaaagaacggcaaaaaggtaatccaactttctcgcaaaacttttgacacggaataccagaagaccaggctgaatgattgggacttcgtggttacaactgatatttccgagatgggggccaactttaaagctgaccgtgtgatcgatccccggagatgcctcaagccagtcattttgaccgacggacccgagagggtgatactggccggccctatgccagttacagcggcatcagccgctcagcgccgaggtagagtggggcggaatccccagaaggaaaacgatcaatacatcttcaccggccagcctctcaataacgacgaggatcatgcccactggactgaagctaaaatgctgcttgacaatattaacacgccggagggaatcatcccagcactattcgaacccgagagggagaagagtgccgctattgacggcgaatatcgcctgaaaggggagagccgtaagacctttgtcgaattgatgagacggggagatttacctgtgtggctggcccacaaagtagcatccgagggtataaagtacacagacaggaaatggtgcttcgatggcgaacgcaataaccagatcctcgaggagaatatggacgtggaaatttggactaaggagggggaacgaaagaaactgagaccccggtggcttgatgcgaggacctattctgacccactggccctcaaggagtttaaagatttcgctgccggacgcaagtcgatcgcattggacctggttacagaaattggcagagtccctagccatctagcttacaggacccggaacgccctggataatctcgtgatgcttcacacttcagagcatggtgggcgtgcatatcgccacgccgtggaggaactgcccgagacaatggaaacgttattgctgctcggcctgatgatccttctgaccggaggcgctatgctctttttgatatccgggaaaggaatcggtaagactagtattggcctgatctgtgtcattgtttctagcgggatgttatggatggcggacgtgccactacagtggatcgcctccgcaatagtactggagttctttatgatggtgctccttattcctgagccggaaaagcaacgaacaccccaggataaccagctggcttacgtcgtgatcggaattttgaccctggccgccatcgttgcagctaatgagatgggcctcctggaaaccacaaaaagagaccttggtatgtcaaaggagccaggggtggtctctcctactagctatctcgatgtagacctgcaccccgccagtgcgtggacgttgtacgctgtggccaccacagttataactccaatgctgaggcataccatcgaaaactccacagcaaacgtgagcttagccgctattgcaaatcaagccgtcgtgctaatgggcctggacaaaggatggcctatctctaagatggatctcggcgtcccccttctggcgttggggtgctactcacaggtgaacccgctgaccctcactgctgccgttctgcttttagtgacgcactatgcaattatcggaccaggcctgcaggccaaagctacacgggaggcccagaagcgcaccgcagctggtataatgaagaatcctactgtagacgggattatgaccatcgatctcgaccccgtgatctacgattccaaattcgagaagcaattgggacaggtcatgctgctagttctgtgtgccgtgcagctccttctgatgagaacaagttgggcgttgtgcgaagccctgactctcgcaaccggcccaattacaacgctgtgggagggtagccccggcaaattttggaacaccactatcgctgtctcgatggccaatatattcagggggtcttatttagcaggagctggccttgccttttccattatgaagagcgtggggacaggacggcgaggcaccggttcacagggggaaactctgggagagaaatggaagaagaaactcaaccaactaagtagaaaggaattcgacctgtacaaaaagtctggcatcacagaggtagatcgcaccgaggccaaagaaggtttgaagaggggcgagacgacccatcacgcggtgtcccgggggagcgctaaactgcagtggtttgttgaacgtaatatggtgattcctgagggaagagtcatcgacctcggctgtgggaggggaggctggtcatattactgcgcaggtcttaagaaggtgacagaagtccgcgggtatactaaaggaggcccgggccatgaggagcccgtgccaatgagtacctacgggtggaacatagttaagctgatgagcggaaaagatgtattctacttgcctcccgaaaagtgtgacacactgctctgcgatatcggtgagtcctctcctagcccaactgtggaagagtcccggaccattcgagtcttaaaaatggtggagccctggctgaagaataaccagttctgtatcaaggttcttaatccttatatgccaacagtgattgaacacctggagagactacagaggaaatacggcgggatgctcgtccgcaaccccctgtcacggaattctacccacgaaatgtattggatcagtaacggaactggcaatattgtgtcgagcgtaaacatggtgtccagattgctgctcaaccgttttacgatgacacataggcggccgaccatcgagaaggacgttgatcttggtgccgggactcgccacgtcaatgctgaacctgagaccccaaacatggacgtgataggagagcgaattaaaagaatcaaggaagagcattcttcaacatggcactacgacgatgaaaatccctataaaacgtgggcctaccacggcagctatgaggtgaaggcaaccggctccgccagttctatgatcaacggggtcgttaagctgttaactaaaccttgggacgtggtaccaatggtgacacaaatggctatgaccgatactacacccttcggacagcagagggtctttaaggaaaaagtggacacccggacaccgcgccctatgcccggtactagaaaggttatggagattaccgcggagtggctgtggaggacgttgggccgaaataaaaagccacggctctgcacccgtgaagagttcacaaagaaagtgagaactaacgccgcaatgggggctgtctttaccgaagagaatcaatgggatagcgcccgcgcagccgtggaagacgaggagttctggaagctggtagatagggaacgggagctacataaacttggaaagtgtggctcatgcgtttacaacatgatgggtaaaagagaaaagaaactgggggagtttggaaaggctaagggctcccgcgccatatggtacatgtggctcggcgcgaggtatctggagttcgaagcattggggtttctgaatgaggaccactggttcagtcgagaaaacagctactctggagtggagggtgaaggcctccataaacttgggtatatcctgcgggatatttccaagatccctggaggcgccatgtacgctgacgatacagccggttgggacactagaattaccgaggacgatttacacaatgaggaaaaaatcacgcagcagatggaccccgagcataggcagctggcaaacgctatatttaagttgacatatcaaaataaagtcgtgaaggtgcagcgcccaacccccaaggggactgtcatggatatcatttcacgtaaagaccagcggggaagcggccaggttggcacatacgggctcaacaccttcactaatatggaagcccaactggtgagacagatggagggagaaggtgtactatcgaaggctgatcttgagaaccctcacctgctcgagaaaaagatcacccagtggctggaaacaaaaggcgtggagaggttgaagcgcatggccatttctggggacgattgcgtcgtgaagccaatcgacgatcgatttgcaaacgcgttactggccctcaatgacatgggaaaagttcggaaggatataccgcagtggcaacccagtaaaggctggcacgactggcagcaggtgcctttctgttcccatcacttccatgaacttattatgaaggatggtagaaaactggtcgtgccatgcaggccccaggacgagctaatcgggcgcgctagaatcagccaaggagccggctggtcactgaaggaaacggcatgtctcggcaaggcttatgcccagatgtggtccttgatgtactttcaccggagggacctgcgtcttgcatctaacgccatttgcagcgcggtacctgttcactggataccaaccagtcgaactacatggtccatccatgctcaccatcagtggatgaccactgaggatatgctgacagtgtggaatcgcgtctggattgaggacaacccctggatggaagataaaacccctgtgacgacatgggaggacatcccgtacctcgggaagagagaagatcaatggtgtggaagcttaattggtctgacctctcgggccacttgggcacagaatatcttgaccgccatacagcaggttaggtcactgatcggcgacgaggagttcctcgattatatgccaagtatgaaacgctttagaaaggaagaggaatccgagggggctatttggtga

SEQ ID NO: 15594 - RNA, 9873 nt, synthetic construct
  misc_feature 1..9873: note = derived and/or modified CDS sequence (opt3) from DENV-3__FJ461334__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaatgccagcgatagaatgggtatgggggttacgtatttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaagcttatcacacagtttgaaacctaccagctgtggacagccttggtctccctcacttgttcaaacaccatattcacgctgacagtggcctggcgaaccgctactctaatcctggcaggtgttagtcttctccctctgtgccaaagctcgtccatgcggaagaccgattggttgccaatgacagtggccgcgatgggcgtcccccctctgcccttatttattttctctctcaaagacactccaaagcgtagaagctggcctctgaatgagggggtaatggctgtgggacttgtttcaatcctggccagttccttgctcaggaacgatgtgcccatggcaggcccactggtcgccggtgggctactgattgcttgttatgtgatcaccggaacgtctgcagaccttacagtagagaaagccgcggacgtgacctgggaagaggaagctgagcagactggcgtcagccataacctcatgataacagttgatgacgatggcaccatgcgcattaaggacgatgaaactgagaatatcctgacagtgttgttaaaaaccgccctgctcatcgtgtccgggatttttccgtactcaatacctgcaacgctgcttgtctggcacacttggcagaagcagacccaacggagcggagtgctgtgggacgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaacggaaagcgactggagcctaattgggcctctgtgaaaaaggatctcatctcctatggcggcgggtggcgcctgagcacgcagtggcaaaaaggagaagaggtacaggtcattgcagtggaaccaggtaagaaccccaagaatttccagacaatgcctggcatcttccagactaccacaggggagataggagctatcgcccttgactttaaaccgggcacctcgggttcaccaattatcaaccgggaagggaaggttgtgggattatacggcaatggcgtcgtgactaaaaacgggggatatgtttctggtattgcgcaaaccaatgccgagcccgatggccctacaccagagctggaagaggaaatgttcaagaaaagaaacctcacgatcatggacttgcatcccgggagtggaaagactaggaagtacctgcctgcaatagtgcgtgaggctattaaacgccggctcagaaccctgatccttgccccgacaagggtcgtggctgcagaaatggaggaggccctgaagggcttgcccatccgatatcagaccactgccacaaaatccgaacacaccggtcgggagattgtagatctaatgtgccatgctacgtttactatgcgcctgctcagcccagtgagagttcctaattacaacttaatcataatggacgaagcgcacttcacagatcccgcatctattgccgctagggggtatatcagcacccgggtcggaatgggcgaggccgcagccatttttatgaccgctactccacctggcacagcggaagccttcccccagtccaatgcaccaatccaggacgaggagcgagacataccggaaagatcatggaacagtgggaatgagtggattaccgattttgtgggaaagacagtgtggttcgtccctagcatcaaagctggtaacgacatcgccaactgtctgcgcaagaatggcaagaaagtaattcaactttctaggaagacttttgatacggaataccagaaaacccgtctgaacgactgggatttcgtggttacaactgacatctccgagatgggggcaaattttaaggccgatcgggtgattgaccccagaaggtgcctcaaaccagtcatattgaccgatggacccgagcgcgtgatcctggctggccctatgccagttacagccgcgtcagcagcccagcgaagaggtcgggtggggaggaacccccagaaggaaaatgaccaatacattttcaccggccagcctctcaacaatgatgaggaccatgctcactggactgaagccaagatgctgcttgacaacatcaatacgccggagggaatcattccagctctattcgaacccgagcgcgagaaaagtgcagccatagatggcgaatatcgtctgaagggggagagcagaaaaacctttgtcgaattgatgcggaggggagacttacctgtgtggctggctcacaaggtagcctccgagggtatcaaatacacagatcgcaagtggtgcttcgacggcgaacgaaacaatcagattctcgaggagaacatggatgtggaaatctggactaaagagggggaaagaaagaagctgcggcccaggtggcttgacgcacgcacctattctgatccactggcgctcaaagagtttaaggacttcgccgctggaagaaaatcgattgccttggatctggttacagaaatcggcagggtccctagccatctagcataccggacccgtaatgctctggacaacctcgtgatgcttcacacttcagagcatggtgggcgcgcctatcgacacgcagtggaggaactgcccgagacaatggaaacgttattgctgctcggcctgatgatacttctgaccggaggcgccatgctctttttgatctccgggaagggaattggtaaaactagtatcggcctgatttgtgtcatcgtttctagcgggatgttatggatggctgatgtgccactacagtggatagcgtccgccattatcctggagttctttatgatggtactccttattcctgagccggaaaagcaaagaacaccccaggacaatcagctggcatacgtggtcatcggaatattgaccctggctgccatcgtggccgcaaacgagatgggcctcctggaaaccacaaagagggatcttggtatgtcaaaagagccaggggttgtgtctcctactagctatctcgacgtcgacctgcaccccgctagtgcctggacgttgtacgcggtagctaccacagtgattactccaatgctgcggcataccatcgaaaattccacagccaacgttagcttagcagccattgctaaccaagcagtggtcctaatgggcctggataagggatggcctatctctaaaatggacctcggcgtgccccttctggccttggggtgctactcacaggtcaatccgctgaccctcactgcggctgtgctgcttttagttacgcactatgccataattggaccaggcctgcaggcaaaggccacacgcgaggctcagaaaagaaccgccgcaggtatcatgaagaaccctactgtggatgggatcatgaccattgacctcgatcccgtaatctacgactccaagttcgagaaacaattgggacaggtgatgctgctagtcctgtgtgctgttcagctccttctgatgaggacaagttgggccttgtgcgaagcgctgactctcgccaccggcccaataacaacgctgtgggagggtagccccggcaagttttggaataccactattgcagtgtcgatggctaacatcttccgggggtcttatttagccggagcaggccttgctttttccattatgaaaagcgtcgggacaggacgaagaggcaccggttcacagggggaaactctgggagagaagtggaaaaagaagctcaatcaactaagtcgcaaagaattcgatctgtacaagaaatctggcatcacagaggtggacaggaccgaggccaaggaaggtttgaaacggggcgagacgacccatcacgccgtatcccgtgggagcgcgaagctgcagtggtttgtggaaagaaacatggttatacctgagggaagggtgatcgatctcggctgtgggcgcggaggctggtcatattactgcgctggtcttaaaaaggtcacagaagtgcgggggtatactaagggaggcccgggccatgaggagcccgtcccaatgagtacctacgggtggaatctggtgaaattgatgagcggaaaggacgttttctacctgcctcccgaaaaatgtgatacactcttatgcgacattggtgagtcctctcctagcccaactgtagaagagtcccgaaccatcagagtgctgaagatggtcgagccctggcttaaaaacaatcagttctgtattaaggtgctgaacccttatatgccaacagttatcgaacacctagagaggctccagcgcaagtacggcgggatgctggtgcggaatcccttgtcaagaaactctacccacgaaatgtattggattagtaatggaactggcaacatcgtctcgagcgtgaatatggtatcccgtctgctccttaacaggtttacgatgacacatcggcgcccgaccatagagaaagatgtggacctgggtgcagggactcgacacgttaacgccgaacctgagaccccaaatatggacgtcattggagagagaatcaagaggatcaaagaagagcattcttcaacatggcactacgatgacgaaaacccctataagacgtgggcttaccacggcagctatgaggtgaaagccaccggctccgcaagttctatgattaatggggtggtcaagttactgactaagccttgggatgttgtgccaatggtaacacaaatggccatgaccgacactacacccttcggacagcagcgggtgtttaaagaaaaggtcgatacccgcacaccgagacctatgcccggtactaggaaagtgatggagataaccgctgagtggttgtggcgaacgctcggccggaacaagaaaccacgtctgtgcaccagagaagagttcacaaagaaggttcgcactaatgcggccatgggggcagtgtttaccgaagagaaccaatgggacagcgctagggccgcagtcgaagatgaggagttctggaaactagtggaccgggaaagagagcttcataagctgggaaaatgtggctcatgcgtatacaatatgatgggtaagcgcgaaaaaaagctcggggagtttggaaaagccaagggctccagggctatctggtacatgtggctgggcgcccgatatttggagttcgaagcgctggggtttctcaacgaggatcactggttcagtcgggaaaatagctactctggagttgagggtgaaggccttcataagctggggtatattttaagagacatctccaaaattcctggaggcgcaatgtacgccgatgacacagctggttgggacactaggatcaccgaggatgacctgcacaacgaggaaaagataacgcagcagatggatcccgagcatcgccagttggccaatgcaatctttaaactcacatatcaaaacaaggtggtcaaagtgcagcgtccaacccccaaggggactgtgatggacattatctcacggaaggatcagagaggaagcggccaggtcggcacatacgggctgaataccttcactaacatggaagctcaactagttaggcagatggagggagaaggtgtgctttcgaaagccgacctggagaatcctcacctcctggagaagaaaattacccagtggttggaaacaaagggcgtagagcgcttaaaacgaatggctatctctggggatgactgcgtggtcaagccaatagatgaccggtttgccaacgcactgctcgcgcttaacgatatgggaaaggtgagaaaagacattccgcagtggcaacccagtaagggctggcacgattggcagcaggttcctttctgttcccatcacttccatgaactgatcatgaaagacggtaggaagctagtggtcccatgccgcccccaggacgagctgatcgggagagcccggattagccaaggagctggctggtcactcaaagaaacggcctgtttgggcaaggcatatgctcagatgtggtccctgatgtactttcacaggcgtgatcttcgactggcctctaatgcaatatgcagcgccgtgcctgtacactggatcccaaccagtcgcactacatggtccattcatgcgcaccatcagtggatgaccactgaggacatgctcacagtttggaacagagtgtggatcgaggataatccctggatggaagacaagacccctgtcacgacatgggaggatgtgccgtacttagggaaacgggaagaccaatggtgtggaagcctgattggtttgacctctagggctacttgggcccagaacatcctgaccgcaatacagcaggttcgctcactcatcggcgatgaggagttccttgactatatgccaagtatgaagagatttcggaaagaagaggaatccgagggggccatttggtga

SEQ ID NO: 15595 - RNA, 9873 nt, synthetic construct
  misc_feature 1..9873: note = derived and/or modified CDS sequence (opt3) from DENV-3__FJ461337__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctatgggaggcgtgcttaattccctgggtaaaatggtccatcagatatttgggagcgcctacacagcattgttctcgggcgtgtcttggatcatgaagattggaatcggcgtactcctgacttggatcgggttaaactccaaaaatacctcaatgagttttagctgcattgtgataggaatcattacgctgtatctaggcgcggttgtccaggctgatatgggttgtgccatcaactggaaggggaaggaactcaaatgcggatccggcattttcgtgacaaatgaggtgcacacctggactgagcagtacaagtttcaagcagactctcccaaacggctggccacagctatcgccggtgcatgggaaaacggcgtctgtgggatacgaagcaccactcgcatggagaatcttttgtggaagcagatcgctaacgaactgaattatattctctgggagaacaatatcaaactgaccgttgtggtgggagatattatcggcgtattagaacaggggaagagaacactgacgccacagcctatggagcttaaatactcatggaagacctggggaaaggccaaaatagtcactgcggagacacaaaacagttccttcattatcgacggccccaacaccccagaatgccccagcgcctctagggcttggaatgtgtgggaggttgaagactatggttttggggtgttcacaactaacatttggttgaagctccgggaggtctacacccagtcatgtgatcatcgcctgatgagtgcagccatcaaagacgaaagagctgtgcacgccgatatgggatactggatagagagccagaagaatggctcctggaaactagagaaggcatcttttatcgaagttaagacgtgcacatggcctaaatcgcacaccctgtggagcaacggtgtgctcgagtccgacatgattatcccaaagtcactggcgggcccgattagtcagcataatcacaggcccgggtatcatactcaaaccgccggaccttggcaccttggcaaattggaactggatttcaactactgcgaggggacaactgtagtcatcaccgaggactgtggaacacgtggcccatctttacggacgaccactgtgagcggtaagctcatacacgaatggtgctgtcgatcctgcacactgccccctcttagatatatgggggaggatggatgttggtacggcatggaaattaggccaatcaatgagaaagaagagaacatggtgaagtcactggtcagcgctggttctggcaaggttgacaattttaccatgggggtgttgtgcctcgccatcctgttcgaggaagtaatgcgcggaaaattcggcaagaaacatatgattgcaggggtgctatttactttcgtcctgctcctgtccggacagatcacatggcgggatatggctcacacccttattatgataggcagtaacgccagcgacagaatgggtatgggggtgacgtatttggcactgatcgccacttttaagattcagcccttcttagctctcggatttttcctgaggaaacttacctctcgcgagaatctgctactcggcgttggcctggcgatggccacaaccttgcaactgccggaagatatcgagcagatggcaaacgggattgctttaggactcatgactctgaagcttatcacacagtttgaaacctaccagctgtggacagccttggtgtccctcacttgttcaaataccatattcacgctgacagtcgcctggcgaaccgctactctaatcctggcaggtgtgagtcttctccctctgtgccaaagctcgtccatgcggaagaccgactggttgccaatgacagttgccgcgatgggcgtgccccctctgcccttatttattttctctctcaaagatactccaaagcgtagaagctggcctctgaacgagggggtcatggctgtaggacttgtgtcaatcctggccagttccttgctcaggaatgacgttcccatggcaggcccactggtggccggtgggctactgattgcttgttatgtcatcaccggaacgtctgcagaccttacagtggagaaagccgcggatgtaacctgggaagaggaagctgagcagactggcgtgagccataacctcatgataacagtcgacgatgacggcaccatgcgcattaaggatgacgaaactgagaacatcctgacagttttgttaaaaaccgccctgctcatcgtgtccgggatttttccgtactcaatacctgcaacgctgcttgtgtggcacacttggcagaagcagacccaacggagcggagtcctgtgggatgtgcccagtccacccgagacacagaaagccgaattggaggaaggtgtttacagaatcaagcagcagggcattttcgggaagacccaagtaggagtgggcgtccagaaagagggtgtgtttcatacaatgtggcacgttactaggggggctgtgctaacccacaatggaaagcgactggagcctaactgggcctctgtcaaaaaggacctcatctcctatggcggcgggtggcgcctgagcgcacagtggcaaaaaggagaagaggtgcaggtaattgctgtcgaaccaggtaagaatcccaagaacttccagacgatgcctggcatcttccagacaactgccggggagataggagcgatcgcccttgattttaaaccgggcacctcgggttcaccaattatcaatcgggaagggaaggtggttggattatacggcaacggcgtggtcacaaaaaatgggggatatgtgtctggtattgcacaaaccaacgctgagcccgacggccctactccagagctggaagaggaaatgttcaagaaaagaaatctcaccatcatggatttgcatcccgggagtggaaagacaaggaagtacctgcctgccatagttcgtgaggctattaaacgccggctcagaacgctgatccttgcaccgactagggtggtcgccgccgaaatggaggaggctctgaagggcttgcccatccgatatcagaccacagcgaccaaatccgaacacactggtcgggagattgtggacctaatgtgccatgcaacatttaccatgcgcctgctcagcccagtaagagtgcctaactacaatttaatcataatggatgaagcccacttcacggaccccgcttctattgccgcaagggggtatatcagcactcgggttggaatgggcgaggccgctgcgatttttatgacagccaccccacctggcaccgcagaagctttcccccagtccaacgccccaatccaggacgaggagcgagatataccggaaagatcatggaatagtgggaacgagtggattactgactttgtcggaaagacagtgtggttcgtgcctagcatcaaagcaggtaatgatatcgccaactgtctgcgcaagaacggcaagaaagtcattcaactttctaggaagacctttgacacagaataccagaaaactcgtctgaatgattgggacttcgtagtgacgaccgatatctccgagatgggggctaactttaaggccgaccgggttattgatcccagaaggtgcctcaaaccagtgatattgacagacggacccgagcgcgtcatcctggcgggccctatgccagtgactgcagcctcagctgcccagcgaagaggtcgggttgggaggaatccccagaaggaaaacgatcaatacattttcaccggccagcctctcaataacgacgaggaccatgctcactggacagaagcaaagatgctgcttgataatatcaacaccccggagggaatcattccagccctattcgaacccgagcgcgagaaaagtgctgccatagacggcgaatatcgtctgaagggggagagcagaaaaacttttgtggaattgatgcggaggggagatttacctgtctggctggcacacaaggtggcgtccgagggtatcaaatacacggaccgcaagtggtgcttcgatggcgaacgaaataaccagattctcgaggagaatatggacgtagaaatctggaccaaagagggggaaagaaagaagctgcggcccaggtggcttgatgcccgcacatattctgacccactggctctcaaagagtttaaggatttcgccgcaggaagaaaatcgattgctttggacctggtgactgaaatcggcagggttcctagccatctagcctaccggacccgtaacgcactggataatctcgtcatgcttcacacatcagagcatggtgggcgcgcctatcgacacgctgtggaggaactgcccgagaccatggaaactttattgctgctcggcctgatgatacttctgacaggaggcgcgatgctctttttgatctccgggaagggaattggtaaaacgagtatcggcctgatttgtgtgatcgtctctagcgggatgttatggatggccgacgttccactacagtggatagcatccgctattgtgctggagttctttatgatggtactccttatccctgagccggaaaagcaaagaaccccccaggataaccagctggcctacgtggtcattggaatcttgactctggccgcaatagtggctgccaatgagatgggcctcctggaaacaaccaagagggaccttggtatgtcaaaagagccaggggttgtgtctcctaccagctatctcgacgtcgatctgcaccccgcgagtgcttggacattgtacgccgtagcaactacggtgatcaccccaatgctgcggcatacaattgaaaactccactgccaatgttagcttagctgcaatcgccaaccaagcggtggtcctaatgggcctggacaagggatggcctatttctaaaatggatctcggcgtgccccttctggctttggggtgctactcacaggtcaacccgctgaccctcacagccgcagtgctgcttttagttacccactatgccatcataggaccaggcctgcaggctaaggccactcgcgaggcacagaaaagaacggctgccggtattatgaagaatcctacagtggacgggatcatgaccatcgatctcgaccccgtaatttacgattccaagttcgagaaacaattgggacaggtgatgctgctagtcctgtgtgcggttcagctccttctgatgaggactagttgggccttgtgcgaagcactgaccctcgctacaggcccaatcactaccctgtgggagggtagccccggcaagttttggaacacaacgatagccgtgtcgatggcaaatattttccgggggtcttatttagctggagccggccttgccttttccatcatgaaaagcgtcgggaccggacgaagaggcactggttcacagggggaaacactgggagagaagtggaaaaagaagctcaaccaactaagtcgcaaagaattcgacctgtacaagaaatctggcattaccgaggtggataggactgaggcgaaggaaggtttgaaacggggcgagacaacccatcacgctgtatcccgtgggagcgcaaagctgcagtggtttgtggaaagaaatatggttatccctgagggaagggtgatagacctcggctgtgggcgcggaggctggtcatattactgcgccggtcttaaaaaggtcacggaagtgcgggggtataccaagggaggcccgggccatgaggagcccgtcccaatgagtacatacgggtggaacctggtgaaattgatgagcggaaaggatgttttctacctgcctcccgaaaaatgtgacactctcttatgcgatatcggtgagtcctctcctagcccaaccgtagaagagtcccgaacaattagagtgctgaagatggtcgagccctggcttaaaaataaccagttctgtatcaaggtgctgaatccttatatgccaactgttattgaacacctagagaggctccagcgcaagtacggcgggatgctggtgcggaaccccttgtcaagaaattctacccacgaaatgtattggatcagtaacggaacaggcaatattgtctcgagcgtgaacatggtatcccgtctgctccttaataggtttaccatgactcatcggcgcccgacgatcgagaaagacgtggacctgggtgctgggacacgacacgttaacgccgaacctgagaccccaaacatggatgtcataggagagagaattaagaggatcaaagaagagcattcttcaacttggcactacgacgatgaaaatccctataagacctgggcataccacggcagctatgaggtgaaagccacaggctccgctagttctatgatcaacggggtggtcaagttactgacgaagccttgggacgttgtgccaatggtaacccaaatggcgatgactgatacaacccccttcggacagcagcgggtgtttaaagaaaaggtcgacactcgcacaccgagacctatgcccggtaccaggaaagtgatggagattacagccgagtggttgtggcgaactctcggccggaataagaaaccacgtctgtgcaccagagaagagttcacgaagaaggttcgcaccaacgcagctatgggggccgtgtttacagaagagaatcaatgggatagcgcaagggccgctgtcgaagacgaggagttctggaaactagtggatcgggaaagagagcttcataagctgggaaaatgtggctcatgcgtatacaacatgatgggtaagcgcgaaaaaaagctcggggagtttggaaaagccaagggctccagggcgatatggtacatgtggctgggcgcacgatatttggagttcgaagccctggggtttctcaatgaggaccactggttcagtcgggaaaacagctactctggagttgagggtgaaggccttcataagctggggtatatcttaagagatatttccaaaatccctggaggcgctatgtacgccgacgacactgcaggttgggataccaggattacagaggacgatctgcacaatgaggaaaagatcactcagcagatggaccccgagcatcgccagttggctaacgccatatttaaactcacctatcaaaataaggtggtcaaagtgcagcgtccaacgcccaaggggacagtgatggatatcatttcacggaaggaccagagaggaagcggccaggtcggcacctacgggctgaacactttcacaaatatggaagctcaactagttaggcagatggagggagaaggtgtgctttcgaaagccgatctggagaaccctcacctcctggagaagaaaatcacccagtggttggaaactaagggcgtagagcgcttaaaacgaatggcaatttctggggacgattgcgtggtcaagccaatcgacgatcggtttgcgaatgccctgctcgctcttaacgacatgggaaaggtgagaaaagatataccgcagtggcaacccagtaagggctggcacgactggcagcaggttcctttctgttcccatcacttccatgaactgattatgaaagacggtaggaagctagtggtcccatgccgcccccaggatgagctgatcgggagagcccggatcagccaaggagcaggctggtcactcaaagaaaccgcttgtttgggcaaggcctatgcacagatgtggtccctgatgtactttcacaggcgtgaccttcgactggcctctaacgcgatttgcagcgctgtgcctgtacactggataccaacaagtcgcacgacctggtccatccatgcccaccatcagtggatgactacagaggatatgctcaccgtttggaatagagtgtggattgaggacaacccctggatggaagataagactcctgtcacaacctgggaggacgtgccgtacttagggaaacgggaagatcaatggtgtggaagcctgatcggtttgacgtctagggcaacatgggcccagaatattctgaccgctatccagcaggttcgctcactcataggcgacgaggagttccttgattatatgccaagtatgaagagatttcggaaagaagaggaatccgagggggccatctggtga

SEQ ID NO: 15596 - RNA, 9873 nt, synthetic construct
  misc_feature 1..9873: note = derived and/or modified CDS sequence (opt3) from DENV-3__FJ461338__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactggttgcggaagtggagccggaagacatcgattgctggtgtaaccttaccagtacatgggtaacctatgggacttgcaatcaggctggagagcatcgccgagacaagcgtagcgtggccctggcaccccacgtcggcatgggtttggatacaagaacccaaacgtggatgtccgccgagggggcttggaggcaggtggaaaaagttgagacttgggcactccggcatcctggattcaccattctggccctgtttctcgctcactacatcggcacatctttaactcagaaggtggtcattttcatcctgcttatgttggtgaccccatcgatgacaatgcgctgtgtaggcgttgggaacagagactttgtggaaggactgtcaggtgccacctgggtcgatgtggtgctagagcatggcgggtgcgtcacgactatggcgaagaataaacccacactcgacatagagctgcagaagaccgaagcaactcaacttgccacactgaggaaattgtgtatcgagggaaagattaccaacatcacgaccgatagccggtgccctacacagggcgaagctattctcccagaggaacaggaccagaattatgtttgtaaacacacttacgtggatcgcggttgggggaacggatgcggcctgttcggcaaggggagtttagtaacctgcgccaagtttcaatgtctggagcccatcgagggaaaagtggtccagtatgaaaatctcaagtacacagtgataattactgttcacaccggtgaccagcatcaggtgggcaacgacacacaaggggtcaccgtggagatcactcctcaggcatccacggtagaagctgttcttccagagtatggaacactgggcttggaatgctctccgcgaaccggtctagatttcaatgagatgattctgctcactatgaaaaacaaggcctggatggtgcacagacagtggtttttcgacctgccccttccttggaccagcggggcgacaaccgagactccaacatggaataaaaaggaactgttggtcacgtttaaaaacgcccatgcaaagaagcaagaggtggtcgtgctcggctcccaggaaggagctatgcacaccgccctgactggcgctacagagatccagaattcagggggaaccagtatcttcgccggtcacttaaaatgtaggctgaagatggataaactagaactcaagggcatgagctacgcaatgtgcctgaacacatttgttcttaaaaaggaggtgtctgagactcagcatgggaccattttgataaaggtagaatacaaaggagaggacgccccctgtaagatccctttctccacggaagatggccaaggtaaagctcacaacgggcggctgattaccgcgaatccagtcgtgacaaagaaagaggagcccgttaacatcgaagcagagccgcctttcggcgaatcaaatatagtgattggaatcggcgacaaggccctcaagatcaactggtataaaaaggggagcagtattggaaaaatgtttgaggctactgcccgtggtgcacgcagaatggccatcctgggcgataccgcttgggacttcgggtctgtcggaggcgtgcttaattccctgggtaagatggtacatcagatttttgggagcgcctacacagcattgttctcgggcgtgtcttggataatgaaaatcggaattggcgttctcctgacttggatcgggttaaactccaagaatacctcaatgagttttagctgcatcgtcattggaataatcacgctgtatctaggcgcggtggtgcaggctgatatgggttgtgccattaactggaaggggaaagaactcaagtgcggatccggcatcttcgtcacaaatgaggttcacacctggactgagcagtacaaatttcaagcagactctcccaagaggctggccacagctattgccggtgcatgggaaaacggcgtgtgtgggatccggagcaccactcgaatggagaatcttttgtggaaacagatagctaacgaactgaattatatcctctgggagaacaatattaagctgaccgtggtagtcggagatatcattggcgtgttagaacaggggaaacgcacactgacgccacagcctatggagcttaagtactcatggaagacctggggaaaagccaagatcgttactgcggagacacaaaacagttccttcataattgacggccccaacaccccagaatgccccagcgcctctagagcttggaatgtgtgggaggtcgaagactatggttttggggtgttcacaactaacatctggttgaaactcagggaggtttacacccagtcatgtgatcatcggctgatgagtgcagccattaaggacgaacgcgctgtgcacgccgatatgggatactggatcgagagccagaaaaatggctcctggaagctagagaaggcatcttttatagaagtaaaaacgtgcacatggcctaagtcgcacaccctgtggagcaacggtgtcctcgagtccgacatgatcattccaaaatcactggcgggcccgatcagtcagcataatcacagacccgggtatcatactcaaaccgccggaccttggcaccttggcaagttggaactggatttcaactactgcgaggggacaactgtggtgattaccgagaattgtggaacaaggggcccatctttacgtacgaccactgtcagcggtaaactcatccacgaatggtgctgtcggtcctgcacactgccccctcttcgatatatgggggaggacggatgttggtacggcatggaaataagaccaattaacgagaaggaagagaatatggttaagtcactggtgagcgctggttctggcaaagtagataactttaccatgggggtgttgtgcctcgccatcctgttcgaggaagtcatgaggggaaagttcggcaaaaagcatatgatcgcaggggtgctatttactttcgttctgctcctgtccggacagattacatggcgcgacatggctcacacccttatcatgattggcagtaatgccagcgatcggatgggtatgggggtgacgtatttggcactgatagccacttttaaaatccagcccttcttagctctcggatttttcctgagaaagcttacctctagggagaacctgctactcggcgtcggcctggcgatggccacaaccttgcaactgccggaagacattgagcagatggcaaatgggatcgctttaggactcatgactctgaagcttattacacagtttgaaacctaccagctgtggacagccttggtgtccctcacttgttcaaacaccatcttcacgctgacagttgcctggcgcaccgctactctaatactggcaggtgtgagtcttctccctctgtgccaaagctcgtccatgcgaaaaaccgattggttgccaatgacagtcgccgcgatgggcgtaccccctctgcccttatttatcttctctctcaaggacactccaaaacggcgtagctggcctctgaatgagggggtgatggctgttggacttgtgtcaattctggccagttccttgctcagaaacgatgtccccatggcaggcccactggtggccggtgggctactgatcgcttgttatgtaattaccggaacgtctgcagaccttacagtggagaaggccgcggacgtcacctgggaagaggaagctgagcagactggcgttagccataacctcatgatcacagtggatgacgatggcaccatgaggataaaagacgatgaaactgagaatattctgacagtgttgttaaagaccgccctgctcatcgtctccgggatctttccgtactcaattcctgcaacgctgcttgtgtggcacacttggcagaaacagacccaacgcagcggagttctgtgggacgtacccagtccacccgagacacagaaggccgaattggaggaaggtgtgtaccggataaagcagcagggcatcttcgggaaaacccaagtcggagtgggcgttcagaaggagggtgtgtttcatacaatgtggcacgtcactagaggggctgtgctaacccacaacggaaaaaggctggagcctaattgggcctctgtaaagaaagatctcatttcctatggcggcgggtggcgactgagcgcacagtggcaaaagggagaagaggtccaggtgatcgctgttgaaccaggtaagaaccccaaaaatttccagacgatgcctggcattttccagacaactaccggggagatcggagccatagcgcttgactttaagccgggcacatcgggttcaccaatcattaaccgcgaagggaaagtggtcggattatacggcaatggcgtggttaccaagaacgggggatatgtgtctggtatcgcccaaactaatgcagagcccgatggccctaccccagagctggaagaggaaatgttcaaaaagcggaacctcacaattatggacttgcatcccgggagtggaaagacgagaaaatacctgcctgctatcgtcagggaggccataaagcgtcgcctccggactctgattcttgctccgaccagagtggtagcagccgaaatggaggaggccctgaaaggcttgcccatcaggtatcagacaaccgctactaagtccgaacacacaggtcgagagatcgtggatctaatgtgccatgcgacctttacgatgcggctgctcagcccagttcgcgtccctaattacaacttaattatcatggacgaagcacacttcactgatcccgcctctatagctgccagagggtatattagcacaagggtgggaatgggcgaggcagccgctatctttatgaccgcgaccccacctggcactgccgaagcattcccccagtccaatgctccaattcaggacgaggagcgggacatcccggaacgatcatggaacagtgggaatgagtggataacagattttgtgggaaaaaccgtctggttcgtacctagcattaaggccggtaacgacatcgcaaactgtctgagaaagaatggcaaaaaggtgatccaactttctcgcaaaacatttgatactgaataccagaagacgaggctgaacgactgggatttcgttgtgaccacagacatttccgagatgggggccaattttaaagctgatcgtgtcatcgacccccggagatgcctcaagccagtgattttgactgatggacccgagagggttatactggccggccctatgccagtgaccgcggcatcagccgctcagcgccgaggtagagtcgggcggaacccccagaaggaaaatgaccaatacatcttcacaggccagcctctcaacaatgatgaggaccatgcccactggaccgaagctaaaatgctgcttgacaacattaatactccggagggaatcatcccagcactattcgaacccgagagggagaagagtgccgctattgatggcgaatatcgcctgaaaggggagagccgtaagacgtttgtggaattgatgagacggggagacttacctgtatggctggcccacaaagtggcatccgagggtataaagtacaccgataggaaatggtgcttcgacggcgaacgcaacaatcagatcctcgaggagaacatggatgttgaaatttggacaaaggagggggaacgaaagaaactgagaccccggtggcttgacgcgaggacttattctgatccactggccctcaaggagtttaaagacttcgctgccggacgcaagtcgatcgcattggatctggtcaccgaaattggcagagtgcctagccatctagcttacaggacacggaatgccctggacaacctcgtgatgcttcacacctcagagcatggtgggcgtgcatatcgccacgccgtcgaggaactgcccgagactatggaaacattattgctgctcggcctgatgatccttctgacgggaggcgctatgctctttttgatatccgggaaaggaatcggtaagaccagtattggcctgatctgtgttattgtgtctagcgggatgttatggatggcggatgtaccactacagtggatcgcctccgcaatagtgctggagttctttatgatggtcctccttattcctgagccggaaaagcaacgaactccccaggacaatcagctggcttacgtggttatcggaattttgacactggccgccatcgtggcagctaacgagatgggcctcctggaaaccaccaaaagagatcttggtatgtcaaaggagccaggggtcgtatctcctacaagctatctcgacgtggacctgcaccccgccagtgcgtggactttgtacgctgttgccacgaccgtgataacaccaatgctgaggcatactatcgaaaattccaccgcaaacgtcagcttagccgctattgcaaaccaagccgtggtcctaatgggcctggataaaggatggcctatctctaagatggacctcggcgtgccccttctggcgttggggtgctactcacaggttaatccgctgacactcaccgctgccgtgctgcttttagtaactcactatgcaattatcggaccaggcctgcaggccaaagctacgcgggaggcccagaagcgcacagcagctggtataatgaagaaccctaccgtggatgggattatgactatcgacctcgatcccgtcatctacgactccaaattcgagaagcaattgggacaggttatgctgctagtgctgtgtgccgtccagctccttctgatgagaaccagttgggcgttgtgcgaagccctgacactcgcaactggcccaattaccacactgtgggagggtagccccggcaaattttggaatacgaccatcgctgtgtcgatggccaacatattcagggggtcttatttagcaggagctggccttgccttttccattatgaagagcgtagggactggacggcgaggcacaggttcacagggggaaaccctgggagagaaatggaagaagaaactcaatcaactaagtagaaaggaattcgatctgtacaaaaagtctggcatcactgaggtggaccgcacagaggccaaagaaggtttgaagaggggcgagaccacgcatcacgcggtttcccgggggagcgctaaactgcagtggtttgtggaacgtaacatggtcattcctgagggaagagtgatcgatctcggctgtgggaggggaggctggtcatattactgcgcaggtcttaagaaggtcaccgaagtgcgcgggtatacaaaaggaggcccgggccatgaggagcccgttccaatgagtacttacgggtggaatatagtaaagctgatgagcggaaaagacgtgttctacttgcctcccgaaaagtgtgataccctgctctgcgacatcggtgagtcctctcctagcccaacagtcgaagagtcccggactattcgagtgttaaaaatggttgagccctggctgaagaacaatcagttctgtatcaaggtgcttaacccttatatgccaaccgtcattgaacacctggagagactacagaggaaatacggcgggatgctcgtgcgcaatcccctgtcacggaactctacacacgaaatgtattggatcagtaatggaaccggcaacattgtatcgagcgtgaatatggtttccagattgctgctcaaccgttttactatgacgcataggcggccgacaatcgagaaggatgtcgaccttggtgccgggacccgccacgtgaacgctgaacctgagactccaaatatggacgtgataggagagcgaattaaaagaatcaaggaagagcattcttcaacctggcactacgatgacgaaaacccctataaaacatgggcctaccacggcagctatgaggtcaaggcaacgggctccgccagttctatgatcaatggggttgtgaagctgttaaccaaaccttgggatgtagtgccaatggtcactcaaatggctatgacagacaccactcccttcggacagcagagggtgtttaaggaaaaagttgatacacggaccccgcgccctatgcccggtacaagaaaggtgatggagattactgcggagtggctgtggaggaccttgggccgaaacaaaaagccacggctctgcacgcgtgaagagttcaccaagaaagtcagaacaaatgccgcaatgggggctgtgtttactgaagagaaccaatgggacagcgcccgcgcagccgtagaagatgaggagttctggaagctggttgacagggaacgggagctacataaacttggaaagtgtggctcatgcgtgtacaatatgatgggtaaaagagaaaagaaactgggggagtttggaaaggctaagggctcccgcgccatatggtacatgtggctcggcgcgaggtatctggagttcgaagcattggggtttctgaacgaggatcactggttcagtcgagaaaatagctactctggagtcgagggtgaaggcctccataaacttgggtatatcctgcgggacatttccaagatccctggaggcgccatgtacgctgatgacaccgccggttgggacacaagaattactgaggatgacttacacaacgaggaaaaaatcacccagcagatggatcccgagcataggcagctggcaaatgctatatttaagttgacgtatcaaaacaaagtggtgaaggtccagcgcccaacacccaaggggaccgttatggacatcatttcacgtaaagatcagcggggaagcggccaggtgggcacttacgggctcaatacattcaccaacatggaagcccaactggtaagacagatggagggagaaggtgtgctatcgaaggctgaccttgagaatcctcacctgctcgagaaaaagatcactcagtggctggaaaccaaaggcgtcgagaggttgaagcgcatggccatttctggggatgactgcgtggttaagccaatcgatgaccgatttgcaaacgcgttactggccctcaacgatatgggaaaagtgcggaaggacataccgcagtggcaacccagtaaaggctggcacgattggcagcaggtccctttctgttcccatcacttccatgaacttattatgaaggacggtagaaaactggtggtaccatgcaggccccaggacgagctaatcgggcgcgctagaatcagccaaggagccggctggtcactgaaggaaacagcatgtctcggcaaggcttatgcccagatgtggtccttgatgtactttcaccggagggatctgcgtcttgcatctaatgccatttgcagcgcggttcctgtgcactggataccaacgagtcgaaccacttggtccatccatgctcaccatcagtggatgacaaccgaggacatgctgactgtctggaaccgcgtgtggattgaggataatccctggatggaagacaaaacacctgttaccacgtgggaggatgtgccgtacctcgggaagagagaagaccaatggtgtggaagcttaatcggtctgacatctcgggccacctgggcacagaacattttgactgccatccagcaggtcaggtcactgataggcgatgaggagttcctcgactatatgccaagtatgaaacgctttagaaaggaagaggaatccgagggggctatctggtga

SEQ ID NO: 15597 - RNA, 9873 nt, synthetic construct
  misc_feature 1..9873: note = derived and/or modified CDS sequence (opt3) from DENV-3__FJ562103__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttaccgctgtccactgatcgcggaagttgagccggaagacattgattgctggtgtaaccttaccagtacatgggtgacctatgggacttgcaatcaggctggagagcatcgacgtgacaaaagaagcgtagccctggcaccccacgtgggcatgggtttggatacaaggacccaaacgtggatgtccgccgagggggcttggcggcaggtcgaaaaggtggagacttgggcactccgccatcctggattcaccatcctggccctgtttctcgctcactacattggcacatctttaactcagaaagttgtgatcttcaccctgcttatgttggtcacaccatcgatgaccatgagatgtgtgggcgtagggaacagggactttgttgaaggactgtcaggtgccacgtgggtggatgtcgtgctagagcatggcgggtgcgtgactacaatggcgaagaataagcccaccctcgacatagagctgcagaaaactgaagcaacacaacttgccaccctgcggaagttgtgtatcgagggaaaaattacgaacatcaccacagatagccgctgccctactcagggcgaagctattctcccagaggaacaggaccagaattatgtctgtaagcacacctacgttgatcgaggttgggggaacggatgcggcctgttcggcaaagggagtttagtgacatgcgccaagtttcaatgtctggagcccatcgagggaaaggtagtgcagtatgaaaatctcaaatacactgtcataattaccgtgcacacaggtgaccagcatcaggttggcaacgacacccaaggggtgactgtcgagatcacgcctcaggcatccacagtggaagctgtacttccagagtatggaaccctgggcttggaatgctctccgagaactggtctagatttcaatgagatgattctgctcaccatgaagaacaaagcctggatggttcacaggcagtggtttttcgacctgccccttccttggacaagcggggcgaccactgagacaccaacgtggaatcggaaggaactgttggtgacctttaaaaacgcccatgcaaagaaacaagaggtcgtggtcctcggctcccaggaaggagctatgcacactgccctgacaggcgctaccgagatccagaattcagggggaacaagtatcttcgccggtcacttaaagtgtcgtctgaagatggataaactagaactcaagggcatgagctacgcaatgtgcctgaacacttttgtgcttaaaaaggaggtttctgagacccagcatgggacgattttgataaaagtggaatacaagggagaggacgccccctgtaagatccctttctccaccgaagatggccaaggtaaagctcacaacgggcgcctgattacagcgaatccagtagtcactaagaaagaggagcccgtgaacatcgaagcagagccgcctttcggcgaatcaaatatagttattggaatcggcaacaaggccctcaaaatcaattggtataagaaggggagcagtattggaaaaatgtttgaggctaccgccagaggtgcaaggcggatggccatcctgggcgacacagcttgggatttcgggtctgtgggaggcgtccttaactccctgggtaagatggtgcatcagatttttgggagcgcctacactgcattgttctcgggcgtatcttggataatgaaaatcggaattggcgtgctcctgacctggatcgggttaaattccaagaacacgtcaatgagttttagctgcatcgttattggaataatcacactgtatctaggcgcggtcgtgcaggctgacatgggttgtgccattaattggaaagggaaggaactcaagtgcggatccggcatcttcgtgaccaacgaggtccacacttggacagagcagtacaaatttcaagcagattctcccaagcgactggccaccgctattgccggtgcatgggaaaatggcgtttgtgggatccgcagcactaccagaatggagaaccttttgtggaaacagatagctaatgaactgaactatatcctctgggagaataacattaagctgacagtggtggtaggagacatcattggcgtcttagaacaggggaaaaggacgctgaccccacagcctatggagcttaagtactcatggaaaacttggggaaaggccaagatcgtgacagcggagacccaaaacagttccttcataattgatggccccaatacaccagaatgccccagcgcctctcgggcttggaacgtttgggaggtggaagactatggttttggggtcttcactaccaatatctggttgaaactccgcgaggtgtacacgcagtcatgtgaccatagactgatgagtgcagccattaaggatgaaagggctgttcacgccgacatgggatactggatcgagagccagaaaaacggctcctggaagctagagaaagcatcttttatagaagtgaagacatgcacctggcctaagtcgcacactctgtggagcaatggtgtactcgagtccgatatgatcattccaaaatcactggcgggcccgatcagtcagcataaccaccgtcccgggtatcatacccaaacagccggaccttggcaccttggcaagttggaactggacttcaattactgcgaggggactaccgtcgtgattacagagaactgtggaacgcggggcccatctttacgaaccactacagtgagcggtaaactcatccacgaatggtgctgtagatcctgcaccctgccccctcttaggtatatgggggaggatggatgttggtacggcatggaaatacgcccaattaatgagaaggaagagaacatggtcaaatcactggttagcgctggttctggcaaggtggacaattttactatgggggtattgtgcctcgccatcctgttcgaggaagtgatgcggggaaagttcggcaaaaagcatatgatcgcaggggtcctatttacattcgtgctgctcctgtccggacagattacctggagagatatggctcacacgcttatcatgattggcagtaacgccagcgacaggatgggtatgggggttacttatttggcactgatagccacctttaaaatccagcccttcttagctctcggatttttcctgcgcaagcttacatctcgagagaatctgctactcggcgtgggcctggcgatggccaccactttgcaactgccggaagatattgagcagatggcaaacgggatcgctttaggactcatgacactgaaacttattacccagtttgaaacataccagctgtggactgccttggtctccctcacctgttcaaatacgatcttcacactgaccgtggcctggcggactgctaccctaatactggcaggtgttagtcttctccctctgtgccaaagctcgtccatgcgtaagacagactggttgccaatgactgtggccgcgatgggcgtcccccctctgcccttatttatcttctctctcaaggataccccaaaaagaaggagctggcctctgaacgagggggtaatggctgtgggacttgtttcaattctggccagttccttgctccgcaacgacgtgcccatggcaggcccactggtcgccggtgggctactgatcgcttgttatgtgattacgggaacatctgcagatcttaccgtagagaaggccgcggacgtgacttgggaagaggaagctgagcagacaggcgtcagccataatctcatgatcaccgttgacgatgacggcactatgcggataaaagatgacgaaacagagaacattctgaccgtgttgttaaagacggccctgctcatcgtgtccgggatctttccgtactcaattcctgcaactctgcttgtctggcacacctggcagaaacagacacaaagaagcggagtgctgtgggatgttcccagtccacccgagacccagaaggccgaattggaggaaggtgtatacaggataaaacagcagggcatcttcgggaagacacaagtgggagtcggcgtgcagaaggagggtgtttttcatactatgtggcacgtgacccgaggggctgtcctaacgcacaatggaaaacgcctggagcctaactgggcctctgtgaagaaagacctcatttcctatggcggcgggtggcggctgagcgcacagtggcaaaagggagaagaggtacaggtcatcgctgtggaaccaggtaaaaatcccaagaacttccagacaatgcctggcattttccagactaccacaggggagatcggagccatagcgcttgattttaagccgggcacctcgggttcaccaatcattaatagagaagggaaagttgtgggattatacggcaacggcgtcgtgactaagaatgggggatatgtttctggtatcgcccaaaccaacgcagagcccgacggccctacaccagagctggaagaggaaatgttcaaaaagaggaatctcacgattatggatttgcatcccgggagtggaaaaactcgtaagtacctgcctgctatcgtgcgcgaggccataaagcggagactcaggaccctgattcttgctccgacacgagtcgtggcagccgaaatggaggaggccctgaaaggcttgcccatccggtatcagaccactgctacaaagtccgaacacaccggtcgcgagatcgtagacctaatgtgccatgcgacgtttactatgagactgctcagcccagtgagggttcctaactacaatttaattatcatggatgaagcacacttcacagaccccgcctctatagctgcccgggggtatattagcacccgagtcggaatgggcgaggcagccgctatctttatgaccgcgactccacctggcacagccgaagcattcccccagtccaacgctccaattcaggatgaggagaaagacatcccggaaagatcatggaatagtgggaacgagtggataaccgactttgtgggaaagacagtgtggttcgtccctagcattaaagccggtaacgatatcgcaaattgtctgcgcaagaacggcaagaaagtaatccaactttctaggaagacttttgacacggaataccagaaaacccgtctgaatgattgggacttcgtggttacaactgatatttccgagatgggggccaactttaaggctgaccgggtgatcgatcccagaaggtgcctcaaaccagtcattttgaccgacggacccgagcgcgtgatactggccggccctatgccagttacagcggcatcagccgctcagcgaagaggtcgggtggggaggaatccccagaaggaaaacgatcaatacatcttcaccggccagcctctcaataacgacgaggatcatgcccactggactgaagctaagatgctgcttgacaatattaacacgccggagggaatcatcccagcactattcgaacccgagcgcgagaaaagtgccgctattgacggcgaatatcgtctgaagggggagagcagaaaaacctttgtcgaattgatgcggaggggagatttacctgtgtggctggcccacaaggtagcatccgagggtataaaatacacagaccgcaagtggtgcttcgatggcgaacgaaataaccagatcctcgaggagaatatggacgtggaaatttggactaaagagggggaaagaaagaagctgcggcccaggtggcttgatgcgcgcacctattctgacccactggccctcaaagagtttaaggatttcgctgccggaagaaaatcgatcgcattggacctggttacagaaattggcagggtccctagccatctagcttaccggacccgtaacgccctggataatctcgtgatgcttcacacttcagagcatggtgggcgcgcatatcgacacgccgtggaggaactgcccgagacaatggaaacgttattgctgctcggcctgatgatccttctgaccggaggcgctatgctctttttgatatccgggaagggaatcggtaaaactagtattggcctgatctgtgtcattgtttctagcgggatgttatggatggcggacgtgccactacagtggatcgcctccgcaatagtactggagttctttatgatggtgctccttattcctgagccggaaaagcaaagaacaccccaggataaccagctggcttacgtcgtgatcggaattttgaccctggccgccatcgttgcagctaatgagatgggcctcctggaaaccacaaagagggaccttggtatgtcaaaagagccaggggtggtctctcctactagctatctcgatgtagacctgcaccccgccagtgcgtggacgttgtacgctgtggccaccacagttataactccaatgctgcggcataccatcgaaaactccacagcaaacgtgagcttagccgctattgcaaatcaagccgtcgtgctaatgggcctggacaagggatggcctatctctaaaatggatctcggcgtcccccttctggcgttggggtgctactcacaggtgaacccgctgaccctcactgctgccgttctgcttttagtgacgcactatgcaattatcggaccaggcctgcaggccaaggctacacgcgaggcccagaaaagaaccgcagctggtataatgaagaatcctactgtagacgggattatgaccatcgatctcgaccccgtgatctacgattccaagttcgagaaacaattgggacaggtcatgctgctagttctgtgtgccgtgcagctccttctgatgaggacaagttgggcgttgtgcgaagccctgactctcgcaaccggcccaattacaacgctgtgggagggtagccccggcaagttttggaacaccactatcgctgtctcgatggccaatatattccgggggtcttatttagcaggagctggccttgccttttccattatgaaaagcgtggggacaggacgaagaggcaccggttcacagggggaaactctgggagagaagtggaaaaagaagctcaaccaactaagtcgcaaagaattcgacctgtacaagaaatctggcatcacagaggtagataggaccgaggccaaggaaggtttgaaacggggcgagacgacccatcacgcggtgtcccgtgggagcgctaagctgcagtggtttgttgaaagaaatatggtgattcctgagggaagggtcatcgacctcggctgtgggcgcggaggctggtcatattactgcgcaggtcttaaaaaggtgacagaagtccgggggtatactaagggaggcccgggccatgaggagcccgtgccaatgagtacctacgggtggaacatagttaaactgatgagcggaaaggatgtattctacttgcctcccgaaaaatgtgacacactgctctgcgatatcggtgagtcctctcctagcccaactgtggaagagtcccgaaccattagagtcttaaagatggtggagccctggctgaaaaataaccagttctgtatcaaggttcttaatccttatatgccaacagtgattgaacacctggagaggctacagcgcaagtacggcgggatgctcgtccggaaccccctgtcaagaaattctacccacgaaatgtattggatcagtaacggaactggcaatattgtgtcgagcgtaaacatggtgtcccgtttgctgctcaacaggtttacgatgacacatcggcgcccgaccatcgagaaagacgttgatcttggtgccgggactcgacacgtcaatgctgaacctgagaccccaaacatggacgtgataggagagagaattaagaggatcaaagaagagcattcttcaacatggcactacgacgatgaaaatccctataagacgtgggcctaccacggcagctatgaggtgaaagcaaccggctccgccagttctatgatcaacggggtcgttaagctgttaactaagccttgggacgtggtaccaatggtgacacaaatggctatgaccgatactacacccttcggacagcagcgggtctttaaagaaaaggtggacacccgcacaccgagacctatgcccggtactaggaaagttatggagattaccgcggagtggctgtggcgaacgttgggccggaataagaaaccacgtctctgcaccagagaagagttcacaaagaaggtgcgcactaacgccgcaatgggggctgtctttaccgaagagaatcaatgggatagcgccagggcagccgtggaagacgaggagttctggaaactggtagatcgggaaagagagctacataagcttggaaaatgtggctcatgcgtttacaacatgatgggtaagcgcgaaaaaaagctgggggagtttggaaaagctaagggctccagggccatatggtacatgtggctcggcgcgcgatatctggagttcgaagcattggggtttctgaatgaggaccactggttcagtcgggaaaacagctactctggagtggagggtgaaggcctccataagcttgggtatatcctgagagatatttccaaaatccctggaggcgccatgtacgctgacgatacagccggttgggacactaggattaccgaggacgatttacacaatgaggaaaagatcacgcagcagatggaccccgagcatcgccagctggcaaacgctatatttaaattgacatatcaaaataaggtcgtgaaagtgcagcgtccaacccccaaggggactgtcatggatatcatttcacggaaggaccagagaggaagcggccaggttggcacatacgggctcaacaccttcactaatatggaagcccaactggtgaggcagatggagggagaaggtgtactatcgaaagctgatcttgagaaccctcacctgctcgagaagaaaatcacccagtggctggaaacaaagggcgtggagcgcttgaaacgaatggccatttctggggacgattgcgtcgtgaagccaatcgacgatcggtttgcaaacgcgttactggccctcaatgacatgggaaaggttagaaaagatataccgcagtggcaacccagtaagggctggcacgactggcagcaggtgcctttctgttcccatcacttccatgaacttattatgaaagatggtaggaagctggtcgtgccatgccgcccccaggacgagctaatcgggagagctcggatcagccaaggagccggctggtcactgaaagaaacggcatgtctcggcaaggcttatgcccagatgtggtccttgatgtactttcacaggcgtgacctgcgacttgcatctaacgccatttgcagcgcggtacctgttcactggataccaaccagtcgcactacatggtccatccatgctcaccatcagtggatgaccactgaggatatgctgacagtgtggaatagagtctggattgaggacaacccctggatggaagataagacccctgtgacgacatgggaggacatcccgtacctcgggaaacgggaagatcaatggtgtggaagcttaattggtctgacctctagggccacttgggcacagaatatcttgaccgccatacagcaggttcgctcactgatcggcgacgaggagttcctcgattatatgccaagtatgaagagatttcggaaagaagaggaatccgagggggctatttggtga

SEQ ID NO: 15598 - RNA, 9873 nt, synthetic construct
  misc_feature 1..9873: note = derived and/or modified CDS sequence (opt3) from DENV-3__FJ898456__SS-prME
  source 1..9873: mol_type = other RNA
accagcctgtgcctcatgatgatgcttcccgccaccctggctttccacttgacttcccgagacggagagcctaggatgatcgtggggaagaacgaacggggaaaatctttactgtttaagacggcatcaggtattaatatgtgtaccctgatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcattctggagcaggggaaacgcacgttaacaccccagccaatggagctgaagtatagttggaagacttggggaaaagcgaagatcgtgacagccgaaacccaaaattccagctttattatcgatggccctaacacacccgagtgcccatctgcttcaagagcatggaacgtatgggaagtcgaggactacggtttcggggtgtttactaccaatatatggcttaaattgagggaaatgtatacgcagctctgtgaccaccggctgatgagtgccgctgttaaggatgagcgcgccgtgcacgcagacatgggatactggatcgagagccagaaaaacggctcctggaagctagaaaaggcgtctctgattgaggtcaaaacatgcacctggcccaagtcgcatactctctggagcaatggtgtgctggaatccgatatgatcattcctaaatcacttgccggcccaatcagtcagcacaactacagaccggggtatcatacccaaacagctggaccctggcacttgggcaagctggagttagacttcaattactgcgaggggactaccgttgtgataacagaaaactgtggaacgaggggcccttctctccgtaccactacagtaagcggtaaactgattcacgagtggtgctgtcggtcctgcacccttccacccctgcgatatatgggggaagatggatgttggtacggcatggagatcagacctatcaatgaaaaggaggagaacatggtcaagtcattggtgagcgccggttctggcaaagcagacaattttactatgggggtgctctgcctggctattttcttcgaagaggtcatgaggggaaagtttggcaaaaagcatatgatcgccggggcactattcacatttgttctgctcctgtccggacagattacctggcgcgatatggcccacacgcttataatgatcggcagtaacgctagcgaccggatgggtatgggggtgacttatttggcgctgattgccaccttcaaaatccagccatttttagcactcggattctttctgagaaaacttacatctagggaaaatctgctactcggcgtaggcctggctatggccaccactttgcaactgcccgaggatattgaacagatggccaacgggatcgctttaggactcatggcactgaaacttataacacagttcgagacctaccagctgtggacagccttggtgtccctcatgtgttcaaatactatctttaccctgacggtcgcgtggcgcacagctaccctaattctggccgtgatcagtcttctcccggtttgccaaagctcgtccatgcgaaaaactgactggctgcctatgaccgtggcagccatgggtgtcccatctttgcccctgttcatttttagcttaaaggatacactcaaacggcgttcatggcctctgaacgagggcgtgatggctgttgggcttgtgagtatcctggcatcctctttcttgagaaatgacgtccccatggccggaccactcgtagcgggcggtctgctaatagcttgttatgtgattactgggaccagcgccgatctgacggttgaaaaggcagccgacgtgacatgggaggaagaggctgaacagaccggagtctcccataaccttatgatcactgtggacgatgacggcacaatgaggatcaaagatgacgagaccgagaacattctcactgtactgttgaagacagccttactgatagtgtcaggcatctttccttacagcattcccgcaaccctcctggtctggcacacgtggcagaaacagactcaacgcagtggggttctttgggatgtgccatctccgcctgaaacccagaaggctgagctggaagagggagtgtaccggatcaagcagcagggtattttcggcaaaacacaagtcggggtgggagttcagaaggagggcgtattccataccatgtggcacgtgacaagaggtgccgtcttgactcacaatgggaaaaggctagaacccaactgggcgaatgtgaagaaagacctgatctcctatggaggcggctggaagctcagcgcccagtggcaaaagggggaggaagttcaggtgatagcagtcgagccaggcaagaaccccaagtcgtttcagaccatgcctggtatcttccagacgacaactggcgaaattggggctatcgccctggattttaaaccaggaacctcaggctctcccattatcaatcgagagggtaaggtggtagggctttacggaaacggcgtcgtgactaagaatggcgggtatgttagtggaatagctcaaaccaacgcagagcctgacggtccgactccagaattagaggaagagatgttcaagaagcgcaatctgaccattatggatctccatcccggctccgggaaaacacggaagtacttgcctgccatcgtgagagaagccatcaaaaggcgtctgcgcacgctcattctggctccaactcgggtcgtggcggcagagatggaggaagcccttaagggactgcccatcagatatcagaccacagctaccaaaagcgagcacactggcagggaaatagttgacttgatgtgccatgccacatttaccatgcgactactgtctcctgtgcgggtcccgaactacaatctcattgtgatggatgaggcacacttcacggaccccgccagcatcgctgcgcgcggttatatttccactagagtagggatgggagaagccgcagctatctttatgacagccaccccacctggcaccgcagatgccttcccccagtcaaacgctccaatacaggacgaggagagggacattcctgaacggagttggaatagcggcaacgagtggatcactgattttgccgggaagacagtgtggttcgttccctctatcaaggcgggaaatgacattgcaaactgtttaagaaagaacggtaagaaagtcatccaactgtccagaaagacctttaatacagaataccagaaaactaaacttaacgattgggacttcgtggtgacgaccgatatttcagagatgggcgccaatttcaaggctgaccgcgtcatagatccaaggcgttgcctgaaaccggtaatcctcacagacgggcctgagcgggtgattttggccggacccatgccagttactgtggctagtgcagcccagagaaggggccgcgtcggtcgaaacccccagaaggaaaatgatcaatacatctttaccgggcagcctctgaacaatgacgaggatcatgctcactggacagaagccaaaatgctcctggacaacatcaataccccagagggcattatacccgcacttttcgaacctgagagagagaaaagcgcggccatcgacggagaatatcggctaaaaggcgaatccaggaagacttttgtggaactgatgcgccgtggggatttgccggtttggttagctcacaaagtggcctctgagggaattaagtacacggacagaaagtggtgcttcgatggtgaacggaacaatcagatcctggaggagaacatggacgtcgaaatttggaccaaagagggcgaaaagaaaaagctcaggccacgctggctggatgcacgaacatattcggacccccttgctctgaaagagtttaaggatttcgccgcagggagaaagagcatcgccctcgacttggtgactgaaataggacgggtaccttcacatctggctcacaggacccgcaatgcgctagataacctggtgatgctccatacatccgagcacggcggtagagcctacaggcacgcagttgaggaacttcccgagaccatggaaactctgttattgctggggctcatgatcctgcttacaggcggagctatgctgtttctcattagtggcaaagggatcggaaagacgtctattggtttgatctgtgtcgtggccagctccggcatgctgtggatggccgacgtgccattacagtggatagcatcagctattgtcctagagttctttatgatggttctgctcatccctgagcccgaaaaacaacggaccccacaggataatcagcttgcctatgtggtaattgggatcctgactttggcggctatagtggccgcaaacgagatgggactgctcgaaacaaccaagcgtgacctgggcatgtctaaagagcctggtgtcgtgagcccgaccagttaccttgatgttgacctccatcccgcctccgcttggacactgtatgcagtggccactacggtcatcaccccaatgttgcgccacacaattgaaaatagcactgcgaacgtatctctggctgccatcgcaaaccaagccgtggttttaatggggctagacaagggctggcctatttcaaagatggatctgggagtgcccctccttgctctgggctgctactcccaggtcaatccattgaccctgacagccgcagtgctcctgcttgtcacccattacgctatcatagggcctggattacaggccaaagcgactcgagaggcccagaagagaacggcagctggcattatgaaaaaccccacagtggacggtatcatgaccatcgatctggacccggttatttatgatagtaagttcgagaaacaactcggacaggtgatgttgctggtactatgtgccgtgcagctgctccttatgaggactagctgggcattttgcgaagctctgaccttggccacaggaccaatcactaccctgtgggagggctcgcctggtaagttctggaatacaacgatagccgtctctatggcgaacatttttcggggctcctacctcgctggggcaggactggccttcagcatcatgaagtcagttggcaccgggaaacgcggaactggcagtcagggtgaaacattaggggagaagtggaaaaagaaacttaatcaactgtctagaaaggagttcgacctctataaaaagtccggaattaccgaggtggagaggactgaagctaaggagggcctaaaacggggtgaaatcacacaccatgccgtcagccgaggctcagcaaagctgcagtggtttgtggagagaaacatggtaatacccgaagggcgcgtgatcgatttgggatgtggcagaggcgggtggagttactattgcgccgggctgaaaaaggttaccgaggtgcggggttacacgaaagggggaccaggccacgaggaacccgtccctatgagcacctatggctggaatattgtgaagctcatgtccgggaaggacgtcttctaccttccgcccgagaaatgtgatacactgttgtgcgacatcggagaatctagcccatcccctactgtggaggagtcacgtaccattagagttctgaagatggtagaaccctggctcaaaaacaatcagttttgtatcaaggtgttaaacccttacatgccaacagtcattgagcacctggaaaggcttcagcgcaaacatggtggcatgctggtgcggaatcccctatctcgaaacagtactcacgagatgtattggatctcgaatgggaccggaaacatagttagctccgtgaatatggtctctagactcctgttgaacaggttcacaatgacccatcgccggcctactattgaaaaggatgtggacctgggcgctggtacgagacacgtaaacgcggagccagagacacccaatatggatgtgatcggggaacgtatcaggcggattaaggaggaacactcaagcacctggcattacgacgacgagaacccgtataaaacttgggcctaccacggatcctatgaagttaaggcaaccggcagtgcttctagcatgataaatggcgtcgtgaaactccttacaaagccttgggatgtggtcccaatggttacgcaaatggccatgaccgacactacaccctttgggcagcagcgcgtgttcaaagagaaggtagatacccgaactcctagaccaatgcccggaacaaggaaggtgatggagatcaccgcagaatggctgtggcggacattaggtcgcaacaaaagaccgaggctgtgcactcgagaggaatttattaagaaagtccggaccaatgccgctatgggcgccgtgttcacggaggaaaaccaatgggactcagcgcgtgcagccgttgaggatgaggaattttggaagttggtggacagagagcgcgaactccataaactggggaagtgtggatcctgcgtctacaatatgatgggcaaaagggagaagaagctaggtgagttcgggaaagctaagggaagtcgggccatctggtatatgtggcttggcgcaagatacctggaatttgaggctctcggcttcctgaacgaagatcactggtttagccgcgaaaattcttactccggggtggaaggagagggtttgcataaactgggctatattctcagggacatctcaaagatacctgggggagccatgtacgctgatgacaccgccggctgggatacacgaatcactgaggacgaccttcacaacgaagagaaaattacccagcagatggatcccgaacaccggagactggcaaatgcgatcttcaagttaacatatcagaacaaggtagttaaagtgcaaaggccaactcctaagggtaccgtcatggacattatcagccgcaaagatcagcgtgggtcgggacaggtgggcacgtacggcctgaatacattcaccaacatggaggcccagttgatacggcaaatggaaggggagggagtgctctctaaggctgacctggagaatccccatctacttgagaaaaaggtcactcagtggctggagacaaagggtgttgaaagactcaaaaggatggccattagtggcgatgactgcgtggtaaagccaatcgatgaccgctttgcaaacgctctgttggccttaaacgatatggggaaagtgcgaaaggacatcccccagtggcagccttccaaaggatggcacgattggcaacaggtcccattctgtagccatcactttcacgagctgattatgaaggacggccggaagctcgtggttccgtgcagaccccaggatgaacttataggtagggcacgcatctcacagggggccggatggtccctgagagagaccgcgtgtctaggcaaggcttatgcccaaatgtgggcactgatgtacttccatcggagggacctccgtttggcctctaatgctatttgcagcgccgtgcctgtccactgggtgccaacaagtcgaaccacatggtccatccatgcacaccatcagtggatgacgaccgaggacatgctgactgtatggaaccgcgtttggattgaagataatccctggatggaggacaagacacctgtgaccacttgggaagatgtcccatatcttggcaaaagagaggaccagtggtgtgggagcctgatcggactcgcttctcgggccacatgggcgcaaaacatattaaccgctatccaacaggtgaggtcactgattggtaatgaggaatttttggattacatgcccagtatgaagcgcttcagaaaagaggaagagtccgaaggcgccatctggtga

SEQ ID NO: 15599 - RNA, 9873 nt, synthetic construct
  misc_feature 1..9873: note = derived and/or modified CDS sequence (opt3) from DENV-3__JN697379__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccacatatcaccgaagttgagccggaagacattgattgctggtgtaacctgacaagtacctgggtgacttatgggacatgcaatcaagcgggagagcaccgccgagacaagcgtagcgtcgctcttgcaccccatgtgggcatgggtctggataccagaacgcaaacttggatgtccgcagagggggcctggaggcaggtcgaaaaagtggagacctgggctttgcggcaccctggattcacaatcctcgcactgtttctggcccattacattggcacttctctcacccagaaggttgtgatcttcatattactgatgcttgtcacaccatcgatgaccatgcgctgtgtgggcgtagggaacagagactttgttgaaggattgtcaggtgctacgtgggtggatgtcgtgctggagcacggcgggtgcgtgactacaatggccaagaataaacccaccctagacatcgagctccagaagactgaagcgacacaactggcaacccttaggaaactgtgtattgagggaaagatcacgaacattaccacagatagccggtgccctactcagggcgaagccatcttgccagaggaacaggaccagaattatgtctgtaaacacacctacgttgatcgcggttgggggaacggatgcggcctcttcggcaaggggagtctggtgacatgcgctaagtttcaatgtttagagtccatagagggaaaagtagtgcagcatgaaaatctgaagtatactgtcattatcaccgtgcacacaggtgaccagcatcaggttggcaacgagacccaaggggtgactgccgaaattacgtctcaggcaagcacagctgaggtcatcctccccgaatacggaacccttggcctggagtgctcccctcgaactggtttggacttcaatgagatgatcctactgaccatgaaaaacaaggcctggatggtgcacagacagtggtttttcgatctcccactgccgtggacatcaggggcgaccactgaaacacccacgtggaataggaaagagcttctggtaacctttaagaacgcccacgccaagaaacaagaagttgtggtcttgggcagtcaggagggagctatgcatactgccctcacaggcgctaccgaaattcagacaagcgggggaacttctatattcgccggtcacctgaagtgtcggttaaaaatggacaagctgaaactaaagggcatgtcctatgcaatgtgcctcaatacctttgtgctgaaaaaggaggtctcagagacgcagcatgggaccatccttattaaggtggaatacaaaggagaggatgccccttgtaagatcccattcagcacagaagacggccaaggtaaagctcacaacgggcgtttgataactgcgaaccccgttgtgaccaagaaagaggagcctgtaaatattgaagcagagccacccttcggcgaaagtaacatcgtcatcggaattggcgataaggccctgaagatcaattggtaccgcaaagggtcttccattggaaagatgtttgaggctacagccagaggtgcaaggcggatggccatactcggcgacactgcttgggatttcgggagcgtgggaggcgttctgaactcgcttggtaaaatggtgcatcagatctttgggtctgcctataccgcactgttctccggcgtctcatggattatgaagatcggaatcggcgtgttgctcacgtggattgggctgaatagtaaaaacacaagcatgtccttttcttgcatagcgatcggaattatcaccttatacctgggcgtagtggttcaggctgacatgggttgtgtcattaattggaaggggaaggaactaaaatgcggaagcggcatcttcgtgactaacgaggtgcacacatggaccgagcagtataagtttcaagccgattcaccgaaacgactcgcaactgccatagctggtgcctgggaaaatggcgtctgtgggatccgcagtaccacaagaatggagaacctgctttggaagcagattgcaaatgaattgaactacatcctgtgggagaataacattaaactcacggttgtggtgggagacatcaccggcgtactggaacaggggaagaggactttaacacctcagcccatggagctgaaatattcctggaagacctggggaaaggctaaaatagtcacagccgagactcaaaatagctctttcattatcgatggcccatcaacccctgaatgccccagtgcgagccgggcctggaacgtgtgggaggttgaagactacggttttggggtgttcacgacaaacatttggcttaagttgcgcgaggtctatacccagctctgtgaccacagactgatgtccgctgcagtgaaagatgaaagggccgttcatgctgacatgggatactggatcgagtctcagaagaatggctcgtggaaactagagaaggccagcctgatagaagtgaagacttgcacctggccaaaatcccacacactctggtcaaacggtgtactggagagtgatatgatcattcccaagtctcttgcaggccctatcagccagcataatcaccgtccagggtaccacactcaaaccgcgggaccgtggcatttgggcaaactggaattagactttaactattgcgaggggacaacggtcgtgatttccgagaattgtggaacccggggcccctcactccgaactacaaccgtgagcggtaagctgatccacgaatggtgctgtagatcttgcactcttcctccactgaggtacatgggggaggatggatgttggtatggcatggaaatacgccccattaacgagaaagaagagaatatggtcaagtccttggccagtgctggtagcggcaaggttgacaacttcacaatgggggtgctctgcctggccatcctatttgaggaagtaatgcggggaaaattcggcaagaaacatatgatcgcaggggtgctgttcacctttgtcctcctgctttctggacagattacgtggagagatatggctcacactttgatcatgattggctccaatgtgtcagacaggatgggtatgggggttacctacctggccttaatagcaacattcaagatccagccttttctcgccctgggattctttcttcgcaaactgaccagtcgagagaacctactcctgggcgtgggcttggctatggcggccactctgcggttaccagaagatattgagcaaatggcaaatgggatcgctctcggactgatggcccttaagctgattacacagttcgaaacctatcagttgtggacagccctcgtcagcctgacttgttcgaacaccatctttacgctaacagtggcttggcgtaccgcaactctgatacttgccggtatctccctcctgcccgtttgccagtctagctcaatgagaaagaccgactggttgccgatgacagtggcggctatgggcgtccctccactgcccttattcatttttagtctcaaagatactctgaagaggcgctcctggcctcttaatgagggggtaatggccgtgggactggtttctatcttggcaagctccctcctgcggaacgacgtgcccatggccggccctctagtagctggtgggctgcttattgcatgttacgtgatcaccggaacgtcagccgatctcacagtagagaaagcggctgacgtgacctgggaagaggaagccgagcaaactggcgtcagccataatctgatgataacagttgacgatgacggcaccatgagaattaaggatgacgaaactgagaacatcttgacagtgttactgaaaaccgcactcctgatcgtgagtgggattttcccatattctatacccgccacgcttctggtctggcacacttggcagaagcagacccagaggtccggagtgttgtgggatgttccaagcccgcctgagacacaaaaagctgaactagaggaaggtgtataccgaatcaagcagcagggcatttttgggaagacccaggtgggagtcggcgtgcaaaaagagggtgttttccacacaatgtggcatgtgactcgcggggccgtcctgacccacaacggaaagcggctcgagcccaattgggcatcggtgaaaaaggacctgatctcatacggcggcgggtggagactttctgctcagtggcagaaaggagaagaggtacaagtcattgccgtggaaccaggtaagaaccccaagaattttcagacgatgcctggcatcttccagacaactaccggggagataggagcgatcgccttagatttcaaaccaggcacaagtggttcccccattatcaacagggaagggaaggttgtgggactgtatggcaatggcgtcgtgaccaaaaacgggggatacgttagcggtattgcacagactaatgctgagcctgacggcccgaccccagagctcgaagaggaaatgtttaagaaacgtaacttgacaatcatggatctgcatcccgggtctggaaagacgcgcaagtatctccctgccatagtgcgggaggctattaaaagaaggctgcgaactcttatcctggcaccaacccgggtcgtggccgccgaaatggaggaggctttgaagggcctacccatccgctaccaaacaaccgcgactaaaagcgaacacacaggtagagagattgtagacctgatgtgccatgcaaccttcacgatgaggctcttatcccctgtgcgggttccgaattataacctgatcataatggatgaagcccactttactgaccccgcttcaattgccgcacgagggtacatcagtacaagagtcggaatgggcgaggccgctgcgattttcatgaccgccaccccacctggcactgcagatgcttttccccagagcaatgccccaatccaggacgaggaacgcgacatacctgagaggtcttggaactccgggaatgaatggattacagatttcgtgggaaagaccgtgtggtttgtcccctcaatcaaagcaggtaacgacatcgccaattgtcttcgtaagaacggcaagaaagtaattcagctgagtcggaagacattcgatactgagtatcagaaaacgaagctcaacgactgggattttgtggttaccacagacatcagcgaaatgggggctaatttcaaagccgatagagtgattgacccaaggcgctgcttgaagccggtcatactgactgatggacctgagcgagtgatcctcgcgggccccatgccagttaccgtggcatccgccgctcagagacggggtagggtcgggcgcaacccccagaaggagaatgaccagtacatttttatgggccaacctctgaacaatgatgaagaccacgcccattggacagaggctaaaatgcttctagacaacatcaataccccagaaggaatcattcccgcactgttcgagcctgaacgtgagaagtctgccgctatagatggcgagtacagattgaaaggggaatcgcggaagactttcgtggagttaatgaggcgcggagacctgccggtatggctcgcccacaaagtggcaagcgaaggtatcaagtatacggatcgaaaatggtgctttgacggcgagagaaacaatcagattctggaagagaacatggatgttgagatctggaccaaggaaggggagaagaagaaacttcggccaaggtggctggacgcgcgcacatactcagatcccctcgccttgaaagagttcaaagactttgctgccggaagaaaatccattgcactggatctagtcactgagatcggcagggtgcctagtcatctggctcaccggacccgtaatgccctcgacaaccttgtgatgctgcacacatctgaacatggtgggcgcgcatatcgacacgccgtcgaggagttacccgaaaccatggagactttgctgctcctgggccttatgatactgctcacaggaggcgctatgttgttcctgatcagcgggaagggaattggtaagacgtccatcggcttaatttgtgttatcgcgtcatctgggatgctatggatggccgatgtgccactgcagtggatagcaagcgctattgtactcgaatttttcatgatggtgcttctgatccctgagcccgagaaacagagaaccccacaagacaatcagttggcctacgtcgtgattggaatcctgactctcgccgcaatagttgctgccaacgaaatgggcctgcttgagacaaccaagagggatctcggtatgagtaaagaacctggggtggtctccccgaccagctatctggacgtagacttgcatcccgcgtctgcttggacactgtacgccgtggcaactacggttatcaccccaatgttacggcacacaattgaaaattcaactgccaacgtgtccctagctgcaatcgccaatcaggcggtcgtgctgatgggcctcgataagggatggcctattagtaaaatggaccttggcgtccccctgttggctctggggtgctatagccaagtgaacccactcaccctggccgcagccgttcttttactggtgacacattacgctatcataggacctggcctccaggccaaggcaacccgcgaagctcagaagagaactgccgcgggtattatgaaaaaccccacggtagatgggatcatgacaatcgacttggatccggtgatttacgactcgaagtttgagaaacagctgggacaagtcatgctactggttctctgtgccgtgcagcttctgttgatgaggacctcttgggcactgtgcgaggtcctcactctggctaccggcccaatcacaactttatgggaaggttcccctggcaagttctggaataccacaatagccgtgagcatggcaaacatttttcgggggtcatatcttgctggagccggcctggccttcagtatcatgaaatctgtagggacgggaaagcgaggcaccggttcccagggggagactctcggagaaaagtggaaaaagaaactaaatcagctgagcagaaaggagtttgatttgtacaaaaagtcaggcattacagaagtggaccgcaccgaggcgaaagagggtctgaagaggggcgaaatcactcaccacgctgttagtcgggggagcgcaaagctccaatggttcgtggagcgtaacatggtcatacccgaaggaagagtgatcgatcttggctgtgggaggggaggctggtcctattactgcgccggtctgaaaaaggtcacagaggtgcgcgggtataccaaaggaggcccaggccatgaggaacccgttcctatgtctacgtacgggtggaatattgtaaagttgatgagcggaaaagacgtgttttatctgccgcccgagaagtgtgataccctcttatgcgacatcggtgaatcctcaccatctcctacagtcgaggaaagtcggactattcgagtgctgaagatggttgagccctggcttaaaaacaatcagttctgtatcaaggtgctgaacccttacatgccaaccgtcattgagcacctagaaagactccagaggaaacatggcgggatgctggtgcgcaatcccttgtcgcggaacagcacacacgagatgtactggatctccaatggaactggcaacatagtatcttcagtgaatatggttagcagactgctccttaaccgtttcaccatgacacacaggcggcctaccattgaaaaggatgtcgacctgggtgctgggactcgccatgtgaatgccgagccagaaacgcccaacatggacgtgatcggagagcgaatcaaaagaattaaggaggaacactccagtacatggcattatgatgacgagaacccgtacaagacctgggcatatcacggctcttacgaagtcaaagccactggcagcgcttcatccatgataaatggggttgtgaagttactgaccaaaccttgggatgtagtgccaatggtcacacagatggcgatgacggacaccactccctttggacaacagagggtgttcaaggagaaagttgatacacggacccctcgcccaatgcccggtactagaaaggtgatggaaatcacagccgagtggttgtggaggaccctcggccgaaacaagcggccgcgtctgtgcacaagagaggaatttactaaaaaggtccgcaccaatgcagctatgggggccgtgttcacggaggaaaaccagtgggacagtgcaagggccgctgtagaggatgaagagttttggaagctagttgaccgggagagagaacttcataagctgggaaaatgtggcagctgcgtgtataatatgatgggtaagcgcgagaaaaagctcggggagttcggaaaggccaaaggctctagggcgatttggtacatgtggctgggcgcacgatatttggagtttgaggccctggggttcctcaacgaagatcactggttttcccgggaaaattcatacagcggagtcgaaggtgagggccttcacaagctggggtacatcttaagagacatttcgaaaatccctggaggcgctatgtatgccgatgacaccgcaggttgggacacaaggataactgaagatgacctgcataacgaggagaagatcacccaacagatggatcccgaacaccgccagttggctaatgccattttcaaactcacataccagaacaaggtggtgaaggtccaacgtccaactcctaaagggaccgttatggacatcatttctcggaaggatcagagaggaagtggccaggtgggcacgtatgggctgaatacatttaccaacatggaggctcagctaatcaggcaaatggaaggagagggtgtactttccaaagccgacctggaaaatccccatccactcgagaagaaaataactcagtggctggagacaaagggcgtggaacgcttgaagcgaatggcaattagcggggatgactgcgtcgtgaaacccatcgatgaccggttcgcgaacgccttactggctctcaatgatatgggaaaggttagaaaagacatccctcagtggcagccatcaaagggctggcacgattggcaacaggtgccgttttgttcccaccatttccacgagcttattatgaaagacggtaggaagctggtcgtgccctgccgccctcaggacgaactaatagggagagcccggatctctcagggagcaggctggagcctgagggagaccgcttgtctcggcaaggcctacgcacaaatgtggactttgatgtatttccatcgtcgagatctgcgccttgccagtaacgcgatttgctccgctgtaccagttcactgggtgcccaccagcagaacaacgtggtctatccatgcccaccaccagtggatgaccactgaagacatgctgacagtctggaaccgggtgtggattgaggataatccttggatggaggacaaaaccccagttactacatgggaagatgtgccctacctcgggaagagggaggaccagtggtgtggatcattaatcggtctgaccagtcgcgcaacgtgggcccaaaacatattgacagctatccagcaggtcagatccctgattggcaatgaagagtttctcgattatatgcctagcatgaaacggttcaggaaggaggaagagtctgaaggggccatctggtga

SEQ ID NO: 15600 - RNA, 9873 nt, synthetic construct
  misc_feature 1..9873: note = derived and/or modified CDS sequence (opt3) from DENV-3__JQ045687__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactggttgcggaagtggagccggaagacatcgattgctggtgtaaccttaccagtacatgggtaacctatgggacttgcaatcaggctggagagcatcgccgagacaagcgtagcgtggccctggcaccccacgtcggcatgggtttggatacaagaacccaaacgtggatgtccgccgagggggcttggaggcaggtggaaaaagttgagacttgggcactccggcatcctggattcaccattctggccctgtttctcgctcactacatcggcacatctttaactcagaaggtggtcattttcatcctgcttatgttggtgaccccatcgatgacaatgcgctgtgtaggcgttgggaacagagactttgtggaaggactgtcaggtgccacctgggtcgatgtggtgctagagcatggcgggtgcgtcacgactatggcgaagaataaacccacactcgacatagagctgcagaagaccgaagcaactcaacttgccacactgaggaaattgtgtatcgagggaaagattaccaacatcacgaccgatagccggtgccctacacagggcgaagctattctcccagaggaacaggaccagaattatgtttgtaaacacacttacgtggatcgcggttgggggaacggatgcggcctgttcggcaaggggagtttagtaacctgcgccaagtttcaatgtctggagcccatcgagggaaaagtggtccagtatgaaaatctcaagtacacagtgataattactgttcacaccggtgaccagcatcaggtgggcaacgacacacaaggggtcaccgtggagatcactcctcaggcatccacggtagaagctgttcttccagagtatggaacactgggcttggaatgctctccgcgaaccggtctagatttcaatgagatgattctgctcactatgaaaaacaaggcctggatggtgcacagacagtggtttttcgacctgccccttccttggaccagcggggcgacaaccgagactccaacatggaataaaaaggaactgttggtcacgtttaaaaacgcccatgcaaagaagcaagaggtggtcgtgctcggctcccaggaaggagctatgcacaccgccctgactggcgctacagagatccagaattcagggggaaccagtatcttcgccggtcacttaaaatgtaggctgaagatggataaactagaactcaagggcatgagctacgcaatgtgcctgaacacatttgttcttaaaaaggaggtgtctgagactcagcatgggaccattttgataaaggtagaatacaaaggagaggacgccccctgtaagatccctttctccacggaagatggccaaggtaaagctcacaacgggcggctgattaccgcgaatccagtcgtgacaaagaaagaggagcccgttaacatcgaagcagagccgcctttcggcgaatcaaatatagtgattggaatcggcgacaaggccctcaagatcaactggtataaaaaggggagcagtattggaaaaatgtttgaggctactgcccgtggtgcacgcagaatggccatcctgggcgataccgcttgggacttcgggtctgtcggaggcgtgcttaattccctgggtaagatggtacatcagatttttgggagcgcctacacagcattgttctcgggcgtgtcttggataatgaaaatcggaattggcgttctcctgacttggatcgggttaaactccaagaatacctcaatgagttttagctgcatcgtcattggaataatcacgctgtatctaggcgcggtggtgcaggctgatatgggttgtgccattaactggaaggggaaagaactcaagtgcggatccggcatcttcgtcacaaatgaggttcacacctggactgagcagtacaaatttcaagcagactctcccaagaggctggccacagctattgccggtgcatgggaaaacggcgtgtgtgggatccggagcaccactcgaatggagaatcttttgtggaaacagatagctaacgaactgaattatatcctctgggagaacaatattaagctgaccgtggtagtcggagatatcattggcgtgttagaacaggggaaacgcacactgacgccacagcctatggagcttaagtactcatggaagacctggggaaaagccaagatcgttactgcggagacacaaaacagttccttcataattgacggccccaacaccccagaatgccccagcgcctctagagcttggaatgtgtgggaggtcgaagactatggttttggggtgttcacaactaacatctggttgaaactcagggaggtttacacccagtcatgtgatcatcggctgatgagtgcagccattaaggacgaacgcgctgtgcacgccgatatgggatactggatcgagagccagaaaaatggctcctggaagctagagaaggcatcttttatagaagtaaaaacgtgcacatggcctaagtcgcacaccctgtggagcaacggtgtcctcgagtccgacatgatcattccaaaatcactggcgggcccgatcagtcagcataatcacagacccgggtatcatactcaaaccgccggaccttggcaccttggcaagttggaactggatttcaactactgcgaggggacaactgtggtgattaccgagaattgtggaacaaggggcccatctttacgtacgaccactgtcagcggtaaactcatccacgaatggtgctgtcggtcctgcacactgccccctcttcgatatatgggggaggacggatgttggtacggcatggaaataagaccaattaacgagaaggaagagaatatggttaagtcactggtgagcgctggttctggcaaagtagataactttaccatgggggtgttgtgcctcgccatcctgttcgaggaagtcatgaggggaaagttcggcaaaaagcatatgatcgcaggggtgctatttactttcgttctgctcctgtccggacagattacatggcgcgacatggctcacacccttatcatgattggcagtaatgccagcgatcggatgggtatgggggtgacgtatttggcactgatagccacttttaaaatccagcccttcttagctctcggatttttcctgagaaagcttacctctagggagaacctgctactcggcgtcggcctggcgatggccacaaccttgcaactgccggaagacattgagcagatggcaaatgggatcgctttaggactcatgactctgaagcttattacacagtttgaaacctaccagctgtggacagccttggtgtccctcacttgttcaaacaccatcttcacgctgacagttgcctggcgcaccgctactctaatactggcaggtgtgagtcttctccctctgtgccaaagctcgtccatgcgaaaaaccgattggttgccaatgacagtcgccgcgatgggcgtaccccctctgcccttatttatcttctctctcaaggacactccaaaacggcgtagctggcctctgaatgagggggtgatggctgttggacttgtgtcaattctggccagttccttgctcagaaacgatgtccccatggcaggcccactggtggccggtgggctactgatcgcttgttatgtaattaccggaacgtctgcagaccttacagtggagaaggccgcggacgtcacctgggaagaggaagctgagcagactggcgttagccataacctcatgatcacagtggatgacgatggcaccatgaggataaaagacgatgaaactgagaatattctgacagtgttgttaaagaccgccctgctcatcgtctccgggatctttccgtactcaattcctgcaacgctgcttgtgtggcacacttggcagaaacagacccaacgcagcggagttctgtgggacgtacccagtccacccgagacacagaaggccgaattggaggaaggtgtgtaccggataaagcagcagggcatcttcgggaaaacccaagtcggagtgggcgttcagaaggagggtgtgtttcatacaatgtggcacgtcactagaggggctgtgctaacccacaacggaaaaaggctggagcctaattgggcctctgtaaagaaagatctcatttcctatggcggcgggtggcgactgagcgcacagtggcaaaagggagaagaggtccaggtgatcgctgttgaaccaggtaagaaccccaaaaatttccagacgatgcctggcattttccagacaactaccggggagatcggagccatagcgcttgactttaagccgggcacatcgggttcaccaatcattaaccgcgaagggaaagtggtcggattatacggcaatggcgtggttaccaagaacgggggatatgtgtctggtatcgcccaaactaatgcagagcccgatggccctaccccagagctggaagaggaaatgttcaaaaagcggaacctcacaacgatggacttgcatcccgggagtggaaagactagaaaatacctgcctgctattgtcagggaggccatcaagcgtcgcctccggaccctgatacttgctccgacaagagtggtagcagccgaaatggaggaggccctgaaaggcttgcccattaggtatcagaccactgctacaaagtccgaacacaccggtcgagagatcgtggatctaatgtgccatgcgacgtttactatgcggctgctcagcccagttcgcgtccctaattacaacttaatcattatggacgaagcacacttcacagatcccgcctctatcgctgccagagggtatataagcaccagggtgggaatgggcgaggcagccgctatttttatgaccgcgactccacctggcacagccgaagcattcccccagtccaatgctccaatccaggacgaggagcgggacattccggaacgatcatggaacagtgggaatgagtggatcaccgattttgtgggaaaaacagtctggttcgtacctagcataaaggccggtaacgacattgcaaactgtctgagaaagaatggcaaaaaggtgatccaactttctcgcaaaacttttgatacggaataccagaagaccaggctgaacgactgggatttcgttgtgacaactgacatctccgagatgggggccaattttaaagctgatcgtgtcattgacccccggagatgcctcaagccagtgatcttgaccgatggacccgagagggttattctggccggccctatgccagtgacagcggcatcagccgctcagcgccgaggtagagtcgggcggaacccccagaaggaaaatgaccaatacatattcaccggccagcctctcaacaatgatgaggaccatgcccactggactgaagctaaaatgctgcttgacaacatcaatacgccggagggaattatcccagcactattcgaacccgagagggagaagagtgccgctatcgatggcgaatatcgcctgaaaggggagagccgtaagacctttgtggaattgatgagacggggagacttacctgtatggctggcccacaaagtggcatccgagggtattaagtacacagataggaaatggtgcttcgacggcgaacgcaacaatcagatactcgaggagaacatggatgttgaaatctggactaaggagggggaacgaaagaaactgagaccccggtggcttgacgcgaggacctattctgatccactggccctcaaggagtttaaagacttcgctgccggacgcaagtcgattgcattggatctggtcacagaaatcggcagagtgcctagccatctagcttacaggacccggaatgccctggacaacctcgtgatgcttcacacttcagagcatggtgggcgtgcatatcgccacgccgtcgaggaactgcccgagacaatggaaacgttattgctgctcggcctgatgattcttctgaccggaggcgctatgctctttttgatctccgggaaaggaataggtaagactagtatcggcctgatttgtgttatcgtgtctagcgggatgttatggatggcggatgtaccactacagtggattgcctccgcaatcgtgctggagttctttatgatggtcctccttatacctgagccggaaaagcaacgaacaccccaggacaatcagctggcttacgtggttattggaatcttgaccctggccgccattgtggcagctaacgagatgggcctcctggaaaccacaaaaagagatcttggtatgtcaaaggagccaggggtcgtatctcctactagctatctcgacgtggacctgcaccccgccagtgcgtggacgttgtacgctgttgccaccacagtgatcactccaatgctgaggcataccatagaaaattccacagcaaacgtcagcttagccgctatcgcaaaccaagccgtggtcctaatgggcctggataaaggatggcctatttctaagatggacctcggcgtgccccttctggcgttggggtgctactcacaggttaatccgctgaccctcactgctgccgtgctgcttttagtaacgcactatgcaatcattggaccaggcctgcaggccaaagctacacgggaggcccagaagcgcaccgcagctggtatcatgaagaaccctactgtggatgggataatgaccattgacctcgatcccgtcatctacgactccaaattcgagaagcaattgggacaggttatgctgctagtgctgtgtgccgtccagctccttctgatgagaacaagttgggcgttgtgcgaagccctgactctcgcaaccggcccaatcacaacgctgtgggagggtagccccggcaaattttggaataccactattgctgtgtcgatggccaacatcttcagggggtcttatttagcaggagctggccttgccttttccataatgaagagcgtagggacaggacggcgaggcaccggttcacagggggaaactctgggagagaaatggaagaagaaactcaatcaactaagtagaaaggaattcgatctgtacaaaaagtctggcattacagaggtggaccgcaccgaggccaaagaaggtttgaagaggggcgagacgacccatcacgcggtttcccgggggagcgctaaactgcagtggtttgtggaacgtaacatggtcatccctgagggaagagtgattgatctcggctgtgggaggggaggctggtcatattactgcgcaggtcttaagaaggtcacagaagtgcgcgggtatactaaaggaggcccgggccatgaggagcccgttccaatgagtacctacgggtggaatatcgtaaagctgatgagcggaaaagacgtgttctacttgcctcccgaaaagtgtgatacactgctctgcgacataggtgagtcctctcctagcccaactgtcgaagagtcccggaccatccgagtgttaaaaatggttgagccctggctgaagaacaatcagttctgtattaaggtgcttaacccttatatgccaacagtcatcgaacacctggagagactacagaggaaatacggcgggatgctcgtgcgcaatcccctgtcacggaactctacccacgaaatgtattggattagtaatggaactggcaacatcgtatcgagcgtgaatatggtttccagattgctgctcaaccgttttacgatgacacataggcggccgaccattgagaaggatgtcgaccttggtgccgggactcgccacgtgaacgctgaacctgagaccccaaatatggacgtgatcggagagcgaataaaaagaattaaggaagagcattcttcaacatggcactacgatgacgaaaacccctataaaacgtgggcctaccacggcagctatgaggtcaaggcaaccggctccgccagttctatgatcaatggggttgtgaagctgttaactaaaccttgggatgtagtgccaatggtcacacaaatggctatgaccgacactacacccttcggacagcagagggtgtttaaggaaaaagttgatacccggacaccgcgccctatgcccggtactagaaaggtgatggagatcaccgcggagtggctgtggaggacgttgggccgaaacaaaaagccacggctctgcacccgtgaagagttcacaaagaaagtcagaactaatgccgcaatgggggctgtgtttaccgaagagaaccaatgggacagcgcccgcgcagccgtagaagatgaggagttctggaagctggttgacagggaacgggagctacataaacttggaaagtgtggctcatgcgtgtacaatatgatgggtaaaagagaaaagaaactgggggagtttggaaaggctaagggctcccgcgccatttggtacatgtggctcggcgcgaggtatctggagttcgaagcattggggtttctgaacgaggatcactggttcagtcgagaaaatagctactctggagtcgagggtgaaggcctccataaacttgggtatatactgcgggacatctccaagattcctggaggcgccatgtacgctgatgacacagccggttgggacactagaatcaccgaggatgacttacacaacgaggaaaaaattacgcagcagatggatcccgagcataggcagctggcaaatgctatctttaagttgacatatcaaaacaaagtggtgaaggtccagcgcccaacccccaaggggactgttatggacataatctcacgtaaagatcagcggggaagcggccaggtgggcacatacgggctcaataccttcactaacatggaagcccaactggtaagacagatggagggagaaggtgtgctatcgaaggctgaccttgagaatcctcacctgctcgagaaaaagattacccagtggctggaaacaaaaggcgtcgagaggttgaagcgcatggccatctctggggatgactgcgtggttaagccaattgatgaccgatttgcaaacgcgttactggccctcaacgatatgggaaaagtgcggaaggacatcccgcagtggcaacccagtaaaggctggcacgattggcagcaggtccctttctgttcccatcacttccatgaacttataatgaaggacggtagaaaactggtggtaccatgcaggccccaggacgagctaattgggcgcgctagaatcagccaaggagccggctggtcactgaaggaaacggcatgtctcggcaaggcttatgcccagatgtggtccttgatgtactttcaccggagggatctgcgtcttgcatctaatgccatctgcagcgcggttcctgtgcactggattccaaccagtcgaactacatggtccatacatgctcaccatcagtggatgaccactgaggacatgctgacagtctggaaccgcgtgtggatcgaggataatccctggatggaagacaaaacccctgttacgacatgggaggatgtgccgtacctcgggaagagagaagaccaatggtgtggaagcttaattggtctgacctctcgggccacttgggcacagaacatcttgaccgccattcagcaggtcaggtcactgatcggcgatgaggagttcctcgactatatgccaagtatgaaacgctttagaaaggaagaggaatccgagggggctatatggtga

SEQ ID NO: 15601 - RNA, 9873 nt, synthetic construct
  misc_feature 1..9873: note = derived and/or modified CDS sequence (opt3) from DENV-3__JQ045689__SS-prME
  source 1..9873: mol_type = other RNA
acaagcctgtgcctcatgatgatgcttcccgcaacactggctttccacttgacttccagggacggagaacctaggatgatcgtggggaagaacgaacggggaaaatctttactgtttaagacggcatcaggtattaatatgtgtaccctcattgcaatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcagttcgaaaaagtcgagacttgggcactccggcatcctggatttaccatcctggccctgttcctcgctcactacattggcacatctttaactcagaaggtggttatctttatactgcttatgttggtgaccccatcgatgacaatgcgctgtgtcggcgtggggaacagagacttcgtagaaggactgtcaggtgccacctgggttgatgtggtcctagagcatggcgggtgcgtgacgactatggcgaagaataaacccacactcgacatcgagctgcagaagaccgaagcaactcagcttgccacactgaggaaattgtgtattgagggaaagatcaccaacattacgaccgatagccggtgccctacacagggcgaagctatcctcccagaggaacaggaccagaattatgtgtgtaaacacacttacgtcgatcgcggttgggggaacggatgcggcctgtttggcaaggggagtttagttacctgcgccaagttccaatgtctggagcccatagagggaaaagtggtacagtatgaaaatctcaagtacacagtgattatcactgtccacaccggtgaccagcatcaggtgggcaacgacacacaaggggttaccgtggagattactcctcaggcatccacggtcgaagctgtgcttccagagtatggaacactgggcttggaatgctctccgcgaaccggtctagattttaatgagatgatcctgctcactatgaaaaacaaggcctggatggtacacagacagtggttctttgacctgccccttccttggaccagcggggcgacaaccgagactccaacatggaataggaaagaactgttggttacgttcaagaacgcccatgccaagaagcaagaggtggtcgtgctcggctcccaggaaggagctatgcacaccgccctgactggcgctacagagatccaaaattcagggggaaccagtatttttgccggtcacttaaagtgtcggctgaaaatggataagctagaactcaaaggcatgagctacgcaatgtgcctgaacacattcgtccttaagaaagaggtgtctgagactcagcatgggaccatattgatcaaggttgaatacaagggagaggacgccccctgtaaaattcctttctccacggaagatggccaaggtaaggctcacaacgggcgtctgatcaccgcgaatccagtggtaaccaagaaggaggagcccgtcaacatagaagcagagccgccttttggcgaatcaaatattgtgatcggaatcggcgacaaagccctcaagattaactggtataagaaagggagcagtatcggaaagatgttcgaggctactgcccgcggtgcaagaaggatggccattctgggcgataccgcttgggactttgggtctgttggaggcgtgcttaattccctgggtaaaatggtccatcagatattcgggagcgcctacacagcattgttttcgggcgtgtcttggatcatgaagattggaatcggcgtactcctgacttggatcgggttaaactccaaaaatacctcaatgagtttcagctgcattgtgataggaatcattacgctgtatctaggcgcggttgtccaggctgatatgggttgtgccatcaactggaaggggaaggaactcaaatgcggatccggcatttttgtgacaaatgaggtgcacacctggactgagcagtacaagttccaagcagactctcccaaacggctggccacagctatcgccggtgcatgggaaaacggcgtctgtgggatacgaagcaccactcgcatggagaatcttttgtggaagcagatcgctaacgaactgaattatattctctgggagaacaatatcaaactgaccgttgtggtgggagatattatcggcgtattagaacaggggaagagaacactgacgccacagcctatggagcttaaatactcatggaagacctggggaaaggccaaaatagtcactgcggagacacaaaacagttcctttattatcgacggccccaacaccccagaatgccccagcgcctctagggcttggaatgtgtgggaggttgaagactatggtttcggggtgtttacaactaacatttggttgaagctccgggaggtctacacccagtcatgtgatcatcgcctgatgagtgcagccatcaaagacgaaagagctgtgcacgccgatatgggatactggatagagagccagaagaatggctcctggaaactagagaaggcatctttcatcgaagttaagacgtgcacatggcctaaatcgcacaccctgtggagcaacggtgtgctcgagtccgacatgattatcccaaagtcactggcgggcccgattagtcagcataatcacaggcccgggtatcatactcaaaccgccggaccttggcaccttggcaaattggaactggattttaactactgcgaggggacaactgtagtcatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtgaagtcactggtcagcgctggttctggcaaggttgataacttcaccatgggggtgttgtgcctcgccatcctgttcgaggaagtaatgcgcggaaaatttggcaagaaacatatgattgcaggggtgctattcacttttgtcctgctcctgtccggacagatcacatggcgggacatggctcacacccttattatgataggcagtaatgccagcgatagaatgggtatgggggtgacgtatttggcactgatcgccactttcaagattcagccctttttagctctcggattctttctgaggaaacttacctctcgcgagaacctgctactcggcgttggcctggcgatggccacaaccttgcaactgccggaagacatcgagcagatggcaaatgggattgctttaggactcatgactctgaaacttatcacacagttcgaaacctaccagctgtggacagccttggtgtccctcacttgttcaaacaccatatttacgctgacagtcgcctggcgaaccgctactctaatcctggccggtgtgagtcttctccctctgtgccaaagctcgtccatgcggaagaccgattggttgccaatgacagttgccgcgatgggcgtgccccctctgcccttattcatattttctctcaaagacactccaaagcgtagaagctggcctctgaatgagggggtcatggctgtaggacttgtgtcaatcctggccagttccttgctcaggaacgatgttcccatggcaggcccactggtggccggtgggctactgattgcttgttatgtcatcaccggaacgtctgcagaccttacagtggagaaagccgcggacgtaacctgggaagaggaagctgagcagactggcgtgagccataacctcatgataacagtcgatgacgatggcaccatgcgcattaaggacgatgaaactgagaatatcctgacagttttgttaaaaaccgccctgctcatcgtgtccgggattttcccgtactcaatacctgcaacgctgcttgtgtggcacacttggcagaagcagacccaacggagcggagtcctgtgggacgtgcccagtccacccgagacacagaaagccgaattggaggaaggtgtttacagaatcaagcagcagggcatttttgggaagacccaagtaggagtgggcgtccagaaagagggtgtgttccatacaatgtggcacgttactagaggggctgtgctaacccacaacggaaagcgactggagcctaattgggcctctgtcaaaaaggatctcatctcctatggcggcgggtggcgcctgagcgcacagtggcaaaaaggagaagaggtgcaggtaattgctgtcgaaccaggtaagaaccccaagaatttccagacgatgcctggcatctttcagacaactaccggggagataggagccatcgcgcttgacttcaaaccgggcacatcgggttcaccaattatcaaccgggaagggaaggtggttggattatacggcaatggcgtggtcaccaaaaacgggggatatgtgtctggtattgcccaaactaatgcagagcccgatggccctaccccagagctggaagaggaaatgtttaagaaaagaaacctcacaatcatggacttgcatcccgggagtggaaagacgaggaagtacctgcctgctatagttcgtgaggccattaaacgccggctcagaactctgatccttgctccgaccagggtggtcgcagccgaaatggaggaggccctgaagggcttgcccatccgatatcagacaaccgctactaaatccgaacacacaggtcgggagattgtggatctaatgtgccatgcgaccttcacgatgcgcctgctcagcccagtaagagtgcctaattacaacttaatcataatggacgaagcacactttactgatcccgcctctattgctgccagggggtatatcagcacacgggttggaatgggcgaggcagccgctattttcatgaccgcgaccccacctggcactgccgaagcatttccccagtccaatgctccaatccaggacgaggagcgagacataccggaaagatcatggaacagtgggaatgagtggattacagatttcgtcggaaagaccgtgtggtttgtgcctagcatcaaagccggtaacgacatcgcaaactgtctgcgcaagaatggcaagaaagtcattcaactttctaggaagacattcgatactgaataccagaaaacgcgtctgaacgactgggattttgtagtgaccacagacatctccgagatgggggccaatttcaaggctgatcgggttattgaccccagaaggtgcctcaaaccagtgatattgactgatggacccgagcgcgtcatcctggccggccctatgccagtgaccgcggcatcagccgctcagcgaagaggtcgggttgggaggaacccccagaaggaaaatgaccaatacattttcacaggccagcctctcaacaatgatgaggaccatgcccactggaccgaagctaagatgctgcttgacaacatcaatactccggagggaatcattccagcactatttgaacccgagcgcgagaaaagtgccgctatagatggcgaatatcgtctgaagggggagagcagaaaaacgttcgtggaattgatgcggaggggagacttacctgtctggctggcccacaaggtggcatccgagggtatcaaatacaccgatcgcaagtggtgctttgacggcgaacgaaacaatcagattctcgaggagaacatggatgtagaaatctggacaaaagagggggaaagaaagaagctgcggcccaggtggcttgacgcgcgcacttattctgatccactggccctcaaagagttcaaggactttgctgccggaagaaaatcgattgcattggatctggtgaccgaaatcggcagggttcctagccatctagctcaccggacacgtaatgccctggacaacctcgtcatgcttcatacctcagagcacggtgggcgcgcataccgacacgccgtggaggaactgcccgagactatggaaacattattgctgctcggcctgatgatacttctgacgggaggcgctatgctattcttgatctccgggaagggaattggtaaaaccagtatcggcctgatttgtgtgatcgtctctagcgggatgttatggatggcggatgttccactacagtggatagcctccgcaattgtgctggagtttttcatgatggtactccttatccctgagccggaaaagcaaagaactccccaggacaatcagctggcttatgtggtcattggaatcttgacactggccgccatagtggcagctaacgagatgggcctcctggaaaccaccaagagggatcttggtatgtcaaaagagccaggggttgtgtctcctacaagctacctcgacgtcgacctgcatcccgccagtgcgtggactttgtatgctgtagccacgaccgtgatcacaccaatgctgcggcacactattgaaaattccaccgcaaacgttagcttagccgctatcgcaaaccaagccgtggtcctaatgggcctggataagggatggcctatttctaaaatggacctcggcgtgccccttctggcgttggggtgctactcacaggtcaatccgctgacactcaccgctgccgtgctgcttttagttactcattacgcaatcataggaccaggcctgcaggccaaggctacgcgcgaggcccagaaaagaacagcagctggtattatgaagaaccctaccgtggatgggatcatgactatcgacctcgatcccgtaatttatgactccaagtttgagaaacaattgggacaggtgatgctgctagtcctgtgtgccgttcagctccttctgatgaggaccagttgggcgttgtgcgaagccctgacactcgcaactggcccaatcaccacactgtgggagggtagccccggcaagttctggaatacgaccatagctgtgtcgatggccaacatttttcgggggtcttacttagcaggagctggccttgccttctccatcatgaaaagcgtcgggactggacgaagaggcacaggttcacagggggaaaccctgggagagaagtggaaaaagaagctcaatcaactaagtcgcaaagaatttgatctgtataagaaatctggcattactgaggtggacaggacagaggccaaggaaggtttgaaacggggcgagaccacgcaccatgcggtatcccgtgggagcgctaagctgcagtggttcgtggaaagaaacatggttacccctgagggaagggtgatcgatctcggctgtgggcgcggaggctggtcatactattgcgcaggtcttaaaaaggtcacagaagtgcgggggtacactaagggaggcccgggccacgaggagcccgtcccaatgagtacctatgggtggaatatagtgaaactgatgagcggaaaggacgttttctacttgcctcccgaaaaatgtgatacactgctctgcgacatcggtgagtcctctcctagcccaactgtagaagagtcccgaaccattagagtgttaaagatggtcgagccctggctgaaaaacaatcagttttgtatcaaggtgcttaacccttacatgccaacagttattgaacacctggagaggctacagcgcaagtatggcgggatgctcgtgcggaatcccctgtcaagaaactctacccatgaaatgtactggatcagtaatggaactggcaacattgtctcgagcgtgaatatggtatcccgtttgctgctcaacaggttcacgatgacacaccggcgcccgaccatcgagaaagatgtggaccttggtgccgggactcgacatgttaacgctgaacctgagaccccaaatatggacgtcataggagagagaattaagaggatcaaagaggaacactcttcaacatggcactatgatgacgaaaacccctacaagacgtgggcctatcatggcagctacgaggtgaaagcaaccggctccgccagttctatgatcaatggggtggtcaagctgttaactaagccttgggatgttgtgccaatggtaacacaaatggctatgaccgacactacaccctttggacagcagcgggtgttcaaagaaaaggtcgatacccgcacaccgagacctatgcccggtactaggaaagtgatggagattaccgcggagtggctgtggcgaacgttgggccggaacaagaaaccacgtctctgcaccagagaagagtttacaaagaaggttcgcactaatgccgcaatgggggctgtgttcaccgaagagaaccaatgggacagcgccagggcagccgtcgaagatgaggagttttggaaactggtggaccgggaaagagagctacacaaacttggaaaatgtggctcatgcgtatataatatgatgggtaagcgcgagaagaagctgggggagttcggaaaagctaagggctccagggccatatggtacatgtggctcggcgcgcgatacctggagtttgaagcattggggttcctgaacgaggatcattggtttagtcgggaaaatagctattctggagttgagggtgaaggcctccacaaacttgggtacatcctgagagacatttccaaaatccctggaggcgccatgtatgctgatgacacagccggttgggacactaggattaccgaggatgacttacataacgaggaaaagatcacgcagcagatggatcccgagcaccgccagctggcaaatgctatattcaaattgacataccaaaacaaggtggtcaaagtgcagcgtccaacccccaaggggactgtgatggacatcatttcacggaaggatcagagaggaagcggccaggtcggcacatatgggctcaatacctttactaacatggaagcccaactggttaggcagatggagggagaaggtgtgctatcgaaagctgaccttgagaatcctcatctgctcgagaagaaaatcacccagtggctggaaacaaagggcgtagagcgcttgaaacgaatggccatttctggggatgactgcgtggtcaagccaatcgatgaccggttcgcaaacgcgttactggccctcaacgatatgggaaaggtgagaaaagacataccgcagtggcaacccagtaagggctggcatgattggcagcaggttcctttctgttcccaccattttcacgaacttattatgaaagacggtaggaagctggtggtcccatgccgcccccaggacgagctaatcgggagagctcggatcagccaaggagccggctggtcactgaaagaaacggcatgtctcggcaaggcttacgcccagatgtggtccttgatgtatttccacaggcgtgatctgcgacttgcatctaatgccatttgcagcgcggtgcctgtacattggataccaaccagtcgcactacatggtccatccacgctcatcaccagtggatgaccactgaggacatgctgacagtttggaacagagtgtggattgaggataatccctggatggaagacaagacccctgtcacgacatgggaggatatcccgtacctcgggaaacgggaagaccaatggtgtggcagcttaattggtctgacctctagggccacttgggcacagaacatcttgaccgccatacaacaggtgcgctcactgatcggcgatgaggagtttctcgactacatgccaagtatgaagagattccggaaagaagaggaatccgagggggctatttggtga

SEQ ID NO: 15602 - RNA, 9873 nt, synthetic construct
  misc_feature 1..9873: note = derived and/or modified CDS sequence (opt3) from DENV-3__JQ045691__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacatcggcatgggtttggatacaagaacccaaacgtggatgtccgccgagggggcttggaggcaggtggaaaaagtcgagacttgggcactccggcatcctggattcaccattctggccctgtttctcgctcactacatcggcacatctttaactcagaaggtggttatattcatcctgcttatgttggtgaccccatcgatgacaatgcgctgtgtcggcgtggggaacagagactttgtagaaggactgtcaggtgccacctgggttgatgtggtcctagagcatggcgggtgcgtgacgactatggcgaagaataaacccacactcgacattgagctgcagaagaccgaagcaactcaacttgccacactgaggaaattgtgtatcgagggaaagattaccaacatcacgaccgatagccggtgccctacacagggcgaagctatactcccagaggaacaggaccagaattatgtgtgtaaacacacttacgtcgatcgcggttgggggaacggatgcggcctgttcggcaaggggagtttagttacctgcgccaagtttcaatgtctggagcccattgagggaaaagtggtacagtatgaaaatctcaagtacacagtgatcattactgtccacaccggtgaccagcatcaggtgggcaacgacacacaaggggttaccgtggagatcactcctcaggcatccacggtcgaagctatccttccagagtatggaacactgggcttggaatgctctccgcgaaccggtctagatttcaatgagatgattctgctcactatgaaaaacaaggcctggatggtgcacagacagtggtttttcgacctgccccttccttggaccagcggggcgacaaccgagactccaacatggaataggaaagaactgttggtaacgtttaagaacgcccatgcaaaaaagcaagaggttgtggtcctcggctcccaggaaggagctatgcacaccgccctgactggcgctacagagatacagatctcagggggaaccagtattttcgccggtcacttaaagtgtcggctgaaaatggataagctagaactcaaaggcatgagctacgcaatgtgcctgaatacatttgtgcttaagaaagaggtctctgagactcagcatgggaccatcttgataaaggtggaatacaagggagaggacgccccctgtaaaattcctttctccacggaagatggccaaggtaaggctcacaacgggcgtctgatcaccgcgaacccagttgtgacaaaaaaggaggagcccgtaaatatcgaagcagagccgcctttcggcgaatcaaacattgtcatcggaattggcgacaaagccctcaagataaattggtataagaaagggagcagtatcggaaagatgtttgaggctactgcccgcggtgcaagaaggatggccattctgggcgataccgcttgggacttcgggtctgtgggaggcgttcttaactccctgggtaaaatggtgcatcagatctttgggagcgcctacacagcattgttctcgggcgtctcttggatcatgaagattggaataggcgtgctcctgacttggatcgggttaaattccaaaaacacctcaatgagttttagctgcattgtaatcggaattatcacgctgtatctaggcgcggtggttcaggctgatatgggttgtgccataaattggaaggggaaggaactcaaatgcggatccggcatcttcgtcacaaacgaggtgcacacctggactgagcagtacaagtttcaagcagactctcccaaacggctggccacagctattgccggtgcatgggaaaatggcgtgtgtgggatccgaagcaccactcgcatggagaaccttttgtggaagcagattgctaatgaactgaactatatcctctgggagaataacataaaactgaccgtcgttgtgggagatattatcggcgtgttagaacaggggaagagaacactgacgccacagcctatggagcttaaatactcatggaagacctggggaaaggccaaaattgtaactgcggagacacaaaatagttccttcatcatagacggccccaacaccccagaatgccccagcgcctctagggcttggaacgtctgggaggtggaagactatggttttggggttttcacaactaatatctggttgaagctccgggaggtgtacacccagtcatgtgatcatcgcctgatgagtgcagccattaaagacgaaagagctgtccacgccgatatgggatactggatcgagagccagaagaacggctcctggaaactagagaaggcatcttttattgaagtgaagacgtgcacatggcctaaatcgcacaccctgtggagcaatggtgttctcgagtccgacatgatcataccaaagtcactggcgggcccgattagtcagcataaccacaggcccgggtatcatactcaaaccgccggaccttggcaccttggcaaattggaactggatttcaattactgcgaggggacaactgtggtaatcaccgagaactgtggaacacgtggcccatctttacggacgaccactgtcagcggtaagctcatccacgaatggtgctgtcgatcctgcacactgccccctcttagatatatgggggaggacggatgttggtacggcatggaaattaggccaatcaatgagaaagaagagaacatggtgaagtcactggtgagcgctggttctggcaaggtcgataattttaccatgggggttttgtgcctcgccattctgttcgaggaagtgatgcgcggaaaattcggcaagaaacatatgatagcaggggtactatttactttcgtgctgctcctgtccggacagatcacatggcgggacatggctcacacccttattatgatcggcagtaacgccagcgatagaatgggtatgggggtcacgtatttggcactgattgccacttttaagatccagcccttcttagctctcggatttttcctgaggaaacttacctctcgcgagaatctgctactcggcgtgggcctggcgatggccacaaccttgcaactgccggaagacatagagcagatggcaaacgggatcgctttaggactcatgactctgaagcttattacacagtttgaaacctaccagctgtggacagccttggtttccctcacttgttcaaataccatcttcacgctgacagtggcctggcgaaccgctactctaattctggcaggtgtcagtcttctccctctgtgccaaagctcgtccatgcggaagaccgattggttgccaatgacagtggccgcgatgggcgttccccctctgcccttatttatcttctctctcaaagacactccaaagaaacgtagctggcctctgaacgagggggtgatggctgtcggacttgtatcaatactggccagttccttgctcagaaatgatgtgcccatggcaggcccactggttgccggtgggctactgattgcttgttatgtgatcaccggaacgtctgcagaccttacagtcgagaaggccgcggacgtgacctgggaagaggaagctgagcagactggcgtaagccataacctcatgatcacagtggatgacgatggcaccatgaggattaaagacgatgaaactgagaacatactgacagtcttgttaaagaccgccctgctcatcgtttccgggatttttccgtactcaatccctgcaacgctgcttgtgtggcacacttggcagaaacagacccaacgcagcggagtgctgtgggacgtccccagtccacccgagacacagaaggccgaattggaggaaggtgtgtaccggattaagcagcagggcatcttcgggaaaacccaagttggagtaggcgtgcagaaggagggtgtctttcatacaatgtggcacgtgactagaggggctgttctaacccacaatggaaaaaggctggagcctaactgggcctctgtgaagaaagatctcatatcctatggcggcgggtggcgactgagcgcacagtggcaaaagggagaagaggtccaggtgatcgctgtagaaccaggtaagaatcccaaaaacttccagacgatgcctggcattttccagacaactaccggggagatcggagccattgcgcttgactttaagccgggcacatcgggttcaccaatcataaatcgcgaagggaaagtcgtgggattatacggcaacggcgttgtgaccaagaatgggggatatgtctctggtattgcccaaactaacgcagagcccgatggccctaccccagagctggaagaggaaatgttcaaaaagcggaatctcacaatcatggacttgcatcccgggagtggaaagacgagaaaatacctgcctgctatcgtgagggaggccattaagcgtcgcctccggactctgatccttgctccgaccagagttgtggcagccgaaatggaggaggccctgaaaggcttgcccataaggtatcagacaaccgctactaagtccgaacacacaggtcgagagattgtcgatctaatgtgccatgcgacctttacgatgcggctgctcagcccagtgcgcgtacctaactacaatttaatcattatggacgaagcacacttcactgatcccgcctctatcgctgccagagggtatataagcacaagggtgggaatgggcgaggcagccgctatttttatgaccgcgaccccacctggcactgccgaagcattcccccagtccaacgctccaatccaggacgaggagcgggacatcccggaacgatcatggaatagtgggaacgagtggattacagattttgttggaaaaaccgtctggttcgtgcctagcatcaaggccggtaatgacattgcaaactgtctgagaaagaacggcaaaaaggtgatacaactttctcgcaaaacatttgatactgaataccagaagacgaggctgaatgactgggatttcgtcgtaaccacagacatctccgagatgggggccaactttaaagctgatcgtgtgattgacccccggagatgcctcaagccagttatcttgactgatggacccgagagggtgatcctggccggccctatgccagtcaccgcggcatcagccgctcagcgccgaggtagagtggggcggaatccccagaaggaaaacgaccaatacattttcacaggccagcctctcaataacgatgaggaccatgcccactggaccgaagctaaaatgctgcttgacaatataaacactccggagggaatcattccagcactattcgaacccgagagggagaagagtgccgctatcgatggcgaatatcgcctgaaaggggagagccgtaagacgtttgttgaattgatgagacggggagacttacctgtgtggctggcccacaaagtcgcatccgagggtattaagtacaccgataggaaatggtgcttcgacggcgaacgcaataaccagatcctcgaggagaatatggatgtggaaatatggacaaaggagggggaacgaaagaaactgagaccccggtggcttgacgcgaggacttattctgatccactggccctcaaggagtttaaagacttcgctgccggacgcaagtcgatcgcattggatctggtaaccgaaattggcagagtgcctagccatctagctcacaggacacggaacgccctggacaatctcgttatgcttcatacctcagagcacggtgggcgtgcataccgccacgccgtcgaggaactgcccgagactatggaaacattattgctgctcggcctgatgatccttctgacgggaggcgctatgctctttttgctgtccgggaaaggaattggtaagaccagtatcggcttaatatgtgtgattgtgtctagcgggatgctatggatggcggatgtcccactgcagtggatcgcctccgcaattgttctcgagttctttatgatggtgcttctgatccctgagccggaaaagcaacgaactccccaggacaaccagttggcttatgtagtgataggaatcctgacactcgccgccattgtcgcagctaatgagatgggcctgcttgaaaccaccaaaagagatctcggtatgtcaaaggagccaggggtggtttctcctacaagctacctggacgtggacttgcatcccgccagtgcgtggactctgtatgctgtcgccacgaccgtaatcacaccaatgttaaggcacactattgaaaactccaccgcaaatgtgagcctagccgctatcgcaaaccaagccgttgtgctgatgggcctcgataaaggatggcctatatctaagatggaccttggcgtccccctgttggcgctggggtgctactcacaggtgaacccgctcacactgaccgctgccgtccttttactggtgactcattacgcaattatcggaccaggcctccaggccaaagctacgcgggaggcccagaagcgcacagcagctggtatcatgaagaatcctaccgttgatgggattatgactatcgacttggatcccgtgatatatgactccaaattcgagaagcaactgggacaggtaatgctactggtgctctgtgccgtccagcttctgttgatgagaaccagttgggcgctgtgcgaagccctcacactggcaactggcccaattaccacattatgggagggtagccccggcaaattttggaacacgaccatcgctgtttcgatggccaatattttcagggggtcttaccttgcaggagctggcctggccttttccatcatgaagagcgtggggactggacggcgaggcacaggttcacagggggaaaccctcggagagaaatggaagaagaaactaaaccaactgagtagaaaggaattcgatttgtataaaaagtctggcataactgaggtcgaccgcacagaggccaaagaaggtctgaagaggggcgagaccacgcaccatgcggtgtcccgggggagcgctaaactccagtggtttgtagaacgtaatatggtgatccctgagggaagagttattgatcttggctgtgggaggggaggctggtcatactattgcgcaggtctgaagaaggtgaccgaagtccgcgggtacacaaaaggaggcccgggccacgaggagcccgtgccaatgagtacttatgggtggaacttggtcaagctgatgagcggaaaagacgtgttctacctccctcccgaaaagtgtgataccttactgtgcgacatcggtgagtcctctcctagctccacagttgaagagtcacggactattcgagtacttaaaatggtggagccatggctgaagaataaccagttctgtatcaaggtcctaaatccctacatgcctaccgtgattgaacacctcgagagactgcagaggaaatatggcgggatgttggttcgcaacccactgtctcggaatagtacacatgaaatgtactggatctcgaacggaaccggcaatatagtgagctccgtcaacatggtgtctagactccttctgaatcgttttactatgacgcacaggcggcccacaattgagaaggatgtagacttaggtgccgggacccgccatgtgaacgctgaaccggagactcctaacatggacgttatcggagagcgaatcaaaagaattaaggaagagcactcaagcacctggcactatgatgacgaaaatccatacaaaacatgggcctatcatggctcctacgaggtcaaggcaacgggcagtgcctctagcatgataaacggggtggtgaagctgttgaccaaaccctgggatgtcgttcctatggtgactcaaatggctatgacagacaccactccattcggacagcagagggtatttaaggaaaaagtggatacacggaccccccgcgcgatgccgggtacaagaaaggtcatggagatcactgccgagtggctctggaggaccctgggccgaaataaaaagcctcggctatgcacgcgtgaagagttcaccaagaaagtgagaacaaacgcagctatgggggccgtttttactgaagagaatcaatgggactcagcacgcgccgctgtggaagatgaggagttctggaagcttgtcgacagggaacgggagctgcacaaactcggaaagtgtggctcctgcgtgtataacatgatgggtaaaagagaaaagaaactgggggagtttggaaaggccaagggcagtcgcgcgatttggtacatgtggttgggcgcaaggtacctggagttcgaagccctcgggtttcttaatgaggatcattggttcagccgagaaaactcttattccggagtagagggtgaaggcctgcacaaattagggtacatcctgcgggacatttcaaagatccccggaggcgctatgtatgccgatgacaccgcaggttgggacacaagaataactgaggatgacttgcataatgaggaaaaaatcacccagcagatggatccagagcacaggcagctcgctaacgccatttttaagctgacgtaccaaaataaagttgtgaaggtccagcgccctacacccaaggggaccgtgatggacatcattagccgtaaagatcagcggggatcgggccaggtgggcacttatgggctaaacacattcaccaatatggaagctcaacttgtcagacagatggagggagaaggtgttctgtctaaggccgacctcgagaacagtcacctgttggagaaaaagatcactcagtggttagaaaccaaaggcgtggagaggctgaagcgcatggcaatatccggggatgactgcgtagtgaagccaattgatgaccgatttgcgaatgccctccttgctctgaacgatatgggaaaagtccggaaggacatcccccagtggcaacctagcaaaggctggcatgattggcagcaggtgccattctgttcacaccatttccacgaactaatcatgaaggacggtagaaaactggttgtgccgtgcaggccccaggacgagctcattgggcgcgccagaatatcccaaggagcaggctggtctttgaaggaaacagcttgtctgggcaaggcctacgcacagatgtggagccttatgtattttcaccggagggatctgcgtctcgccagtaacgcgatctgctccgctgtccctgtgcattggattccaacgagccgaaccacttggtctatccacgcccatcaccagtggatgacaaccgaggacatgttaactgtatggaatcgcgtttggattgaggataacccctggatggaagacaaaacacctgtgaccacgtgggaggatgtcccatacctggggaagagagaagaccaatggtgtggatcattgatcggtctgacaagtcgggcaacctgggcccagaatatactcactgctatccagcaggtgaggtcccttattggcgatgaggagttcctggactacatgcccagcatgaaacgctttagaaaggaagaggaatctgagggggccatctggtga

SEQ ID NO: 15603 - RNA, 9873 nt, synthetic construct
  misc_feature 1..9873: note = derived and/or modified CDS sequence (opt3) from DENV-3__JQ045692__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctatccttccagagtatggaacactgggcttggaatgctctccgcgaaccggtctagatttcaatgagatgatcctgctcactatgaaaaacaaggcctggatggtacacagacagtggtttttcgacctgccccttccttggaccagcggggcgacaaccgagactccaacatggaataggaaagaactgttggttacgtttaagaacgcccatgcaaaaaagcaagaggtggtcgtgctcggctcccaggaaggagctatgcacaccgccctgactggcgctacagagattcagatatcagggggaaccagtatcttcgccggtcacttaaagtgtcggctgaaaatggataagctagaactcaaaggcatgagctacgcaatgtgcctgaatacatttgtccttaagaaagaggtgtctgagactcagcatgggaccattttgatcaaggttgaatacaagggagaggacgccccctgtaaaatacctttctccacggaagatggccaaggtaaggctcacaacgggcgtctgattaccgcgaacccagtggtaacaaaaaaggaggagcccgtcaatatcgaagcagagccgcctttcggcgaatcaaacatcgtgattggaatcggcgacaaagccctcaagattaattggtataagaaagggagcagtataggaaagatgtttgaggctactgcccgcggtgcaagaaggatggccatcctgggcgataccgcttgggacttcgggtctgttggaggcgtgcttaactccctgggtaaaatggtccatcagatttttgggagcgcctacacagcattgttctcgggcgtgtcttggatcatgaagatcggaattggcgtactcctgacttggatagggttaaattccaaaaacacctcaatgagttttagctgcatcgtgattggaatcattacgctgtatctaggcgcggttgtccaggctgatatgggttgtgccatcaattggaaggggaaggaactcaaatgcggatccggcatattcgtgacaaacgaggtgcacacctggactgagcagtacaagtttcaagcagactctcccaaacggctggccacagctatcgccggtgcatgggaaaatggcgtctgtgggattcgaagcaccactcgcatggagaaccttttgtggaagcagatcgctaatgaactgaactatattctctgggagaataacatcaaactgaccgttgtggtgggagatataattggcgtattagaacaggggaagagaacactgacgccacagcctatggagcttaaatactcatggaagacctggggaaaggccaaaatcgtcactgcggagacacaaaatagttccttcattatcgacggccccaacaccccagaatgccccagcgcctctagggcttggaacgtgtgggaggttgaagactatggttttggggtgttcacaactaatatatggttgaagctccgggaggtctacacccagtcatgtgatcatcgcctgatgagtgcagccatcaaagacgaaagagctgtgcacgccgatatgggatactggattgagagccagaagaacggctcctggaaactagagaaggcatcttttatcgaagttaagacgtgcacatggcctaaatcgcacaccctgtggagcaatggtgtgctcgagtccgacatgattatcccaaagtcactggcgggcccgataagtcagcataaccacaggcccgggtatcatactcaaaccgccggaccttggcaccttggcaaattggaactggatttcaattactgcgaggggacaactgtagtcattaccgagaactgtggaacacgtggcccatctttacggacgaccactgtgagcggtaagctcatccacgaatggtgctgtcgatcctgcacactgccccctcttagatatatgggggaggacggatgttggtacggcatggaaatcaggccaattaatgagaaagaagagaacatggtgaagtcactggtcagcgctggttctggcaaggttgataattttaccatgggggtgttgtgcctcgccatcctgttcgaggaagtaatgcgcggaaaattcggcaagaaacatatgattgcaggggtgctatttactttcgtcctgctcctgtccggacagataacatggcgggacatggctcacacccttatcatgattggcagtaacgccagcgatagaatgggtatgggggtgacgtatttggcactgatcgccacttttaagattcagcccttcttagctctcggatttttcctgaggaaacttacctctcgcgagaatctgctactcggcgttggcctggcgatggccacaaccttgcaactgccggaagacatcgagcagatggcaaacgggatagctttaggactcatgactctgaagcttatcacacagtttgaaacctaccagctgtggacagccttggtgtccctcacttgttcaaataccattttcacgctgacagtcgcctggcgaaccgctactctaatcctggcaggtgtgagtcttctccctctgtgccaaagctcgtccatgcggaagaccgattggttgccaatgacagttgccgcgatgggcgtgccccctctgcccttatttattttctctctcaaagacactccaaagcgtagaagctggcctctgaacgagggggtcatggctgtaggacttgtgtcaatcctggccagttccttgctcaggaatgatgttcccatggcaggcccactggtggccggtgggctactgatagcttgttatgtcattaccggaacgtctgcagaccttacagtggagaaagccgcggacgtaacctgggaagaggaagctgagcagactggcgtgagccataacctcatgatcacagtcgatgacgatggcaccatgcgcatcaaggacgatgaaactgagaacattctgacagttttgttaaaaaccgccctgctcatagtgtccgggatctttccgtactcaattcctgcaacgctgcttgtgtggcacacttggcagaagcagacccaacggagcggagtcctgtgggacgtgcccagtccacccgaggcccagaaagctgaattggaggaaggtgtttacagaatcaagcagcagggcattttcgggaagacacaagtaggagtgggcgtccagaaagagggtgtgtttcataccatgtggcacgttacaaggggggccgtgctaactcacaatggaaagcgactggagcctaactgggcatctgtcaaaaaggatctcatctcctatggcggcgggtggcgcctgagcgctcagtggcaaaaaggagaagaggtgcaggtaatagccgtcgaaccaggtaagaatcccaagaacttccagaccatgcctggcatcttccagacgacaactggggagattggagcgatcgcccttgactttaaaccgggcacctcgggttcaccaattatcaatcgggaagggaaggtggttggattatacggcaacggcgtggtcacaaaaaatgggggatatgtgtctggtatagcacaaaccaacgctgagcccgatggccctactccagagctggaagaggaaatgttcaagaaaagaaatctcaccattatggacttgcatcccgggagtggaaagacaaggaagtacctgcctgccatcgttcgtgaggctatcaaacgccggctcagaacgctgattcttgcaccgactagggtggtcgccgccgaaatggaggaggctctgaagggcttgcccatccgatatcagaccacagcgaccaaatccgaacacactggtcgggagatagtggatctaatgtgccatgcaacatttaccatgcgcctgctcagcccagtaagagtgcctaactacaatttaattatcatggacgaagcccacttcacggatcccgcttctattgccgcaagggggtatatcagcactcgggttggaatgggcgaggccgctgcgatatttatgacagccaccccacctggcaccgcagaagctttcccccagtccaacgccccaattcaggacgaggagcgagacatcccggaaagatcatggaatagtgggaacgagtggatcactgattttgtcggaaagacagtgtggttcgtgcctagcattaaagcaggtaatgacatcgccaactgtctgcgcaagaacggcaagaaagtcattcaactttctaggaagacctttgatacagaataccagaaaactcgtctgaatgactgggatttcgtagtgacgaccgacatatccgagatgggggctaactttaaggccgatcgggttatcgaccccagaaggtgcctcaaaccagtgattttgacagatggacccgagcgcgtcatcctggcgggccctatgccagtgactgcagcctcagctgcccagcgaagaggtcgggttgggaggaatccccagaaggaaaacgaccaatacatcttcaccggccagcctctcaataacgatgaggaccatgctcactggacagaagcaaagatgctgcttgacaatattaacaccccggagggaataatcccagccctattcgaacccgagcgcgagaaaagtgctgccattgatggcgaatatcgtctgaagggggagagcagaaaaacttttgtggaattgatgcggaggggagacttacctgtctggctggcacacaaggtggcgtccgagggtatcaaatacacggatcgcaagtggtgcttcgacggcgaacgaaataaccagattctcgaggagaatatggatgtagaaatctggaccaaagagggggaaagaaagaagctgcggcccaggtggcttgacgcccgcacatattctgatccactggctctcaaagagtttaaggacttcgccgcaggaagaaaatcgatagctttggatctggtgactgaaatcggcagggttcctagccatctagcccaccggacccgtaacgcactggacaatctcgtcatgcttcatacatcagagcacggtgggcgcgcctaccgacacgctgtggaggaactgcccgagaccatggaaacttttttattgctgggcctcatgattctgcttacaggaggcgcgatgctgttcctcttgtccgggaagggaatcggtaaaacgagtattggcctgatctgtgtgatagtctctagcgggatgttatggatggccgatgttccactacagtggattgcatccgctatcgtgctggagtttttcatgatggtactccttattcctgagccggaaaagcaaagaaccccccaggacaaccagctggcctatgtggtcatcggaatattgactctggccgcaatcgtggctgccaatgagatgggcctcctggaaacaaccaagagggatcttggtatgtcaaaagagccaggggttgtgtctcctaccagctacctcgacgtcgacctgcatcccgcgagtgcttggacattgtatgccgtagcaactacggtgattaccccaatgctgcggcacacaatcgaaaactccactgccaatgttagcttagctgcaattgccaaccaagcggtggtcctaatgggcctggataagggatggcctatctctaaaatggacctcggcgtgccccttctggctttggggtgctactcacaggtcaacccgctgaccctcacagccgcagtgctgcttttagttacccattacgccataattggaccaggcctgcaggctaaggccactcgcgaggcacagaaaagaacggctgccggtatcatgaagaatcctacagtggatgggatcatgaccattgacctcgatcccgtaatctatgactccaagtttgagaaacaattgggacaggtgatgctgctagtcctgtgtgcggttcagctccttctgatgaggactagttgggccttgtgcgaagcactgaccctcgctacaggcccaataactaccctgtgggagggtagccccggcaagttctggaacacaacgattgccgtgtcgatggcaaatatctttcgggggtcttacttagctggagccggccttgccttctccattatgaaaagcgtcgggaccggacgaagaggcactggttcacagggggaaacactgggagagaagtggaaaaagaagctcaaccaactaagtcgcaaagaatttgatctgtataagaaatctggcatcaccgaggtggacaggactgaggcgaaggaaggtttgaaacggggcgagacaacccaccatgctgtatcccgtgggagcgcaaagctgcagtggttcgtggaaagaaatatggttatacctgagggaagggtgatcgatctcggctgtgggcgcggaggctggtcatactattgcgccggtcttaaaaaggtcacggaagtgcgggggtacaccaagggaggcccgggccacgaggagcccgtcccaatgagtacatatgggtggaacctggtgaaattgatgagcggaaaggacgttttctacctgcctcccgaaaaatgtgatactctcttatgcgacattggtgagtcctctcctagctccaccgtagaagagtcacgaacaatcagagtgctgaagatggtcgagccatggcttaaaaataaccagttttgtattaaggtgctgaatccctacatgcctactgttatcgaacacctagagaggctccagcgcaagtatggcgggatgctggtgcggaacccattgtctagaaatagtacccatgaaatgtactggatttcgaacggaacaggcaatatcgtcagctccgtgaacatggtatctcgtctgctccttaataggttcaccatgactcaccggcgccccacgatagagaaagatgtggacctgggtgctgggacacgacatgttaacgccgaaccggagacccctaacatggacgtcattggagagagaatcaagaggatcaaagaagagcactcaagcacttggcactatgatgacgaaaatccatacaagacctgggcatatcatggctcctacgaggtgaaagccacaggcagtgcttctagcatgattaacggggtggtcaagttactgacgaagccctgggatgttgtgcctatggtaacccaaatggcgatgactgacacaaccccatttggacagcagcgggtgttcaaagaaaaggtcgatactcgcacacccagagccatgccgggtaccaggaaagtgatggagataacagcagagtggttgtggcgaactctcggccggaataagaaacctcgtctgtgcaccagagaagagtttacgaagaaggttcgcaccaacgctgccatgggggcagtgttcacagaagagaatcaatgggactcagccagggctgccgtcgaagatgaggagttttggaaactagtggaccgggaaagagagcttcacaagctgggaaaatgtggctcctgcgtatataacatgatgggtaagcgcgaaaaaaagctcggggagttcggaaaagcgaagggcagtagggcaatctggtacatgtggctgggcgcccgatacttggagtttgaagctctggggttcctcaatgaggatcattggtttagccgggaaaactcttattccggagttgagggtgaaggccttcacaagctggggtacattttaagagacatctcaaaaattcccggaggcgccatgtatgcagatgacactgctggttgggacaccaggatcacagaggatgacctgcataatgaggaaaagataactcagcagatggatccagagcaccgccagttggccaacgctatcttcaaactcacctaccaaaataaggtggtcaaagtgcagcgtcctacgcccaaggggacagtgatggacattatcagccggaaggatcagagaggatcgggccaggtcggcacctatgggctgaacacttttacaaatatggaagcccaactagttaggcagatggagggagaaggtgtgctttctaaagcagacctggagaacccacacctcctggagaagaaaattacccagtggttggaaactaagggcgtagagcgcttaaaacgaatggcgatcagtggggatgactgcgtggtcaagcccatagatgaccggttcgccaatgctctgctcgcccttaacgatatgggaaaggtgagaaaagacattcctcagtggcaaccatccaagggctggcatgattggcagcaggttccgttctgtagccaccattttcacgaactgatcatgaaagacggtaggaagctagtggtcccctgccgccctcaggacgagctgatcgggagagcacggatttcacaaggagctggctggtccctcaaagaaaccgcctgtttgggcaaggcatacgcccagatgtggtctctgatgtatttccacaggcgtgatcttcgactggcgagcaacgctatatgcagtgccgtgccagtacattggatccccacatcccgcacgacctggagcattcacgcacatcaccagtggatgactacagaggacatgctcaccgtttggaatagagtgtggatcgaggataacccttggatggaagacaagactccagtcacaacctgggaggatgtgccctacttagggaaacgggaagaccaatggtgtggatctctgattggtttgacgtcaagggccacatgggctcagaatatcctgaccgccatacagcaggttcgcagtctcatcggcgatgaggagtttcttgactacatgccttccatgaagagattccggaaagaagaggaaagcgagggggcaatttggtga

SEQ ID NO: 15604 - RNA, 9873 nt, synthetic construct
  misc_feature 1..9873: note = derived and/or modified CDS sequence (opt3) from DENV-3__JQ045694__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgcaaaaaagcaagaggtcgtggtcctcggctcccaggaaggagctatgcacaccgccctgactggcgctacagagatccagaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcacaaaaaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgccatcaactggaaggggaaggaactcaaatgcggatccggcattttcgtgacaaatgaggtccacacctggactgagcagtacaagtttcaagcagactctcccaaacggctggccacagctatcgccggtgcatgggaaaacggcgtttgtgggatacgaagcaccactcgcatggagaatcttttgtggaagcagatcgctaacgaactgaattatattctctgggagaacaatatcaaactgaccgtggtggtaggagatattatcggcgtcttagaacaggggaagagaacactgacgccacagcctatggagcttaaatactcatggaagacctggggaaaggccaaaatagtgactgcggagacacaaaacagttccttcattatcgacggccccaacaccccagaatgccccagcgcctctagggcttggaatgtttgggaggtggaagactatggttttggggtcttcacaactaacatttggttgaagctccgggaggtgtacacccagtcatgtgatcatcgcctgatgagtgcagccatcaaagacgaaagagctgttcacgccgatatgggatactggatagagagccagaagaatggctcctggaaactagagaaggcatcttttatcgaagtgaagacgtgcacatggcctaaatcgcacaccctgtggagcaacggtgtactcgagtccgacatgattatcccaaagtcactggcgggcccgattagtcagcataatcacaggcccgggtatcatactcaaaccgccggaccttggcaccttggcaaattggaactggatttcaactactgcgaggggacaactgtcgtgatcaccgagaattgtggaacacgtggcccatctttacggacgaccactgtgagcggtaagctcatacacgaatggtgctgtcgatcctgcacactgccccctcttagatatatgggggaggacggatgttggtacggcatggaaattaggccaatcaacgagaaagaagagaatatggtcaagtcactggttagcgctggttctggcaaggtggataactttaccatgggggtattgtgcctcgccatcctgttcgaggaagtgatgcgcggaaaattcggcaagaaacatatgattgcaggggtcctatttactttcgtgctgctcctgtccggacagatcacatggcgggacatggctcacacccttattatgataggcagtaatgccagcgatagaatgggtatgggggttacgtatttggcactgatcgccacttttaagattcagcccttcttagctctcggatttttcctgaggaaacttacctctcgcgagaacctgctactcggcgtgggcctggcgatggccacaaccttgcaactgccggaagacatcgagcagatggcaaatgggattgctttaggactcatgactctgaagcttatcacacagtttgaaacctaccagctgtggacagccttggtctccctcacttgttcaaacaccatattcacgctgacagtggcctggcgaaccgctactctaatcctggcaggtgttagtcttctccctctgtgccaaagctcgtccatgcggaagaccgattggttgccaatgacagtggccgcgatgggcgtcccccctctgcccttatttattttctctctcaaagacactccaaagcgtagaagctggcctctgaatgagggggtaatggctgtgggacttgtttcaatcctggccagttccttgctcaggaacgatgtgcccatggcaggcccactggtcgccggtgggctactgattgcttgttatgtgatcaccggaacgtctgcagaccttacagtagagaaagccgcggacgtgacctgggaagaggaagctgagcagactggcgtcagccataacctcatgataacagttgatgacgatggcaccatgcgcattaaggacgatgaaactgagaatatcctgacagtgttgttaaaaaccgccctgctcatcgtgtccgggatttttccgtactcaatacctgcaacgctgcttgtctggcacacttggcagaagcagacccaacggagcggagtgctgtgggacgttcccagtccacccgagacacagaaagccgaattggaggaaggtgtatacagaatcaagcagcagggcattttcgggaagacccaagtgggagtcggcgtgcagaaagagggtgtttttcatacaatgtggcacgtgactaggggggctgtcctaacccacaacggaaagcgactggagcctaattgggcctctgtgaaaaaggatctcatctcctatggcggcgggtggcgcctgagcgcacagtggcaaaaaggagaagaggtacaggtcattgctgtggaaccaggtaagaaccccaagaatttccagacgatgcctggcatcttccagacaactaccggggagataggagccatcgcgcttgactttaaaccgggcacatcgggttcaccaattatcaaccgggaagggaaggttgtgggattatacggcaatggcgtcgtgaccaaaaacgggggatatgtttctggtattgcccaaactaatgcagagcccgatggccctaccccagagctggaagaggaaatgttcaagaaaagaaacctcacaatcatggacttgcatcccgggagtggaaagacgaggaagtacctgcctgctatagtgcgtgaggccattaaacgccggctcagaactctgatccttgctccgaccagggtcgtggcagccgaaatggaggaggccctgaagggcttgcccatccgatatcagacaaccgctactaaatccgaacacacaggtcgggagattgtagatctaatgtgccatgcgacctttacgatgcgcctgctcagcccaatcagagtgcctaattacaacttaataattatggacgaagcacacttcactgatcccgcctctatcgctgccagggggtatattagcacacgggttggaatgggcgaggcagccgctatctttatgaccgcgaccccacctggcactgccgaagcattcccccagtccaatgctccaatacaggacgaggagcgagacattccggaaagatcatggaacagtgggaatgagtggatcacagattttgtcggaaagaccgtgtggttcgtgcctagcatcaaagccggtaacgacattgcaaactgtctgcgcaagaatggcaagaaagtcatccaactttctaggaagacatttgatactgaataccagaaaacgcgtctgaacgactgggatttcgtagtgaccacagacatttccgagatgggggccaattttaaggctgatcgggttatagaccccagaaggtgcctcaaaccagtgatcttgactgatggacccgagcgcgtcattctggccggccctatgccagtgaccgcggcatcagccgctcagcgaagaggtcgggttgggaggaacccccagaaggaaaatgaccaatacatcttcacaggccagcctctcaacaatgatgaggaccatgcccactggaccgaagctaagatgctgcttgacaacatcaatactccggagggaattataccagcactattcgaacccgagcgcgagaaaagtgccgctatcgatggcgaatatcgtctgaagggggagagcagaaaaacgtttgtggaattgatgcggaggggagacttacctgtctggctggcccacaaggtggcatccgagggtattaaatacaccgatcgcaagtggtgcttcgacggcgaacgaaacaatcagatcctcgaggagaacatggatgtagaaatttggacaaaagagggggaaagaaagaagctgcggcccaggtggcttgacgcgcgcacttattctgatccactggccctcaaagagtttaaggacttcgctgccggaagaaaatcgatcgcattggatctggtgaccgaaataggcagggttcctagccatctagcttaccggacacgtaatgccctggacaacctcgtcatgcttcacacctcagagcatggtgggcgcgcatatcgacacgccgtggaggaactgcccgagactatggaaacattattgctgctcggcctgatgatccttctgacgggaggcgctatgctctttttgatgtccgggaagggaattggtaaaaccagtatcggcctgatttgtgtgatcgtctctagcgggatgttatggatggcggatgttccactacagtggatagcctccgcaattgtgctggagttctttatgatggtactccttatccctgagccggaaaagcaaagaactccccaggacaatcagctggcttacgtggtcattggaatcttgacactggccgccatagtggcagctaacgagatgggcctcctggaaaccaccaagagggatcttggtatgtcaaaagagccaggggttgtgtctcctacaagctatctcgacgtcgacctgcaccccgccagtgcgtggactttgtacgctgtagccacgaccgtgatcacaccaatgctgcggcatactattgaaaattccaccgcaaacgttagcttagccgctatcgcaaaccaagccgtggtcctaatgggcctggataagggatggcctatttctaaaatggacctcggcgtgccccttctggcgttggggtgctactcacaggtcaatccgctgacactcaccgctgccgtgctgcttttagttactcactatgcaatcataggaccaggcctgcaggccaaggctacgcgcgaggcccagaaaagaacagcagctggtattatgaagaaccctaccgtggatgggatcatgactatcgacctcgatcccgtaatttacgactccaagttcgagaaacaattgggacaggtgatgctgctagtcctgtgtgccgttcagctccttctgatgaggaccagttgggcgttgtgcgaagccctgacactcgcaactggcccaatcaccacactgtgggagggtagccccggcaagttttggaatacgaccatagctgtgtcgatggccaacattttccgggggtcttatttagcaggagctggccttgccttttccatcatgaaaagcgtcgggactggacgaagaggcacaggtcctcagggggaaaccctgggagagaagtggaaaaagaagctcaatcaactatcacgcaaagaattcgatctgtacaagaaaagtggcattactgaggtggacaggacagaggccaaggaaggtttgaaacggggcgagaccacgcatcacgcggtatctcgtgggtccgctaagctgcagtggtttgtggaaagaaacatggttatcccggagggaagggtgatagatctcggctgtgggcgcggaggctggagctattactgcgcaggtcttaaaaaggtcaccgaagtgcgggggtatacaaagggaggccccggccatgaggagccagtccctatgtcaacttacgggtggaatctggtgaaattgatgagtggacgagacgttttctacctgccccctgaaaagtgtgataccctcttatgcgacatcggtgagagctccccatctcccacagtagaagagagcagaactattagggtgctgaaaatggtcgagccttggcttaagaacaatcagttctgtatcaaagtgctgaacccatatatgcccaccgttattgaacacctagagcgcctccagcggaagtacggcgggatgctggtgagaaatccgttgtcccgtaactcaacacacgaaatgtattggatctctaatggaaccggcaacattgtcagttcggtgaatatggtaagcaggctgctccttaaccggtttactatgacgcatcgccgacctacaatcgagaaggatgtggacctgggtgccgggaccagacacgttaacgctgaaccagagactcccaatatggacgtcataggagagaggattaaacggatcaaggaagagcattcctctacctggcactacgatgacgaaaacccttataaaacatgggcctaccacggctcatatgaggtgaaggcaacgggcagcgcctccagtatgatcaatggggtggtcaaattactgaccaagccatgggatgttgtgcccatggtaactcaaatggctatgacagacaccactccgttcggacagcagcgcgtgtttaaggaaaaagtcgatacaagaacccctaggcccatgccaggtacacgaaaggtgatggagattactgcggagtggttgtggcggaccctcggccgtaacaaaaagcctagactgtgcacgcgcgaagagttcaccaaaaaggttaggacaaatgccgcaatgggggctgtgtttactgaagagaaccaatgggactctgcccgggcagccgtcgaagatgaggagttctggaagctagtggacagagaacgcgagcttcataaactgggaaagtgtggcagctgcgtatacaatatgatgggtaaaagggaaaagaaactcggggagtttggaaaggctaaaggctcacgagccatatggtacatgtggctgggcgcgcggtatttggagttcgaagcactggggtttctcaacgaggatcactggttctccagagaaaatagttacagcggagttgagggtgaaggccttcataagctggggtatatcttaagggacatttctaagatccccggaggcgccatgtacgctgatgacaccgccggttgggacacacgcattactgaggatgacctgcacaacgaggaaaaaatcacccagcagatggatccagagcatcgtcagttggcaaatgctatatttaagctcacgtatcaaaacaaagtggtcaaggtgcagcggcccacacctaaagggaccgtgatggacatcatttccagaaaggatcagaggggatcaggccaggtcggcacttacgggctgaatacattcaccaacatggaagcccaactagttcgccagatggagggagaaggtgtgcttagcaaggctgacctggagaatccacacctcctggagaaaaagatcactcagtggttggaaaccgagggcgtagaacgattaaaacggatggccatttcgggggatgactgcgtggtcaagccgatcgatgacagatttgcaaacgcgctgctcgcccttaacgatatgggaaaagtgaggaaggacataccccagtggcaaccttctaagggctggcacgattggcagcaggttccattctgtagtcatcacttccatgagctgattatgaaagacggtcgcaagctagtggtcccctgcagacctcaggacgaactgatcgggcgggctaggatctcccaaggagccggctggagcctcaaagagacagcatgtttgggcaaggcttatgcccagatgtggtcactgatgtactttcaccgtcgagatcttcgcctggcatccaatgccatttgctctgcggtgccagtacactggatacccacgagcagaaccacttggagtatccatgctcaccatcagtggatgacaaccgaggacatgctcactgtttggaaccgggtgtggattgaagataatccttggatggaggacaaaacaccggtcaccacgtgggaagatgtgccatacttagggaagagggaggaccaatggtgtggatccctgatcggtttgacaagccgcgccacctgggcacagaacattctgactgccatccagcaggttagatctctcataggcgatgaggaattccttgactatatgccctcaatgaagcggtttaggaaagaggaagagagtgaaggggctatctggtga

SEQ ID NO: 15605 - RNA, 9873 nt, synthetic construct
  misc_feature 1..9873: note = derived and/or modified CDS sequence (opt3) from DENV-3__GU363549__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacgagcaaggcaaggcgcataacggtcgtcttataactgcaaatccagttgtgaccaaaaaggaagagcccgtaaacattgaagccgagccgcctttcggggaatcaaatatcgtcatcggcattggagataacgctttgaaaatcaattggtataagaagggcagcagtattgggaaaatgtttgaggccacagcacgcggagccagaaggatggctatactgggtgacactgcctgggatttcggctctgtggggggagttctcaactccctgggcaagatggtgcaccagatctttggtagcgcatacaccgcgcttttctcgggggtctcttgggtgatgaaaattggcatcggagtactgttgacgtggatcggcctcaattccaagaacacatcaatgagttttagctgcattgctatagggatcattaccctgtatttaggagccgtggttcaggcagacatgggctgtgtcatcaattggaaaggtaaggagctgaagtgcgggtccggaattttcgtgactaacgaagtgcatacatggaccgagcagtacaaatttcaagccgattctcccaagcggctagctactgccatcgcaggcgcttgggaaaatggtgtctgtggcatacgaagcaccacacgcatggagaacctcctgtggaaacagatcgccaatgaacttaactatattttgtgggagaataacatcaagctgacggttgtggtgggggacaccattggagtactcgagcagggcaaaagaactctgacaccacagcctatggaattaaagtactcatggaaaacctgggggaaggcgaagatcgtcacagccgagactcaaaacagttccttcataattgatggacccaataccccagaatgccccagcgcttctagggcatggaacgtgtgggaggttgaagactatggctttggtgtgttcacgacaaatatctggctgaaacttcgggaggtctacacccagatgtgtgaccaccgcttgatgtcagccgctgtgaaggatgagagagccgttcacgcagacatggggtactggattgaaagtcagaaaaacggaagctggaagctcgagaaagcgtccctgatcgaagtgaagacttgcacctggcctaagtctcatacactatggtcgaatggcgtactggagagcgatatgataatcccaaaatccctcgccggtccgatttcacagcacaactataggcccggctaccatactcaaaccgctgggccttggcacctgggaaagcttgagttggactttaattattgcgaaggcacaacggtcgtgatcaccgagaactgtgggactcgtggaccaagtctgcggacaaccactgtgtctggcaaattaattcacgaatggtgctgtcgaagctgcacactcccccctctgagatacatgggtgaggatgggtgttggtatggaatggaaatcaggccaatatccgagaaggaggaaaatatggtcaaatcacttgttagcgccggctctggtaaggtggacaacttcaccatgggcgtactgtgcttggcaattctctttgaggaagtgatgcgcgggaagttcggaaaaaagcatatgatcgctggcgtcttcctgacgtttatgctactgctctccgggcagatcacttggcgggatatggcccacaccctgattatgatcggaagtaatgcaagcgacagaatgggcatgggtgtgacataccttgccttgattgctaccttcaaaatacagccctttctggcgttagggttctttctcaggaagctgacttctcgcgagaaccttctgctaggagttggcctcgccatggcaacaaccatccaactgccggaagatattgagcagatggctaatggcatcgccttggggctgatggccttaaaactcattacacagttcgagacttatcagctgtggaccgctcttatctccctgacgtgttcaaacacaatatttaccttgactgtggcatggcgaaccgccacactcatcctggcgggagtcagtctactgcctgtgtgccaaagctcgtccatgcggaagactgactggcttccaatgaccgttgctgccatgggtgtgccccctctccccctgttcattttttctttgaaggatacgctgaaacgtagaagctggccattaaatgaaggcgtcatggcagtagggctcgtgtcaatcctggccagttcccttctgaggaacgacgttcctatggctggacccttggtggcaggcggtctcctgattgcctgttacgtcatcacagggacctctgcggatctaactgtggagaaggctgccgacgtaacatgggaagaggaagcagagcagaccggagtgagccataacctgatgataactgtcgacgatgacggcacaatgcgcattaaagatgacgagaccgaaaatatccttacggttctcctgaagactgccttgttaatcgtgtccggcattttcccatactcaataccggctaccctgctcgtgtggcacacatggcagaaacagacccaacggagcggggtcctgtgggatgtgcctagtcccccagagacacagaaggccgaacttgaggagggagtttatagaatcaaacagcagggtattctgggcaagactcaagtaggggtgggagtccagaaggaaggcgtgtttcataccatgtggcacgttacgaggggtgcagtgttgacacacaacgggaaacgactagagcccaattgggcttctgtcaagaaagacctgatctcctacggaggcggctggcgcctcagcgcccagtggcaaaagggggaagaggtgcaggtaattgcggtcgaacctggaaaaaacccaaagaatttccagactatgcccggtacctttcagacaaccactggcgagatcggggccatagcactggatttcaagcctggaacctcgggctcaccgatcattaaccgggagggtaaagtggttgggctttatggaaatggcgtggtcacaaagaacggcgggtacgtgtctggaatcgctcaaacgaatgccgaaccagacggtcccactcctgagttagaagaggaaatgttcaaaaagagaaacctgaccattatggatctccatccaggcagtgggaaaacaaggaagtatttgcccgctatcgttcgtgaggcaataaagcgccggctgagaaccctcattctggcccctactagggtggtcgccgctgagatggaagaggcgcttaaaggactgccgatccgataccagacaaccgcaacgaagtccgaacacactggccgggagatcgtggacttgatgcgccatgccacatttaccatgagactactgagccccgtaagggtgccaaattataacctcattatcatggatgaagctcacttcaccgaccctgcctctatagcagcccggggttacattagcactcgagttgggatgggagaggctgcggccatctttatgacagcaacccccccaggcacagctgatgccttccctcagtccaatgcacccattcaggacgaggaaagagacatcccagagcgctcatggaacagtggcaatgaatggataactgattttgccgggaaaacggtctggttcgtgccgagcattaaggctggaaacgacatcgccaactgcttaaggaaaaatggtaagaaggtgatccaactgtctcgtaaaacctttgatacagagtaccagaagactaaacttaacgactgggatttcgtcgtaaccacagacatttccgagatgggcgcgaattttaaggcagatcgggtgatcgaccctagaaggtgtctgaaacccgttattctcaccgatgggccagaacgcgtgatattggccggacccatgcctgtcactgtggcttcagccgctcagcgaagaggccgggttggtaggaacccacagaaggagaatgaccaatatatcttcacggggcagcccctgaacaatgatgaagaccatgcacactggaccgaggccaagatgctcctggacaacattaatacacctgaaggcatcatcccggctctttttgagccagagcgcgaaaaaagtgccgcaattgatggagagtaccgtctaaagggcgaaagcagaaaaactttcgtggagctgatgcggaggggggacttgcccgtctggttagcgcacaaggtggcctccgaaggaataaaatataccgatcgcaagtggtgcttcgacggtcagcgaaacaatcagatcctggaggagaacatggatgtagaaatttggacaaaagagggcgaaaagaagaaactcagacctcggtggctggacgctaggacctactctgatccccttgccctgaaggagtttaaagacttcgcagctgggcgcaagtcgatcgccctcgatttggtgactgaaattggaagagttccaagccatctggcacacaggacacggaatgccctagacaacctggtcatgctccatacgtcagagcacggcggtcgtgcttatcgccacgcggtggaggaacttcctgagaccatggaaactctgttattgctggggctcatgatcctgcttacaggcggagccatgctgtttctcatatccggcaaagggatcggaaagaccagtattggtttgatctgcgtgattgcatctagcggcatgctgtggatggctgagatccccttacaatggatagcctccgccattgtcctagagttctttatgatggttctgctcatcccagaacctgagaagcagcgaaccccgcaggataatcaacttgcatacgtggtaattgggatcctgacattggctgccataatcgcggctaacgaaatgggactgctcgagactacgaaaagagacctgggcatgtcaaaggaacccggtgtggtctctccaaccagctatcttgatgtggacctccatcctgccagtgcatggacactgtacgccgttgctactaccgtgattacacccatgttgaggcacaccatcgagaattccactgcaaacgtcagcctggccgcgattgctaaccaggccgtagtgttaatggggctagacaaaggctggccaatctctaagatggatctgggagttcctctccttgcactgggctgttactcacaggtgaatcccttgacgctgacagccgctgtcctcctgcttgtgacccattatgccataattgggccgggattacaggcaaaagctactcgggaggcccaaaagcgcaccgcggccggcatcatgaagaacccaacagtcgacggtatcattactatcgatctggaccctgtgatatacgattccaaattcgaaaagcagctcgggcaggttatgttgctggtgctatgcgcagtacagctgctccttatgagaaccagttgggctctgtgtgaggccttgacactggcaacgggacccattaccactctctgggaaggcagcccaggtaaattttggaatacaaccatcgctgtgtcgatggccaacattttcaggggctcttatctggccggggcgggattagctttttccatcatgaagagcgtcggcactgggaaacggggaacaggctcacaaggtgagacccttggggaaaagtggaagaaaaagctgaatcagctcagtcgaaaagagttcgacctatacaagaaatctggaataacggaggttgatagaaccgaagcaaaggagggcctgaaacgcggtgaaacaactcaccatgccgtgtccaggggcagcgctaagttgcagtggtttgtcgagcggaacatggtgatccccgaagggcgtgtaattgacctgggatgcggcagagggggatggtcatattactgtgccggcctcaagaaagtgaccgaggttaggggttatacaaaggggggacctggccacgaggaaccggtgcccatgagtactcacggctggaatatcgtcaaacttatgagcgggaaggatgtgttctacctgccacctgagaaatgcgacaccttgctgtgtgatattggagaatcctctcccagccctacagtcgaggagtcccgcaccatccgggtgctcaagatggttgaaccatggttaaagaacaatcagttttgcattaaagtactgaacccctacatgcctgcagtgatcgagcatcttgaacgactgcaaagaaagcacggtggcatgctagtcaggaatccactctcacgcaactctactcatgagatgtattggataagtaatgggacgggaaacattgtgtcgagcgttaatatggtgtcccggctgttgctgaacagattcacaatgacccaccgtaggcccactatcgaaaaagacgtcgatctcggcgccggtacccggcacgtgaacgctgagccggagacacctaatatggacgtaatcggggaacgcattcgaagaataaaggaggaacataactctacgtggcactacgacgatgagaatccatataaaacctgggcgtaccatggatcatatgaagtgaaggccactggcagcgcatccagtatgatcaacggcgttgtcaagcttctgacaaaaccctgggacgtggtgcctatggtcacccagatggctatgactgatacaaccccattcgggcagcaaagggtttttaaggagaaagtggacacacggactccccgcccgatgcctggaaccagaaaggtaatggagattacggccgaatggttatggaggaccctgggtcgaaataaacggccccgtttgtgtacaagagaggaattcactaagaaggtgcgcaccaacgcagccatgggcgctgtctttacagaggaaaatcagtgggattctgccaaagcggcagtggaggacgaggaattctggaagctcgttgatagggagcgggaactgcacaaactagggaagtgcggaagctgtgtgtacaacatgatgggcaaaagagagaagaaacttggtgagtttgggaaggccaagggatcacgcgctatctggtatatgtggctgggcgccaggtacctcgaattcgaggcactgggctttttgaatgaagaccattggttctcccgagagaacagttacagcggggtcgaaggagagggtctgcacaaactcggctatattcttcgggatatctctaagataccagggggagctatgtacgccgacgatactgctggctgggacaccagaatcacggaggacgatctgcacaatgaagagaaaattacacagcagatgaaccctgaacataggttactggccaatgcaatctttaagttgacctatcaaaacaaagtggtaaaggttcagcgccccactccaacaggtaccgtgatggacattatctcccgtaaggatcagcgggggtcaggacaggtcggcacttacggcctcaataccttcacaaacatggaggcgcaactggtgagacagatggaaggggagggagtgctaagcaaagccgaccttgagaacccccacctgcctgaaaagaaaataacgcagtggctcgagaccaagggtgtcgaaaggctgaaacgcatggctatttcgggcgatgactgcgttgtgaagccaatcgatgaccgatttgccaatgcattgttagctctgaacgatatggggaaggtacggaaagacatcccgcagtggcaaccctctaagggatggcatgattggcagcaggtgcctttctgcagtcaccactttcatgagctcattatgaaagacggcagaaagcttgtcgtgccatgtaggccccaggatgaactgataggtcgcgccagaatctcccaaggggcaggatggagcctacgggagactgcctgcctgggcaaagcgtatgctcagatgtggtcactcatgtacttccacaggcgtgacttgcgactggcctccaatgcaatttgttctgccgttcctgtgcattgggtcccaacaagccgcaccacttggagtatccacgctcatcaccagtggatgacaaccgaggacatgcttacggtgtggaacagagtatggattgaagataatccctggatggaggacaagacacctgttaccacttgggaaaacgtgccgtatctgggcaagcgggaggatcaatggtgcgggtccctcatcggattaaccagcagggccacatgggcacagaatatatctactgctatccagcaggtccgctcactgattggtaacgaggaattcttggactacatgccaagtatgaaaagatttcggaaggaggaagagtccgaaggcgccatctggtga

SEQ ID NO: 15606 - RNA, 9873 nt, synthetic construct
  misc_feature 1..9873: note = derived and/or modified CDS sequence (opt3) from DENV-3__KJ622197__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaatcacagagacccctacttggaataggaaagaactgttggtaacatttaagaacgctcacgccaaaaagcaagaggttgtggtcctcggctcacaggaaggagctatgcacacggccctgaccggcgcaactgagattcagaatagtgggggaacaagcatattcgccggtcatttaaagtgtcggctgaaaatggataagctagaactcaaaggcatgtcttatgctatgtgcctgaacacctttgtgcttaagaaagaggtctccgagacacagcacgggactatcttgattaaggtggaatacaagggagaggacgcgccatgtaaaatccccttctcaaccgaagatggccaaggtaaggcacataacgggcgtctgataacggccaatcctgttgtgaccaaaaaggaggagccagtaaacattgaagctgagcccccgttcggcgaaagcaatatcgtcatcggaattggcgacaaagccctcaagatcaactggtacaagaaagggagttctattggaaagatgtttgaggcaacagcccgcggtgctagaaggatggccatactgggcgatactgcatgggacttcgggtccgtgggaggcgttcttaatagcctgggtaaaatggtgcaccagatctttgggtcggcgtataccgctttgttcggcggagtctcttggattatgaagatcggcatcggggtgctcctgacatggattggattaaactccaaaaatacttcaatgagttttagctgcatagtaatcggcattatcaccctgtacctaggtacggtggttcaggccgatatggggtgtgtcattaactggaagggaaaggaactcaaatgcggctccggtatcttcgtgacaaatgaggtgcatacctggactgagcagtataagtttcaagcagactctcctaaacggctggccacagctatagccggcgcatgggaaaacggggtctgtggaatccgaagcaccactcgcatggagaatcttttgtggaagcagattgctaacgaactgaattacatcctctgggagaacaatattaaactgaccgttgtggtgggcgatatcataggggtattagaacagggaaagagaacactgacgccccagccaatggagcttaaatattcatggaagacctggggcaaggccaaaattgtcactgcggagatccaaaacagttccttcattatcgacggtcctaacacacccgaatgcccaagcgcctctagggcttggaatgtgtgggaggttgaagactacgggtttggagtgttcaccacaaacatatggttgaagctccgggaggtctatactcagacctgtgatcaccgcctgatgtcagcagccatcaaagacgaaagagctgtgcacgccgatatgggctactggattgagagtcagaagaatggtagctggaaactagagaaggcatcctttatcgaagttaagacgtgcacatggcccaaatctcataccctgtggtcgaacggcgtgctcgagagcgacatgattatccctaagtccctggcggggccaatatcacagcacaatcataggccgggataccacactcaaaccgccggcccctggcaccttgggaaattggaactggatttcaactattgcgagggaacaactgtagtcattaccgagaattgtggcacacgtggtcctagtttacggacgaccactgtgtctgggaagctcatccatgaatggtgctgtcgaagctgcacactgccaccccttagatacatgggagaggacggctgttggtatggtatggaaatcaggcctattaacgagaaagaagagaatatggtgaagtccctggtctcagctggcagcgggaaggttgataactttaccatgggagtgttgtgcctcgccatcctgttcgaggaagtaatgcgcggcaaattcgggaagaaacacatgattgcaggagtgctactgacttttatgctcctgctttctggccagataacatggcgggacatggctcataccttgatcatgattggttccaatgccagtgatagaatggggatgggagtcacgtacctggcattaatcgccactttcaagattcagccatttctcgctctgggcttctttcttaggaaactgaccagccgcgagaacctactcctgggcgtggggttggcgatggccacaaccctgcaattacccgaagacatcgagcagatggcaaatggaatagctctcggtctgatggcccttaagctgatcactcagttcgaaacatatcagttgtggaccgccctcgtttctctgacatgttccaacactatttttaccctaacggtggcttggcgaacagcaaccctgatccttgccggcgtctcactcctgccggtgtgccaaagtagctcgatgcggaagactgattggttgcctgttgcggtggctgccatgggggtcccacccctgcctttattcattttttccctcaaagacaccctgaagcgtagatcttggccccttaatgagggagtaatggcagtgggcctggttagcatcttggcctcaagtctcctgaggaacgatgtgccaatggctggtcctctagtcgcagggggactgcttatagcctgttacgtgattacaggcacttccgcggacctcaccgtagagaaagctgccgacgtgacgtgggaagaggaagcagagcagacaggcgtctctcacaacctgatgatcaccgttgatgacgatgggactatgcgcatcaaggacgatgaaacagagaatattttgaccgtgttactgaaaactgccctcctgatagtgagcggaatcttcccctattccattccagctacacttctggtctggcatacctggcagaagcagacgcaacggtcaggtgtgttgtgggacgttccgagccctcccgagactcagaaagccgaactagaggaaggcgtatacagaatcaagcagcaggggatttttggaaagacccaagtgggcgtcggtgtgcagaaagagggggttttccacacaatgtggcacgtgaccaggggagcagtcctgacacataacggcaagcgactcgagccaaattgggctagtgtgaaaaaggatctgatctcttacggcgggggatggcgcctttccgcccagtggcaaaaaggtgaagaggtacaggtcatagcggtggaacccggccggaaccctaagaattttcagactatgccagggatcttccagaccacgacaggagagattggcgccatcgcattagacttcaagcccggtactagcgggtcgcctattatcaacagagaaggaaaagttgtgggcctgtatggcaatggggtcgtgaccaagaacggaggttacgtttcaggcatagctcaagccaatgctgagccggatgggccaacacccgagctcgaagaggaaatgtttaaaaagaggaacttgaccattatggacctgcaccctggatctggcaaaactcgtaagtatctcccagcaatcgtgcgcgaggccatcaagcggagactgaggacccttattctggcccccacacgagtcgtggctgcggaaatggaggaggcattgaaaggtctacctatccggtaccagacgactgccaccaagagtgaacatacagggcgcgagatagtagatctgatgtgccacgctaccttcactatgagactcttatccccggtgagggttcccaattataacctgattatcatggacgaagcccattttacagatccagcaagcattgccgctcggggatacatctctacccgagtcggcatgggcgaggcggccgcaatattcatgacggctactcctcccgggacagccgaagcatttccacagagcaatgcccctattcaggacgaggagagagacatccccgaacgctcctggaactcaggaaatgagtggatcaccgatttcgtgggtaaaaccgtgtggtttgtcccaagtattaaggctggcaacgacatcgccaactgtcttaggaaaaatgggaagaaggtaattcaactgagccgtaaaactttcgatacagaatatcagaagaccaaactcaacgactgggattttgtggttacaactgacatatctgagatgggagcgaatttcaaggcagatcgggtgatcgacccgagaaggtgcttgaaacctgtcattctgacggatggccccgagcgcgtgatcctcgccggtccaatgcccgttaccgctgcctccgctgcacagcgaagagggcgggtgggcaggaaccctcagaaggaaaatgaccaatacatctttacaggacagccactgaacaatgatgaggaccacgcccactggactgaagctaagatgcttctagacaacattaatacccccgagggcataatccctgccctgttcgaaccggagcgcgagaaatcagcagcgattgatggggaataccgtttgaagggagagagtagaaaaacattcgtcgaattaatgcggaggggtgacctgccagtgtggctcgcccataaggtagctagcgagggcatcaaatataccgatcgcaagtggtgctttgacggggaacgaaacaatcagattctggaggagaacatggatgtggaaatctggactaaagagggagaaagaaagaagcttcggcccaggtggctggacgcccgcacgtactccaatcctctcgcattgaaagagttcaaggattttgctgccggcagaaaatctatagcactggacctagttaccgaaatcggtagggtcccctcgcacctggcccatcggacacgtaacgctctcgataatcttgtgatgctgcacactagcgagcacgggggccgcgcgtatcgacatgccgtggaggaattaccagagaccatggaaacattgctgctcctgggacttatgattctgctcaccggcggggcaatgttgttcctgatctcaggaaagggtattggcaaaacttccatcgggttaatatgtgtcattgttagttctggaatgctatggatggctgacgtgcctctgcagtggatcgccagcgccattgtactcgagtttttcatgatggtgcttctgatccccgagccagaaaagcaaagaacacctcaggataaccagttggcatacgtcgtgataggcatcctgacgctcgctgccattgttgcggctaatgagatgggtctgcttgaaaccactaagagggacctcgggatgtccaaagagccgggcgtggtctcacccacatcttatctggatgtagacttgcacccagccagcgcatggaccctgtacgccgtggctaccacagttatcactcctatgttacggcatacgattgaaaacagtaccgcaaacgtgtccctagccgcgatcgctaatcaagccgtcgtgctgatgggactcgacaagggctggcccataagcaaaatggatcttggggtcccactgttggcactgggatgctattctcaggtgaaccctctcacactgactgccgctgttcttttactggtgacccactacgccattatcggccccggtctccaggcaaaggctacacgcgaggcccagaaaagaaccgcggccgggatcatgaagaatccgactgtagacggaattatgacgatcgatttggacccagtgatatacgattcaaagtttgagaaacaactgggccaggtcatgctactggttctctgtgcagtgcagcttctgttgatgaggacatcctgggctctgtgcgaagccctcaccctggcaactggtcctattaccacattatgggagggcagtcccgggaagttctggaacactaccatcgctgtcagcatggccaatatttttcggggatcgtatcttgccggcgcggggctggctttctctatcatgaaatccgtgggaacaggcaagcgaggtacggggagccagggagaaaccctcggcgagaaatggaagaagaaactaaaccaactgtcaagacgcgaatttgagttgtacaagaaaagtggtataactgaggtagacaggacagaagcaaaggagggcctgaaacggggggaaaccactcatcacgccgtgtctcgtggatccgctaagctccagtggttcgttgagagaaatatggtgatcccagaaggcagggtcattgatcttgggtgtggacgcggcggttggagctattactgcgccgggctgaaaaaggtgacagaggtccggggatataccaagggcggccccgggcacgaggaacctgtgccgatgtcaacgtacggatggaacaccgttaaattgatgagtggtaaggacgtattttatctgcccccagagaaatgtgatacactcttatgcgacatcggcgaaagctccccttctcccactgtggaggagagccgaaccattagagtcctgaagatggtggaaccttggcttaaaaataaccagttctgtatcaaggttctgaatccatacatgcccacagtgattgagcatctagaaaggctccagcgcaagcacgggggaatgctggtccggaaccctttgtccagaaattcaactcatgagatgtactggatctctaacggcaccggtaatatagtgagttcggtaaacatggtgagccgtctgctccttaacaggttcacaatgacccaccggcgcccaactattgaaaaagatgttgacctgggggcaggaacgcgacacgtcaatgccgagcccgagacaccgaacatggatgtgatcggcgaaagaatcaagaggattaaagaggaacattcctctacctggcactatgacgacgagaatccttacaagacttgggcttatcatggctcatacgaagtgaaagcgaccgggagcgcctccagtatgataaacggagtcgttaagttactgacaaagccatgggatgtggtacccatggtgacgcaaatggcaatgaccgacactacaccttttggtcagcagcgggtcttcaaagagaaggtggatacccgcactccaagacccatgccgggcacaaggaaagttatggagatcaccgctgaatggttgtggcgaacactcgggcggaataagcgtcctagactgtgcactcgcgaggaatttaccaaaaaggtgaggacgaacgccgcaatgggagccgtcttcaccgaggaaaatcaatgggagtctgctcgggccgcggtggaggacgaagagttttggaagctagtaggcagagaacgcgagcttcacaaactgggtaagtgtgggagctgcgtttataacatgatgggaaaaagggagaagaaactcggcgaattcggcaaggcaaaagggtcacgagccatttggtacatgtggctgggagctcggtatttggagtttgaagccctgggtttcctcaatgaggatcattggttttccagagaaaacagttacagcggcgtggagggggagggacttcacaagctgggctacatcttaagggacatttctaagatccccggtggggcaatgtatgctgatgacacagccggatgggatactcgcataaccgaagacgatctgcacaatgaggaaaaaatcacacagcagatggacccagagcatcgtcagttggctaacgccattttcaagctcacttaccaaaataaagtcgtgaaggtgcagcggcctacccccaaaggcacggtcatggacatcatttccagaaaggatcagaggggctcagggcaggttggaacatatggtctgaacacctttactaatatggaagcacaactaatccgccagatggagggcgagggggtgcttagcaaggcggacctggaaaacccacacctcctggagaaaaagataacacagtggttggaaaccaaaggagtagagcgattaaagcggatggccatttcgggcgatgactgcgtggtcaaacccatcgatgacagattcgctaacgccctgctcgcacttaatgatatgggtaaggtgaggaaggacatccctcagtggcaaccatctaaagggtggcatgattggcagcaggttccgttttgtagtcaccacttccatgaactgattatgaaggacggacgcaaactagtggtcccctgcagacctcaggatgagctgataggccgggctaggatctcccaaggcgccgggtggagcctcaaggagactgcatgtttgggaaaagcctacgcgcagatgtggtcactgatgtatttccaccgtcgagaccttcgcctggcttccaacgccatttgctctgcagtgccagtacattgggttcccaccagcagaacaacgtggagtatccacgcccatcaccagtggatgaccactgaagatatgctcacagtgtggaatcgggtctggattgaggacaacccttggatggaagacaagaccccagtgactacatgggaggatgttccctacttaggtaagagggaggaccaatggtgtggctccctgatcgggttgaccagccgcgctacgtgggcccagaatatactgacagcaatccagcaggtgagatctctcattggagatgaagagtttcttgactatatgccttcaatgaaacggttcaggaaggaagaggaaagtgagggcgctatctggtga

SEQ ID NO: 15607 - RNA, 9873 nt, synthetic construct
  misc_feature 1..9873: note = derived and/or modified CDS sequence (opt3) from DENV-3__KJ622198__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaatcacagagacccctacttggaataggaaagaactgttggtaacatttaagaacgctcacgccaaaaagcaagaggttgtggtcctcggctcacaggaaggagctatgcacacggccctgaccggcgcaactgagattcagaatagtgggggaacaagcatattcgccggtcatttaaagtgtcggctgaaaatggataagctagaactcaaaggcatgtcttatgctatgtgcctgaacacctttgtgcttaagaaagaggtctccgagacacagcacgggactatcttgattaaggtggaatacaagggagaggacgcgccatgtaaaatccccttctcaaccgaagatggccaaggtaaggcacataacgggcgtctgataacggccaatcctgttgtgaccaaaaaggaggagccagtaaacattgaagctgagcccccgttcggcgaaagcaatatcgtcatcggaattggcgacaaagccctcaagatcaactggtacaagaaagggagttctattggaaagatgtttgaggcaacagcccgcggtgctagaaggatggccatactgggcgatactgcatgggacttcgggtccgtgggaggcgttcttaatagcctgggtaaaatggtgcaccagatctttgggtcggcgtataccgctttgttcggcggagtctcttggattatgaagatcggcatcggggtgctcctgacatggattggattaaactccaaaaatacttcaatgagttttagctgcatagtaatcggcattatcaccctgtacctaggtacggtggttcaggccgatatggggtgtgtcattaactggaagggaaaggaactcaaatgcggctccggtatcttcgtgacaaatgaggtgcatacctggactgagcagtataagtttcaagcagactctcctaaacggctggccacagctatagccggcgcatgggaaaacggggtctgtggaatccgaagcaccactcgcatggagaatcttttgtggaagcagattgctaacgaactgaattacatcctctgggagaacaatattaaactgaccgttgtggtgggcgatatcataggggtattagaacagggaaagagaacactgacgccccagccaatggagcttaaatattcatggaagacctggggcaaggccaaaattgtcactgcggagatccaaaacagttccttcattatcgacggtcctaacacacccgaatgcccaagcgcctctagggcttggaatgtgtgggaggttgaagactacgggtttggagtgttcaccacaaacatatggttgaagctccgggaggtctatactcagacctgtgatcaccgcctgatgtcagcagccatcaaagacgaaagagctgtgcacgccgatatgggctactggattgagagtcagaagaatggtagctggaaactagagaaggcatcctttatcgaagttaagacgtgcacatggcccaaatctcataccctgtggtcgaacggcgtgctcgagagcgacatgattatccctaagtccctggcggggccaatatcacagcacaatcataggccgggataccacactcaaaccgccggcccctggcaccttgggaaattggaactggatttcaactattgcgagggaacaactgtagtcattaccgagaattgtggcacacgtggtcctagtttacggacgaccactgtgtctgggaagctcatccatgaatggtgctgtcgaagctgcacactgccaccccttagatacatgggagaggacggctgttggtatggtatggaaatcaggcctattaacgagaaagaagagaatatggtgaagtccctggtctcagctggcagcgggaaggttgataactttaccatgggagtgttgtgcctcgccatcctgttcgaggaagtaatgcgcggcaaattcgggaagaaacacatgattgcaggagtgctactgacttttatgctcctgctttctggccagataacatggcgggacatggctcataccttgatcatgattggttccaatgccagtgatagaatggggatgggagtcacgtacctggcattaatcgccactttcaagattcagccatttctcgctctgggcttctttcttaggaaactgaccagccgcgagaacctactcctgggcgtggggttggcgatggccacaaccctgcaattacccgaagacatcgagcagatggcaaatggaatagctctcggtctgatggcccttaagctgatcactcagttcgaaacatatcagttgtggaccgccctcgtttctctgacatgttccaacactatttttaccctaacggtggcttggcgaacagcaaccctgatccttgccggcgtctcactcctgccggtgtgccaaagtagctcgatgcggaagactgattggttgcctgttgcggtggctgccatgggggtcccacccctgcctttattcattttttccctcaaagacaccctgaagcgtagatcttggccccttaatgagggagtaatggcagtgggcctggttagcatcttggcctcaagtctcctgaggaacgatgtgccaatggctggtcctctagtcgcagggggactgcttatagcctgttacgtgattacaggcacttccgcggacctcaccgtagagaaagctgccgacgtgacgtgggaagaggaagcagagcagacaggcgtctctcacaacctgatgatcaccgttgatgacgatgggactatgcgcatcaaggacgatgaaacagagaatattttgaccgtgttactgaaaactgccctcctgatagtgagcggaatcttcccctattccattccagctacacttctggtctggcatacctggcagaagcagacgcaacggtcaggtgtgttgtgggacgttccgagccctcccgagactcagaaagccgaactagaggaaggcgtatacagaatcaagcagcaggggatttttggaaagacccaagtgggcgtcggtgtgcagaaagagggggttttccacacaatgtggcacgtgaccaggggagcagtcctgacacataacggcaagcgactcgagccaaattgggctagtgtgaaaaaggatctgatctcttacggcgggggatggcgcctttccgcccagtggcaaaaaggtgaagaggtacaggtcatagcggtggaacccggccggaaccctaagaattttcagactatgccagggatcttccagaccacgacaggagagattggcgccatcgcattagacttcaagcccggtactagcgggtcgcctattatcaacagagaaggaaaagttgtgggcctgtatggcaatggggtcgtgaccaagaacggaggttacgtttcaggcatagctcaagccaatgctgagccggatgggccaacacccgagctcgaagaggaaatgtttaaaaagaggaacttgaccattatggacctgcaccctggatctggcaaaactcgtaagtatctcccagcaatcgtgcgcgaggccatcaagcggagactgaggacccttattctggcccccacacgagtcgtggctgcggaaatggaggaggcattgaaaggtctacctatccggtaccagacgactgccaccaagagtgaacatacagggcgcgagatagtagatctgatgtgccacgctaccttcactatgagactcttatccccggtgagggttcccaattataacctgattatcatggacgaagcccattttacagatccagcaagcattgccgctcggggatacatctctacccgagtcggcatgggcgaggcggccgcaatattcatgacggctactcctcccgggacagccgaagcatttccacagagcaatgcccctattcaggacgaggagagagacatccccgaacgctcctggaactcaggaaatgagtggatcaccgatttcgtgggtaaaaccgtgtggtttgtcccaagtattaaggctggcaacgacatcgccaactgtcttaggaaaaatgggaagaaggtaattcaactgagccgtaaaactttcgatacagaatatcagaagaccaaactcaacgactgggattttgtggttacaactgacatatctgagatgggagcgaatttcaaggcagatcgggtgatcgacccgagaaggtgcttgaaacctgtcattctgacggatggccccgagcgcgtgatcctcgccggtccaatgcccgttaccgctgcctccgctgcacagcgaagagggcgggtgggcaggaaccctcagaaggaaaatgaccaatacatctttacaggacagccactgaacaatgatgaggaccacgcccactggactgaagctaagatgcttctagacaacattaatacccccgagggcataatccctgccctgttcgaaccggagcgcgagaaatcagcagcgattgatggggaataccgtttgaagggagagagtagaaaaacattcgtcgaattaatgcggaggggtgacctgccagtgtggctcgcccataaggtagctagcgagggcatcaaatataccgatcgcaagtggtgctttgacggggaacgaaacaatcagattctggaggagaacatggatgtggaaatctggactaaagagggagaaagaaagaagcttcggcccaggtggctggacgcccgcacgtactccaatcctctcgcattgaaagagttcaaggattttgctgccggcagaaaatctatagcactggacctagttaccgaaatcggtagggtcccctcgcacctggcccatcggacacgtaacgctctcgataatcttgtgatgctgcacactagcgagcacgggggccgcgcgtatcgacatgccgtggaggaattaccagagaccatggaaacattgctgctcctgggacttatgattctgctcaccggcggggcaatgttgttcctgatctcaggaaagggtattggcaaaacttccatcgggttaatatgtgtcattgttagttctggaatgctatggatggctgacgtgcctctgcagtggatcgccagcgccattgtactcgagtttttcatgatggtgcttctgatccccgagccagaaaagcaaagaacacctcaggataaccagttggcatacgtcgtgataggcatcctgacgctcgctgccattgttgcggctaatgagatgggtctgcttgaaaccactaagagggacctcgggatgtccaaagagccgggcgtggtctcacccacatcttatctggatgtagacttgcacccagccagcgcatggaccctgtacgccgtggctaccacagttatcactcctatgttacggcatacgattgaaaacagtaccgcaaacgtgtccctagccgcgatcgctaatcaagccgtcgtgctgatgggactcgacaagggctggcccataagcaaaatggatcttggggtcccactgttggcactgggatgctattctcaggtgaaccctctcacactgactgccgctgttcttttactggtgacccactacgccattatcggccccggtctccaggcaaaggctacacgcgaggcccagaaaagaaccgcggccgggatcatgaagaatccgactgtagacggaattatgacgatcgatttggacccagtgatatacgattcaaagtttgagaaacaactgggccaggtcatgctactggttctctgtgcagtgcagcttctgttgatgaggacatcctgggctctgtgcgaagccctcaccctggcaactggtcctattaccacattatgggagggcagtcccgggaagttctggaacactaccatcgctgtcagcatggccaatatttttcggggatcgtatcttgccggcgcggggctggctttctctatcatgaaatccgtgggaacaggcaagcgaggtacggggagccagggagaaaccctcggcgagaaatggaagaagaaactaaaccaactgtcaagacgcgaatttgagttgtacaagaaaagtggtataactgaggtagacaggacagaagcaaaggagggcctgaaacggggggaaaccactcatcacgccgtgtctcgtggatccgctaagctccagtggttcgttgagagaaatatggtgatcccagaaggcagggtcattgatcttgggtgtggacgcggcggttggagctattactgcgccgggctgaaaaaggtgacagaggtccggggatataccaagggcggccccgggcacgaggaacctgtgccgatgtcaacgtacggatggaacaccgttaaattgatgagtggtaaggacgtattttatctgcccccagagaaatgtgatacactcttatgcgacatcggcgaaagcctgccttcccccactgtggaggagtctcgaaccattagagtccttaagatggtggaaccttggctgaaaaataaccagttctgtatcaaggttctaaatccatacatgcccacagtgattgagcatctcgaaaggctgcagcgcaagcacgggggaatgttggtccggaaccctctgagcagaaattccactcatgagatgtactggatctcaaacggcaccggtaatatagtgtctagtgtaaacatggtgtcgcgtctccttctgaacaggttcacaatgacccaccggcgcccaactattgaaaaagatgttgacttaggggcaggaacgcgacacgtcaatgccgagcccgagacaccgaacatggatgtgatcggcgaaagaatcaagaggattaaagaggaacatagctccacctggcactatgacgacgagaatccttacaagacttgggcttatcatggctcttacgaagtgaaagcgaccgggtcagccagctccatgataaacggagtcgttaagctgttgacaaagccatgggatgtggtacccatggtgacgcaaatggcaatgaccgacactacaccttttggtcagcagcgggtcttcaaagagaaggtggatacccgcactccaagacccatgccgggcacaaggaaagttatggagatcaccgctgaatggctctggcgaacactggggcggaataagcgtcctagactatgcactcgcgaggaatttaccaaaaaggtgaggacgaacgccgcaatgggagccgtcttcaccgaggaaaatcaatgggagagtgctcgggccgcggtggaggacgaagagttttggaagcttgtaggcagagaacgcgagctgcacaaactcggtaagtgtgggtcttgcgtttataacatgatgggaaaaagggagaagaaactgggcgaattcggcaaggcaaaagggagccgagccatttggtacatgtggttgggagctcggtatctggagtttgaagccctcggtttccttaatgaggatcattggttttcaagagaaaactcctacagtggcgtggagggggagggactgcacaagttaggctacatcctgagggacattagcaagatccccggtggggcaatgtatgctgatgacacagccggatgggatactcgcataaccgaagacgatttgcacaatgaggaaaaaatcacacagcagatggacccagagcatcgtcagctcgctaacgccattttcaagctgacttaccaaaataaagtcgtgaaggtgcagcggcctacccccaaaggcacggtcatggacatcatttctagaaaggatcagaggggctccgggcaggttggaacatatggtctaaacacctttactaatatggaagcacaacttatccgccagatggagggcgagggggtgctgtcaaaggcggacctcgaaaacccacacctgttggagaaaaagataacacagtggttagaaaccaaaggagtagagcgactgaagcggatggccattagcggcgatgactgcgtggtcaaacccatcgatgacagattcgctaacgccctccttgcactgaatgatatgggtaaggtgaggaaggacatccctcagtggcaaccatcgaaagggtggcatgattggcagcaggttccgttttgttctcaccacttccatgaactaattatgaaggacggacgcaaactggtggtcccctgcagacctcaggatgagctcataggccgggctaggatcagtcaaggcgccgggtggtccttgaaggagactgcatgtctgggaaaagcctacgcgcagatgtggagccttatgtatttccaccgtcgagacctgcgcctcgcttcaaacgccatttgctccgcagtgccagtacattgggttcccacctctagaacaacgtggagcatccacgcccatcaccagtggatgaccactgaagatatgttaacagtgtggaatcgggtctggattgaggacaacccttggatggaagacaagaccccagtgactacatgggaggatgttccctacctgggtaagagggaggaccaatggtgtggcagtttgatcgggctgacctcccgcgctacgtgggcccagaatatactcacagcaatccagcaggtgagaagccttattggagatgaagagtttctggactatatgccttctatgaaacggttcaggaaggaagaggaatcagagggcgctatctggtga

SEQ ID NO: 15608 - RNA, 9873 nt, synthetic construct
  misc_feature 1..9873: note = derived and/or modified CDS sequence (opt3) from DENV-3__KJ622191__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgaggtgatcctgctcactatgaaaaacaaggcctggatggtacatagacagtggtttttcgacctgccgcttccctggacctccggggcaatcacagagacccctacttggaataggaaagaactgttggttacatttaagaacgctcacgccaaaaagcaagaggtggtcgtgctcggctcacaggaaggagctatgcacacggccctgaccggcgcaactgagattcagaatagtgggggaacaagcatattcgccggtcatttaaagtgtcggctgaaaatggataagctagaactcaaaggcatgtcttatgctatgtgcctgaacacctttgtccttaagaaagaggtgtccgagacacagcacgggactatcttgattaaggttgaatacaagggagaggacgcgccatgtaaaatccccttctcaaccgaagatggccaaggtaaggcacataacgggcgtctgataacggccaatcctgtggtaaccaaaaaggaggagccagtcaacattgaagctgagcccccgttcggcgaaagcaatatcgtgatcggaattggcgacaaagccctcaagatcaactggtacaagaaagggagttctattggaaagatgtttgaggcaacagcccgcggtgctagaaggatggccatactgggcgatactgcatgggacttcgggtccgttggaggcgtgcttaatagcctgggtaaaatggtccaccagatctttgggtcggcgtataccgctttgttcggcggagtgtcttggattatgaagatcggcatcggggtactcctgacatggattggattaaactccaaaaatacttcaatgagttttagctgcatagtgatcggcattatcaccctgtacctaggtacggttgtccaggccgatatggggtgtgtgattaactggaagggaaaggaactcaaatgcggctccggtatcttcgtgacaaatgaggtccatacctggactgagcagtataagtttcaagcagactctcctaaacggctggccacagctatagccggcgcatgggaaaacggggtttgtggaatccgaagcaccactcgcatggagaatcttttgtggaagcagattgctaacgaactgaattacatcctctgggagaacaatattaaactgaccgtggtggtaggcgatatcataggggtcttagaacagggaaagagaacactgacgccccagccaatggagcttaaatattcatggaagacctggggcaaggccaaaattgtgactgcggagatccaaaacagttccttcattatcgacggtcctaacacacccgaatgcccaagcgcctctagggcttggaatgtttgggaggtggaagactacgggtttggagtcttcaccacaaacatatggttgaagctccgggaggtgtatactcagacctgtgatcaccgcctgatgtcagcagccatcaaagacgaaagagctgttcacgccgatatgggctactggattgagagtcagaagaatggtagctggaaactagagaaggcatcctttatcgaagtgaagacgtgcacatggcccaaatctcataccctgtggtcgaacggcgtactcgagagcgacatgattatccctaagtccctggcggggccaatatcacagcacaatcataggccgggataccacactcaaaccgccggcccctggcaccttgggaaattggaactggatttcaactattgcgagggaacaactgtcgtgattaccgagaattgtggcacacgtggtcctagtttacggacgaccactgtgtctgggaagctcatccatgaatggtgctgtcgaagctgcacactgccaccccttagatacatgggagaggacggctgttggtatggtatggaaatcaggcctattaacgagaaagaagagaatatggtcaagtccctggtttcagctggcagcgggaaggtggataactttaccatgggagtattgtgcctcgccatcctgttcgaggaagtgatgcgcggcaaattcgggaagaaacacatgattgcaggagtcctactgacttttatgctcctgctttctggccagataacatggcgggacatggctcataccttgatcatgattggttccaatgccagtgatagaatggggatgggagtgacgtacctggcattaatcgccactttcaagattcagccatttctcgctctgggcttctttcttaggaaactgaccagccgcgagaacctactcctgggcgttgggttggcgatggccacaaccctgcaattacccgaagacatcgagcagatggcaaatggaatagctctcggtctgatggcccttaagctgatcactcagttcgaaacatatcagttgtggaccgccctcgtgtctctgacatgttccaacactatttttaccctaacggtcgcttggcgaacagcaaccctgatccttgccggcgtgtcactcctgccggtttgccaaagtagctcgatgcggaagactgattggttgcctgtggcggtcgctgccatgggggtaccacccctgcctttattcattttttccctcaaagacaccctgaagcgtagatcttggccccttaatgagggagtgatggcagttggcctggtgagcatcttggcctcaagtctcctgaggaacgatgtcccaatggctggtcctctagtggcagggggactgcttatagcctgttacgtaattacaggcacttccgcggacctcaccgtggagaaagctgccgacgtcacgtgggaagaggaagcagagcagacaggcgtttctcacaacctgatgatcaccgtggatgacgatgggactatgcgcatcaaggacgatgaaacagagaatattttgaccgtgttactgaaaactgccctcctgatagtcagcggaatcttcccctattccattccagctacacttctggtgtggcatacctggcagaagcagacgcaacggtcaggtgttttgtgggacgtaccgagccctcccgagactcagaaagccgaactagaggaaggcgtgtacagaatcaagcagcaggggatttttggaaagacccaagtcggcgtgggtgttcagaaagagggggtgttccacacaatgtggcacgtcaccaggggagcagtgctgacacataacggcaagcgactcgagccaaattgggctagtgtaaaaaaggatctgatctcttacggcgggggatggcgcctttccgcccagtggcaaaaaggtgaagaggtccaggtgatagcggttgaacccggccggaaccctaagaattttcagactatgccagggatcttccagaccacgatgggagagattggcgccatcgcattagacttcaagcccggtacaagcgggtcgcctattatcaacagagaaggaaaagtggtcggcctgtatggcaatggggtggttactaagaacggaggttacgtgtcaggcatagctcaagccaatgctgagccggatgggccaacccccgagctcgaagaggaaatgtttaaaaagaggaacttgacaattatggacctgcaccctggatctggcaaaacccgtaagtatctcccagcaatcgtccgcgaggccatcaagcggagactgaggactcttattctggcccccacccgagtggtagctgcggaaatggaggaggcattgaaaggtctacctatccggtaccagacaacggccactaagagtgaacataccgggcgcgagatagtggatctgatgtgccacgctacattcaccatgagactcttatccccggttagggtccccaattataacctgattatcatggacgaagcccattttactgatccagcaagcattgccgctcggggatacatctctacacgagtgggcatgggcgaggcggccgcaatattcatgaccgctacgcctcccgggactgccgaagcatttccacagagcaatgcccctattcaggacgaggagagagacatccccgaacgctcctggaactcaggaaatgagtggatcacagatttcgtgggtaaaaccgtctggtttgtaccaagtattaaggctggcaacgacatcgccaactgtcttaggaaaaatgggaagaaggtgattcaactgagccgtaaaaccttcgatactgaatatcagaagacaaaactcaacgactgggattttgttgtgaccacagacatatctgagatgggagcgaatttcaaggcagatcgggtcatcgacccgagaaggtgcttgaaacctgtgattctgactgatggccccgagcgcgttatcctcgccggtccaatgcccgtgacggctgcctccgctgcacagcgaagagggcgggtcggcaggaaccctcagaaggaaaatgaccaatacatctttaccggacagccactgaacaatgatgaggaccacgcccactggacagaagctaagatgcttctagacaacattaatactcccgagggcataatccctgccctgttcgaaccggagcgcgagaaatcagcagcgattgatggggaataccgtttgaagggagagagtagaaaaaccttcgtggaattaatgcggaggggtgacctgccagtatggctcgcccataaggtggctagcgagggcatcaaatatacagatcgcaagtggtgctttgacggggaacgaaacaatcagattctggaggagaacatggatgttgaaatctggaccaaagagggagaaagaaagaagcttcggcccaggtggctggacgcccgcacttactccgatcctctcgcattgaaagagttcaaggactttgctgccggcagaaaatctatagcactggatctagtcacggaaatcggtagggtgccctcgcacctggcccatcggacccgtaatgctctcgacaaccttgtgatgctgcacacaagcgagcacgggggccgcgcgtatcgacatgccgtcgaggaattaccagagactatggaaaccttgctgctcctgggacttatgattctgctcacaggcggggcaatgttgttcctgatctcaggaaagggtattggcaaaacctccatcgggttaatatgtgttattgtgagttctggaatgctatggatggctgatgtacctctgcagtggatcgccagcgccattgtgctcgagtttttcatgatggtccttctgatccccgagccagaaaagcaaagaactcctcaggacaatcagttggcatacgtggttataggcatcctgacactcgctgccattgtggcggctaacgagatgggtctgcttgaaacgaccaagagggatctcgggatgtccaaagagccgggcgtcgtatcacccacttcttatctggacgtggacttgcacccagccagcgcatggacactgtacgccgttgctaccaccgtgatcacacctatgttacggcatactattgaaaatagtacggcaaacgtctccctagccgcgatcgctaaccaagccgtggtcctgatgggactcgataagggctggcccataagcaaaatggaccttggggtgccactgttggcactgggatgctattctcaggttaatcctctcaccctgacagccgctgtgcttttactggtaactcactacgccattatcggccccggtctccaggcaaaggctacccgcgaggcccagaaaagaacagcggccgggatcatgaagaacccgaccgtggatggaattatgactatcgacttggatccagtcatatacgactcaaagtttgagaaacaactgggccaggttatgctactggtgctctgtgcagtccagcttctgttgatgaggacgtcctgggctctgtgcgaagccctcacactggcaaccggtcctattactaccttatgggagggcagtcccgggaagttctggaatacaactatcgctgtgagcatggccaacatttttcggggatcgtatcttgccggcgcggggctggctttctctatcatgaaatccgtaggaaccggcaagcgaggtacagggagccagggagaaacgctcggcgagaaatggaagaagaaactaaatcaactgtcaagacgcgaatttgagttgtacaagaaaagtggtataaccgaggtggataggactgaagcaaaggagggcctgaaacggggggaaacaacccatcacgccgtttctcgtggatccgctaagctccagtggttcgtggagagaaacatggtcatcccagaaggcagggtgattgaccttgggtgtggacgcggcggttggagctattactgcgccgggctgaaaaaggtcactgaggtgcggggatatacaaagggcggccccgggcacgaggaacctgttccgatgtcaacctacggatggaatacggtaaaattgatgagtggtaaggatgtgttttatctgcccccagagaaatgtgacaccctcttatgcgatatcggcgaaagctccccttctcccacagtcgaggagagccgaactattagagtgctgaagatggttgaaccttggcttaaaaacaatcagttctgtatcaaggtgctgaacccatacatgcccaccgtcattgagcatctagaaaggctccagcgcaagcacgggggaatgctggtgcggaatcctttgtccagaaactcaacacatgagatgtactggatctctaatggcactggtaacatagtaagttcggtgaatatggttagccgtctgctccttaacaggttcaccatgacacaccggcgcccaaccattgaaaaagacgtcgatctgggggcaggaactcgacacgtgaacgccgagcccgagacgccgaatatggacgtgatcggcgaaagaatcaagaggattaaagaggaacattcctctacatggcactatgacgatgagaacccttacaagacctgggcttatcatggctcatacgaagtcaaagcgactgggagcgcctccagtatgataaatggagttgtgaagttactgaccaagccatgggacgtagtgcccatggtcacacaaatggcaatgacggataccactccttttggtcagcagcgggtgttcaaagagaaggttgacacacgcaccccaagacccatgccgggcactaggaaagtgatggagatcacagctgaatggttgtggcgaaccctcgggcggaacaagcgtcctagactgtgcacacgcgaggaatttactaaaaaggtcaggaccaatgccgcaatgggagccgtgttcacggaggaaaaccaatgggagtctgctcgggccgcggtagaggatgaagagttttggaagctagttggcagagaacgcgagcttcacaaactgggtaagtgtgggagctgcgtgtataatatgatgggaaaaagggagaagaaactcggcgaattcggcaaggcaaaagggtcacgagccatttggtacatgtggctgggagctcggtatttggagtttgaagccctgggtttcctcaacgaggaccattggttttccagagaaaatagttacagcggcgtcgagggggagggacttcacaagctgggctacatcttaagggatatttctaagatccccggtggggcaatgtatgctgacgataccgccggatgggacacacgcataactgaagatgacctgcacaacgaggaaaaaatcacccagcagatggacccagagcatcgtcagttggctaatgccattttcaagctcacataccaaaacaaagtggtgaaggtccagcggcctactcccaaaggcaccgttatggatatcatttccagaaaggaccagaggggctcagggcaggtgggaacgtatggtctgaatacatttaccaacatggaagcacaactaatccgccagatggagggcgagggggtacttagcaaggcggatctggaaaatccacacctcctggagaaaaagataactcagtggttggaaacaaaaggagtggagcgattaaagcggatggccatttcgggcgacgattgcgtcgtgaaacccatcgacgatagattcgctaacgccctgctcgcacttaacgacatgggtaaggttaggaaggatatccctcagtggcaaccatctaaagggtggcatgactggcagcaggtgccgttttgtagtcaccacttccatgaactgattatgaaggatggacgcaaactagtcgtgccctgcagacctcaggacgagctgataggccgggctaggatctcccaaggcgccgggtggagcctcaaggagaccgcatgtttgggaaaagcctacgcgcagatgtggtcactgatgtatttccaccgtcgagatcttcgcctggcttccaatgccatttgctctgcagtaccagttcattgggtgcccactagcagaaccacatggagtatccacgcccatcaccagtggatgacgaccgaagacatgctcactgtctggaaccgggtgtggattgaggacaatccttggatggaagataagacaccagttaccacttgggaggacgtgccctacttaggtaagagggaggatcaatggtgtggctccctgatcgggttgacaagccgcgctacctgggcccagaacatactgacggcaatccagcaggtcagatctctcattggagacgaagagtttcttgattatatgccttcaatgaaacggttcaggaaggaagaggaaagtgagggcgctatctggtga

SEQ ID NO: 15609 - RNA, 9873 nt, synthetic construct
  misc_feature 1..9873: note = derived and/or modified CDS sequence (opt3) from DENV-3__KJ622192__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaatcacagagacccctacttggaataggaaagaactgttggtaacatttaagaacgctcacgccaaaaagcaagaggttgtggtcctcggctcacaggaaggagctatgcacacggccctgaccggcgcaactgagattcagaatagtgggggaacaagcatattcgccggtcatttaaagtgtcggctgaaaatggataagctagaactcaaaggcatgtcttatgctatgtgcctgaacacctttgtgcttaagaaagaggtctccgagacacagcacgggactatcttgattaaggtggaatacaagggagaggacgcgccatgtaaaatccccttctcaaccgaagatggccaaggtaaggcacataacgggcgtctgataacggccaatcctgttgtgaccaaaaaggaggagccagtaaacattgaagctgagcccccgttcggcgaaagcaatatcgtcatcggaattggcgacaaagccctcaagatcaactggtacaagaaagggagttctattggaaagatgtttgaggcaacagcccgcggtgctagaaggatggccatactgggcgatactgcatgggacttcgggtccgtgggaggcgttcttaatagcctgggtaaaatggtgcaccagatctttgggtcggcgtataccgctttgttcggcggagtctcttggattatgaagatcggcatcggggtgctcctgacatggattggattaaactccaaaaatacttcaatgagttttagctgcatagtaatcggcattatcaccctgtacctaggtacggtggttcaggccgatatggggtgtgtcattaactggaagggaaaggaactcaaatgcggctccggtatcttcgtgacaaatgaggtgcatacctggactgagcagtataagtttcaagcagactctcctaaacggctggccacagctatagccggcgcatgggaaaacggggtctgtggaatccgaagcaccactcgcatggagaatcttttgtggaagcagattgctaacgaactgaattacatcctctgggagaacaatattaaactgaccgttgtggtgggcgatatcataggggtattagaacagggaaagagaacactgacgccccagccaatggagcttaaatattcatggaagacctggggcaaggccaaaattgtcactgcggagatccaaaacagttccttcattatcgacggtcctaacacacccgaatgcccaagcgcctctagggcttggaatgtgtgggaggttgaagactacgggtttggagtgttcaccacaaacatatggttgaagctccgggaggtctatactcagacctgtgatcaccgcctgatgtcagcagccatcaaagacgaaagagctgtgcacgccgatatgggctactggattgagagtcagaagaatggtagctggaaactagagaaggcatcctttatcgaagttaagacgtgcacatggcccaaatctcataccctgtggtcgaacggcgtgctcgagagcgacatgattatccctaagtccctggcggggccaatatcacagcacaatcataggccgggataccacactcaaaccgccggcccctggcaccttgggaaattggaactggatttcaactattgcgagggaacaactgtagtcattaccgagaattgtggcacacgtggtcctagtttacggacgaccactgtgtctgggaagctcatccatgaatggtgctgtcgaagctgcacactgccaccccttagatacatgggagaggacggctgttggtatggtatggaaatcaggcctattaacgagaaagaagagaatatggtgaagtccctggtctcagctggcagcgggaaggttgataactttaccatgggagtgttgtgcctcgccatcctgttcgaggaagtaatgcgcggcaaattcgggaagaaacacatgattgcaggagtgctactgacttttatgctcctgctttctggccagataacatggcgggacatggctcataccttgatcatgattggttccaatgccagtgatagaatggggatgggagtcacgtacctggcattaatcgccactttcaagattcagccatttctcgctctgggcttctttcttaggaaactgaccagccgcgagaacctactcctgggcgtggggttggcgatggccacaaccctgcaattacccgaagacatcgagcagatggcaaatggaatagctctcggtctgatggcccttaagctgatcactcagttcgaaacatatcagttgtggaccgccctcgtttctctgacatgttccaacactatttttaccctaacggtggcttggcgaacagcaaccctgatccttgccggcgtctcactcctgccggtgtgccaaagtagctcgatgcggaagactgattggttgcctgttgcggtggctgccatgggggtcccacccctgcctttattcattttttccctcaaagacaccctgaagcgtagatcttggccccttaatgagggagtaatggcagtgggcctggttagcatcttggcctcaagtctcctgaggaacgatgtgccaatggctggtcctctagtcgcagggggactgcttatagcctgttacgtgattacaggcacttccgcggacctcaccgtagagaaagctgccgacgtgacgtgggaagaggaagcagagcagacaggcgtctctcacaacctgatgatcaccgttgatgacgatgggactatgcgcatcaaggacgatgaaacagagaatattttgaccgtgttactgaaaactgccctcctgatagtgagcggaatcttcccctattccattccagctacacttctggtctggcatacctggcagaagcagacgcaacggtcaggtgtgttgtgggacgttccgagccctcccgagactcagaaagccgaactagaggaaggcgtatacagaatcaagcagcaggggatttttggaaagacccaagtgggcgtcggtgtgcagaaagagggggttttccacacaatgtggcacgtgaccaggggagcagtcctgacacataacggcaagcgactcgagccaaattgggctagtgtgaaaaaggatctgatctcttacggcgggggatggcgcctttccgcccagtggcaaaaaggtgaagaggtacaggtcatagcggtggaacccggccggaaccctaagaattttcagactatgccagggatcttccagaccacgacaggagagattggcgccatcgcattagacttcaagcccggtactagcgggtcgcctattatcaacagagaaggaaaagttgtgggcctgtatggcaatggggtcgtgaccaagaacggaggttacgtttcaggcatagctcaagccaatgctgagccggatgggccaacacccgagctcgaagaggaaatgtttaaaaagaggaacttgaccattatggacctgcaccctggatctggcaaaactcgtaagtatctcccagcaatcgtgcgcgaggccatcaagcggagactgaggacccttattctggcccccacacgagtcgtggctgcggaaatggaggaggcattgaaaggtctacctatccggtaccagacgactgccaccaagagtgaacatacagggcgcgagatagtagatctgatgtgccacgctaccttcactatgagactcttatccccggtgagggttcccaattataacctgattatcatggacgaagcccattttacagatccagcaagcattgccgctcggggatacatctctacccgagtcggcatgggcgaggcggccgcaatattcatgacggctactcctcccgggacagccgaagcatttccacagagcaatgcccctattcaggacgaggagagagacatccccgaacgctcctggaactcaggaaatgagtggatcaccgatttcgtgggtaaaaccgtgtggtttgtcccaagtattaaggctggcaacgacatcgccaactgtcttaggaaaaatgggaagaaggtaattcaactgagccgtaaaactttcgatacagaatatcagaagaccaaactcaacgactgggattttgtggttacaactgacatatctgagatgggagcgaatttcaaggcagatcgggtgatcgacccgagaaggtgcttgaaacctgtcattctgacggatggccccgagcgcgtgatcctcgccggtccaatgcccgttaccgctgcctccgctgcacagcgaagagggcgggtgggcaggaaccctcagaaggaaaatgaccaatacatctttacaggacagccactgaacaatgatgaggaccacgcccactggactgaagctaagatgcttctagacaacattaatacccccgagggcataatccctgccctgttcgaaccggagcgcgagaaatcagcagcgattgatggggaataccgtttgaagggagagagtagaaaaacattcgtcgaattaatgcggaggggtgacctgccagtgtggctcgcccataaggtagctagcgagggcatcaaatataccgatcgcaagtggtgctttgacggggaacgaaacaatcagattctggaggagaacatggatgtggaaatctggactaaagagggagaaagaaagaagcttcggcccaggtggctggacgcccgcacgtactccgatcctctcgcattgaaagagttcaaggactttgctgccggcagaaaatctatagcactggatctagttaccgaaatcggtagggtcccctcgcacctggcccatcggacacgtaatgctctcgacaaccttgtgatgctgcacactagcgagcacgggggccgcgcgtatcgacatgccgtggaggaattaccagagaccatggaaacattgctgctcctgggacttatgattctgctcaccggcggggcaatgttgttcctgatctcaggaaagggtattggcaaaacttccatcgggttaatatgtgtcattgttagttctggaatgctatggatggctgatgtgcctctgcagtggatcgccagcgccattgtactcgagtttttcatgatggtgcttctgatccccgagccagaaaagcaaagaacacctcaggacaatcagttggcatacgtcgtgataggcatcctgacgctcgctgccattgttgcggctaacgagatgggtctgcttgaaaccactaagagggatctcgggatgtccaaagagccgggcgtggtctcacccacatcttatctggacgtagacttgcacccagccagcgcatggaccctgtacgccgtggctaccacagttatcactcctatgttacggcatacgattgaaaatagtaccgcaaacgtgtccctagccgcgatcgctaaccaagccgtcgtgctgatgggactcgataagggctggcccataagcaaaatggaccttggggtcccactgttggcactgggatgctattctcaggtgaatcctctcacactgactgccgctgttcttttactggtgacccactacgccattatcggccccggtctccaggcaaaggctacacgcgaggcccagaaaagaaccgcggccgggatcatgaagaacccgactgtagatggaattatgacgatcgacttggatccagtgatatacgactcaaagtttgagaaacaactgggccaggtcatgctactggttctctgtgcagtgcagcttctgttgatgaggacatcctgggctctgtgcgaagccctcaccctggcaactggtcctattaccacattatgggagggcagtcccgggaagttctggaatactaccatcgctgtcagcatggccaacatttttcggggatcgtatcttgccggcgcggggctggctttctctatcatgaaatccgtgggaacaggcaagcgaggtacggggagccagggagaaaccctcggcgagaaatggaagaagaaactaaatcaactgtcaagacgcgaatttgagttgtacaagaaaagtggtataactgaggtagataggacagaagcaaaggagggcctgaaacggggggaaaccactcatcacgccgtgtctcgtggatccgctaagctccagtggttcgttgagagaaacatggtgatcccagaaggcagggtcattgaccttgggtgtggacgcggcggttggagctattactgcgccgggctgaaaaaggtgacagaggtccggggatataccaagggcggccccgggcacgaggaacctgtgccgatgtcaacgtacggatggaataccgttaaattgatgagtggtaaggatgtattttatctgcccccagagaaatgtgacacactcttatgcgatatcggcgaaagctccccttctcccactgtggaggagagccgaaccattagagtcctgaagatggtggaaccttggcttaaaaacaatcagttctgtatcaaggttctgaacccatacatgcccacagtgattgagcatctagaaaggctccagcgcaagcacgggggaatgctggtccggaatcctttgtccagaaactcaactcatgagatgtactggatctctaatggcaccggtaacatagtgagttcggtaaatatggtgagccgtctgctccttaacaggttcacaatgacccaccggcgcccaactattgaaaaagacgttgatctgggggcaggaacgcgacacgtcaacgccgagcccgagacaccgaatatggacgtgatcggcgaaagaatcaagaggattaaagaggaacattcctctacctggcactatgacgatgagaacccttacaagacttgggcttatcatggctcatacgaagtgaaagcgaccgggagcgcctccagtatgataaatggagtcgttaagttactgacaaagccatgggacgtggtacccatggtgacgcaaatggcaatgaccgatactacaccttttggtcagcagcgggtcttcaaagagaaggtggacacccgcactccaagacccatgccgggcacaaggaaagttatggagatcaccgctgaatggttgtggcgaacactcgggcggaacaagcgtcctagactgtgcactcgcgaggaatttaccaaaaaggtgaggacgaatgccgcaatgggagccgtcttcaccgaggaaaaccaatgggagtctgctcgggccgcggtggaggatgaagagttttggaagctagtaggcagagaacgcgagcttcacaaactgggtaagtgtgggagctgcgtttataatatgatgggaaaaagggagaagaaactcggcgaattcggcaaggcaaaagggtcacgagccatttggtacatgtggctgggagctcggtatttggagtttgaagccctgggtttcctcaacgaggaccattggttttccagagaaaatagttacagcggcgtggagggggagggacttcacaagctgggctacatcttaagggatatttctaagatccccggtggggcaatgtatgctgacgatacagccggatgggacactcgcataaccgaagatgacctgcacaacgaggaaaaaatcacacagcagatggacccagagcatcgtcagttggctaatgccattttcaagctcacttaccaaaacaaagtcgtgaaggtgcagcggcctacccccaaaggcacggtcatggatatcatttccagaaaggaccagaggggctcagggcaggttggaacatatggtctgaatacctttactaacatggaagcacaactaatccgccagatggagggcgagggggtgcttagcaaggcggatctggaaaatccacacctcctggagaaaaagataacacagtggttggaaaccaaaggagtagagcgattaaagcggatggccatttcgggcgacgattgcgtggtcaaacccatcgacgatagattcgctaacgccctgctcgcacttaacgacatgggtaaggtgaggaaggatatccctcagtggcaaccatctaaagggtggcatgactggcagcaggttccgttttgtagtcaccacttccatgaactgattatgaaggatggacgcaaactagtggtcccctgcagacctcaggacgagctgataggccgggctaggatctcccaaggcgccgggtggagcctcaaggagactgcatgtttgggaaaagcctacgcgcagatgtggtcactgatgtatttccaccgtcgagatcttcgcctggcttccaatgccatttgctctgcagtgccagtacattgggttcccaccagcagaacaacgtggagtatccacgcccatcaccagtggatgaccactgaagacatgctcacagtgtggaaccgggtctggattgaggacaatccttggatggaagataagaccccagtgactacatgggaggacgttccctacttaggtaagagggaggatcaatggtgtggctccctgatcgggttgaccagccgcgctacgtgggcccagaacatactgacagcaatccagcaggtgagatctctcattggagacgaagagtttcttgattatatgccttcaatgaaacggttcaggaaggaagaggaaagtgagggcgctatctggtga

SEQ ID NO: 15610 - RNA, 9873 nt, synthetic construct
  misc_feature 1..9873: note = derived and/or modified CDS sequence (opt3) from DENV-3__KJ622193__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaatcacagagacccctacttggaataggaaagaactgttggtaacatttaagaacgctcacgccaaaaagcaaggcgttgtggtcctcggatcacaggagggcgctatgcacacggccctgaccggggcaactgaaattcagaatagtggaggtacaagcatattcgccggccatttaaagtgtcggctgaaaatggataagctagagctcaaagggatgtcttatgctatgtgcctgaacacctttgtgcttaagaaagaagtctccgagacacagcacggaactatcttgattaaggtggagtacaagggcgaagacgcgccatgtaaaatccccttctcaaccgaggatggtcaagggaaggcacataacggccgtctgataacggccaatcctgttgtgaccaaaaaggaagagccagtaaacattgaggctgaacccccgttcggagagagcaatatcgtcatcggcattggggacaaagccctcaagatcaactggtacaagaaaggaagttctattggtaagatgtttgaagcaacagcccgcggcgctagaaggatggccatactgggggatactgcatgggacttcggatccgtgggcggtgttcttaatagcctggggaaaatggtgcaccagatctttggctcggcgtataccgctttgttcggaggcgtctcttggattatgaagatcgggatcggagtgctcctgacatggattggcttaaactccaaaaatacttcaatgagttttagctgcatagtaatcggtattatcaccctgtacctagggacggtggttcaggccgatatgggatgtgtcattaactggaagggcaaggagctcaaatgcggttccggcatcttcgtgacaaatgaagtgcatacctggactgagcagtataagtttcaagcagactctcctaaacggctggccacagctatagccggggcatgggagaacggagtctgtggcatccgaagcaccactcgcatggaaaatcttttgtggaagcagattgctaacgagctgaattacatcctctgggaaaacaatattaaactgaccgttgtggtgggggatatcataggagtattagagcagggcaagagaacactgacgccccagccaatggaacttaaatattcatggaagacctggggtaaggccaaaattgtcactgcggagatccaaaacagttccttcattatcgacgggcctaacacacccgagtgcccaagcgcctctagggcttggaatgtgtgggaagttgaggactacggatttggcgtgttcaccacaaacatatggttgaagctccgggaagtctatactcagacctgtgatcaccgcctgatgtcagcagccatcaaagacgagagagctgtgcacgccgatatgggttactggattgaaagtcagaagaatggcagctggaaactagagaaggcatcctttatcgaggttaagacgtgcacatggcccaaatctcataccctgtggtcgaacggggtgctcgaaagcgacatgattatccctaagtccctggcgggaccaatatcacagcacaatcataggccgggctaccacactcaaaccgccgggccctggcaccttggaaaattggagctggatttcaactattgcgaaggcacaactgtagtcattaccgagaattgtggtacacgtgggcctagtttacggacgaccactgtgtctggaaagctcatccatgagtggtgctgtcgaagctgcacactgccaccccttagatacatgggcgaagacggttgttggtatggcatggagatcaggcctattaacgaaaaagaggaaaatatggtgaagtccctggtctcagctgggagcggaaaggttgataactttaccatgggcgtgttgtgcctcgccatcctgttcgaggaggtaatgcgcgggaaattcggaaagaaacacatgattgcaggcgtgctactgacttttatgctcctgctttctggtcagataacatggcgggacatggctcataccttgatcatgattgggtccaatgccagtgatagaatgggaatgggcgtcacgtacctggcattaatcgccactttcaagattcagccatttctcgctctgggcttctttcttaggaaactgaccagccgcgaaaacctactcctgggggtgggattggcgatggccacaaccctgcaattacccgaggacatcgaacagatggcaaatggtatagctctcggcctgatggcccttaagctgatcactcagttcgagacatatcagttgtggaccgccctcgtttctctgacatgttccaacactatttttaccctaacggtggcttggcgaacagcaaccctgatccttgccggggtctcactcctgccggtgtgccaaagtagctcgatgcggaagactgattggttgcctgttgcggtggctgccatgggagtcccacccctgcctttattcattttttccctcaaagacaccctgaagcgtagatcttggccccttaatgaaggcgtaatggcagtgggtctggttagcatcttggcctcaagtctcctgaggaacgatgtgccaatggctgggcctctagtcgcaggaggcctgcttatagcctgttacgtgattacaggcacttccgcggacctcaccgtagagaaagctgccgacgtgacgtgggaggaagaggcagaacagacaggggtctctcacaacctgatgatcaccgttgatgacgatggaactatgcgcatcaaggacgatgagacagaaaatattttgaccgtgttactgaaaactgccctcctgatagtgagcggtatcttcccctattccattccagctacacttctggtctggcatacctggcagaagcagacgcaacggtcaggcgtgttgtgggacgttccgagccctcccgagactcagaaagccgagctagaagagggggtatacagaatcaagcagcagggaatttttggcaagacccaagtgggtgtcggggtgcagaaagaaggagttttccacacaatgtggcacgtgaccaggggcgcagtcctgacacataacggcaagcgactcgagccaaattgggctagtgtgaaaaaggatctgatctcttacgggggaggttggcgcctttccgcccagtggcaaaaaggcgaggaagtacaggtcatagcggtggagcccgggcggaaccctaagaattttcagactatgccaggaatcttccagaccacgacaggcgaaattggtgccatcgcattagacttcaagcccgggactagcggatcgcctattatcaacagagagggcaaagttgtgggcctgtatgggaatggagtcgtgaccaagaacggtggctacgtttcagggatagctcaagccaatgctgaaccggatggaccaacacccgagctcgaggaagagatgtttaaaaagaggaacttgaccattatggacctgcaccctggctctggtaaaactcgtaagtatctcccagcaatcgtgcgcgaagccatcaagcggagactgaggacccttattctggcccccacacgagtcgtggctgcggagatggaagaggcattgaaagggctacctatccggtaccagacgactgccaccaagagtgagcatacaggacgcgaaatagtagatctgatgtgccacgctaccttcactatgagactcttatccccggtgagggttcccaattataacctgattatcatggacgaggcccattttacagatccagcaagcattgccgctcggggctacatctctacccgagtcggcatgggggaagcggccgcaatattcatgacggctactcctcccggaacagccgaggcatttccacagagcaatgcccctattcaggacgaagagagagacatccccgagcgctcctggaactcaggtaatgaatggatcaccgatttcgtgggcaaaaccgtgtggtttgtcccaagtattaaggctgggaacgacatcgccaactgtcttaggaaaaatggaaagaaggtaattcaactgagccgtaaaactttcgatacagagtatcagaagaccaaactcaacgactgggattttgtggttacaactgacatatctgaaatgggcgcgaatttcaaggcagatcgggtgatcgacccgagaaggtgcttgaaacctgtcattctgacggatggtcccgagcgcgtgatcctcgccgggccaatgcccgttaccgctgcctccgctgcacagcgaagaggccgggtgggaaggaaccctcagaaggagaatgaccaatacatctttacaggccagccactgaacaatgatgaagaccacgcccactggactgaggctaagatgcttctagacaacattaatacccccgaagggataatccctgccctgttcgagccggaacgcgagaaatcagcagcgattgatggagagtaccgtttgaagggtgaaagtagaaaaacattcgtcgagttaatgcggaggggcgacctgccagtgtggctcgcccataaggtagctagcgaagggatcaaatataccgatcgcaagtggtgctttgacggagagcgaaacaatcagattctggaagagaacatggatgtggagatctggactaaagaaggcgagagaaagaagcttcggcccaggtggctggacgcccgcacgtactccgatcctctcgcattgaaagaattcaaggactttgctgccggtagaaaatctatagcactggatctagttaccgagatcgggagggtcccctcgcacctggcccatcggacacgtaatgctctcgacaaccttgtgatgctgcacactagcgaacacggcggacgcgcgtatcgacatgccgtggaggagttaccagaaaccatggagacattgctgctcctgggccttatgattctgctcaccgggggagcaatgttgttcctgatctcaggtaagggcattgggaaaacttccatcggattaatatgtgtcattgttagttctggcatgctatggatggctgatgtgcctctgcagtggatcgccagcgccattgtactcgaatttttcatgatggtgcttctgatccccgagccagagaagcaaagaacacctcaggacaatcagttggcatacgtcgtgataggtatcctgacgctcgctgccattgttgcggctaacgaaatggggctgcttgagaccactaagagggatctcggcatgtccaaagaaccgggagtggtctcacccacatcttatctggacgtagacttgcacccagccagcgcatggaccctgtacgccgtggctaccacagttatcactcctatgttacggcatacgattgagaatagtaccgcaaacgtgtccctagccgcgatcgctaaccaagccgtcgtgctgatgggcctcgataaggggtggcccataagcaaaatggaccttggagtcccactgttggcactgggctgctattctcaggtgaatcctctcacactgactgccgctgttcttttactggtgacccactacgccattatcggtcccgggctccaggcaaaggctacacgcgaagcccagaaaagaaccgcggccggaatcatgaagaacccgactgtagatggcattatgacgatcgacttggatccagtgatatacgactcaaagtttgagaaacaactgggtcaggtcatgctactggttctctgtgcagtgcagcttctgttgatgaggacatcctgggctctgtgcgaggccctcaccctggcaactggccctattaccacattatgggaagggagtcccggaaagttctggaatactaccatcgctgtcagcatggccaacatttttcggggctcgtatcttgccggggcgggactggctttctctatcatgaaatccgtgggcacaggtaagcgagggacgggaagccagggcgagaccctcggtgaaaaatggaagaagaaactaaatcaactgtcaagacgcgagtttgaattgtacaagaaaagtggcataactgaggtagataggacagaggcaaaggaagggctgaaacggggagagaccactcatcacgccgtgtctcgtggctccgctaagctccagtggttcgttgaaagaaacatggtgatcccagaggggagggtcattgaccttggatgtggccgcggtgggtggagctattactgcgccggactgaaaaaggtgacagaagtccggggctataccaagggcgggcccggacacgaggagcctgtgccgatgtcaacgtacggttggaataccgttaaattgatgagtggcaaggatgtattttatctgcccccagaaaaatgtgacacactcttatgcgatatcggggagagctccccttctcccactgtggaagagagccgaaccattagagtcctgaagatggtggagccttggcttaaaaacaatcagttctgtatcaaggttctgaacccatacatgcccacagtgattgaacatctagagaggctccagcgcaagcacggaggcatgctggtccggaatcctttgtccagaaactcaactcatgaaatgtactggatctctaatggtaccgggaacatagtgagttcggtaaatatggtgagccgtctgctccttaacaggttcacaatgacccaccggcgcccaactattgagaaagacgttgatctgggagcaggcacgcgacacgtcaacgccgaacccgagacaccgaatatggacgtgatcggcgagagaatcaagaggattaaagaagagcattcctctacctggcactatgacgatgaaaacccttacaagacttgggcttatcatgggtcatacgaggtgaaagcgaccggaagcgcctccagtatgataaatggtgtcgttaagttactgacaaagccatgggacgtggtacccatggtgacgcaaatggcaatgaccgatactacaccttttggccagcagcgggtcttcaaagaaaaggtggacacccgcactccaagacccatgccggggacaaggaaagttatggagatcaccgctgagtggttgtggcgaacactcggacggaacaagcgtcctagactgtgcactcgcgaagagtttaccaaaaaggtgaggacgaatgccgcaatgggcgccgtcttcaccgaagagaaccaatgggaatctgctcgggccgcggtggaggatgaggaattttggaagctagtaggtagagagcgcgaacttcacaaactggggaagtgtggaagctgcgtttataatatgatgggcaaaagggagaagaaactcggcgagttcgggaaggcaaaaggatcacgagccatttggtacatgtggctgggtgctcggtatttggaatttgaggccctgggcttcctcaacgaagaccattggttttccagagagaatagttacagcggggtggaaggagagggccttcacaagctgggttacatcttaagggatatttctaagatccccgggggagcaatgtatgctgacgatacagccggctgggacactcgcataaccgaggatgacctgcacaacgaagagaaaatcacacagcagatggacccagaacatcgtcagttggctaatgccattttcaagctcacttaccaaaacaaagtcgtgaaggtgcagcggcctacccccaaaggcacggtcatggatatcatttccagaaaggaccagagggggtcaggacaggttggtacatatggcctgaatacctttactaacatggaggcacaactaatccgccagatggaaggggagggagtgcttagcaaggcggatctggagaatccacacctcctggaaaaaaagataacacagtggttggagaccaaaggcgtagaacgattaaagcggatggccatttcgggtgacgattgcgtggtcaaacccatcgacgatagattcgctaacgccctgctcgcacttaacgacatggggaaggtgaggaaggatatccctcagtggcaaccatctaaaggatggcatgactggcagcaggttccgttttgtagtcaccacttccatgagctgattatgaaggatggccgcaaactagtggtcccctgcagacctcaggacgaactgataggccgggctaggatctcccaaggggccggatggagcctcaaggagactgcatgtttgggtaaagcctacgcgcagatgtggtcactgatgtatttccaccgtcgagatcttcgcctggcttccaatgccatttgctctgcagtgccagtacattgggttcccaccagcagaacaacgtggagtatccacgcccatcaccagtggatgaccactgaggacatgctcacagtgtggaaccgggtctggattgaagacaatccttggatggaggataagaccccagtgactacatgggaagacgttccctacttaggcaagagggaggatcaatggtgtgggtccctgatcggattgaccagccgcgctacgtgggcccagaacatactgacagcaatccagcaggtgagatctctcattggcgacgaggaatttcttgattatatgccttcaatgaaacggttcaggaaggaggaagagagtgaaggtgctatctggtga

SEQ ID NO: 15611 - RNA, 9873 nt, synthetic construct
  misc_feature 1..9873: note = derived and/or modified CDS sequence (opt3) from DENV-3__KJ622194__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaatcacagagacccctacttggaataggaaagaactgttggtaacatttaagaacgctcacgccaaaaagcaagaggttgtggtcctcggctcacaggaaggagctatgcacacggccctgaccggcgcaactgagattcagaatagtgggggaacaagcatattcgccggtcatttaaagtgtcggctgaaaatggataagctagaactcaaaggcatgtcttatgctatgtgcctgaacacctttgtgcttaagaaagaggtctccgagacacagcacgggactatcttgattaaggtggaatacaagggagaggacgcgccatgtaaaatccccttctcaaccgaagatggccaaggtaaggcacataacgggcgtctgataacggccaatcctgttgtgaccaaaaaggaggagccagtaaacattgaagctgagcccccgttcggcgaaagcaatatcgtcatcggaattggcgacaaagccctcaagatcaactggtacaagaaagggagttctattggaaagatgtttgaggcaacagcccgcggtgctagaaggatggccatactgggcgatactgcatgggacttcgggtccgtgggaggcgttcttaatagcctgggtaaaatggtgcaccagatctttgggtcggcgtataccgctttgttcggcggagtctcttggattatgaagatcggcatcggggtgctcctgacatggattggattaaactccaaaaatacttcaatgagttttagctgcatagtaatcggcattatcaccctgtacctaggtacggtggttcaggccgatatggggtgtgtcattaactggaagggaaaggaactcaaatgcggctccggtatcttcgtgacaaatgaggtgcatacctggactgagcagtataagtttcaagcagactctcctaaacggctggccacagctatagccggcgcatgggaaaacggggtctgtggaatccgaagcaccactcgcatggagaatcttttgtggaagcagattgctaacgaactgaattacatcctctgggagaacaatattaaactgaccgttgtggtgggcgatatcataggggtattagaacagggaaagagaacactgacgccccagccaatggagcttaaatattcatggaagacctggggcaaggccaaaattgtcactgcggagatccaaaacagttccttcattatcgacggtcctaacacacccgaatgcccaagcgcctctagggcttggaatgtgtgggaggttgaagactacgggtttggagtgttcaccacaaacatatggttgaagctccgggaggtctatactcagacctgtgatcaccgcctgatgtcagcagccatcaaagacgaaagagctgtgcacgccgatatgggctactggattgagagtcagaagaatggtagctggaaactagagaaggcatcctttatcgaagttaagacgtgcacatggcccaaatctcataccctgtggtcgaacggcgtgctcgagagcgacatgattatccctaagtccctggcggggccaatatcacagcacaatcataggccgggataccacactcaaaccgccggcccctggcaccttgggaaattggaactggatttcaactattgcgagggaacaactgtagtcattaccgagaattgtggcacacgtggtcctagtttacggacgaccactgtgtctgggaagctcatccatgaatggtgctgtcgaagctgcacactgccaccccttagatacatgggagaggacggctgttggtatggtatggaaatcaggcctattaacgagaaagaagagaatatggtgaagtccctggtctcagctggcagcgggaaggttgataactttaccatgggagtgttgtgcctcgccatcctgttcgaggaagtaatgcgcggcaaattcgggaagaaacacatgattgcaggagtgctactgacttttatgctcctgctttctggccagataacatggcgggacatggctcataccttgatcatgattggttccaatgccagtgatagaatggggatgggagtcacgtacctggcattaatcgccactttcaagattcagccatttctcgctctgggcttctttcttaggaaactgaccagccgcgagaacctactcctgggcgtggggttggcgatggccacaaccctgcaattacccgaagacatcgagcagatggcaaatggaatagctctcggtctgatggcccttaagctgatcactcagttcgaaacatatcagttgtggaccgccctcgtttctctgacatgttccaacactatttttaccctaacggtggcttggcgaacagcaaccctgatccttgccggcgtctcactcctgccggtgtgccaaagtagctcgatgcggaagactgattggttgcctgttgcggtggctgccatgggggtcccacccctgcctttattcattttttccctcaaagacaccctgaagcgtagatcttggccccttaatgagggagtaatggcagtgggcctggttagcatcttggcctcaagtctcctgaggaacgatgtgccaatggctggtcctctagtcgcagggggactgcttatagcctgttacgtgattacaggcacttccgcggacctcaccgtagagaaagctgccgacgtgacgtgggaagaggaagcagagcagacaggcgtctctcacaacctgatgatcaccgttgatgacgatgggactatgcgcatcaaggacgatgaaacagagaatattttgaccgtgttactgaaaactgccctcctgatagtgagcggaatcttcccctattccattccagctacacttctggtctggcatacctggcagaagcagacgcaacggtcaggtgtgttgtgggacgttccgagccctcccgagactcagaaagccgaactagaggaaggcgtatacagaatcaagcagcaggggatttttggaaagacccaagtgggcgtcggtgtgcagaaagagggggttttccacacaatgtggcacgtgaccaggggagcagtcctgacacatagtggcaagcgactcgagccaaactgggcttctgtgaaaaaggatctgatctcctacggcgggggatggcgccttagcgcccagtggcaaaaaggtgaagaggtacaggtcatagcggtggaacccggccggaatcctaagaactttcagactatgccagggatcttccagaccacgacaggagagattggcgccatcgcattagacttcaagcccggtacttcggggtcacctattatcaatagagaaggaaaagttgtgggcctgtatggcaacggggtcgtgaccaagaatggaggttacgtttctggcatagctcaagccaacgctgagccggatgggccaacacccgagctcgaagaggaaatgtttaaaaagaggaatttgaccattatggacctgcaccctggaagtggcaaaactcgtaagtatctcccagcaatcgtgcgcgaggccatcaagcggagactgaggacccttattctggcccccacacgagtcgtggctgcggaaatggaggaggcattgaaaggtctacctatccggtaccagacgactgccaccaagtccgaacatacagggcgcgagatagtagatctgatgtgccacgctaccttcactatgagactcttaagcccggtgagggttcccaactataatctgattatcatggacgaagcccattttacagatccagcatctattgccgctcggggatacatcagcacccgagtcggcatgggcgaggcggccgcaatattcatgacggctactcctcccgggacagccgaagcatttccacagtccaacgcccctattcaggacgaggagagagacatccccgaacgctcatggaatagtggaaacgagtggatcaccgatttcgtgggtaaaaccgtgtggtttgtcccaagcattaaggctggcaatgacatcgccaactgtcttaggaaaaacgggaagaaggtaattcaactgtctcgtaaaactttcgatacagaatatcagaagaccaaactcaatgactgggattttgtggttacaactgacatatccgagatgggagcgaacttcaaggcagatcgggtgatcgacccgagaaggtgcttgaaacctgtcattctgacggatggccccgagcgcgtgatcctcgccggtccaatgcccgttaccgctgcctcagctgcacagcgaagagggcgggtgggcaggaatcctcagaaggaaaacgaccaatacatctttacaggacagccactgaataacgatgaggaccacgcccactggactgaagctaagatgcttctagacaatattaacacccccgagggcataatccctgccctgttcgaaccggagcgcgagaaaagtgcagcgattgatggggaataccgtttgaagggagagagcagaaaaacattcgtcgaattaatgcggaggggtgacctgccagtgtggctcgcccataaggtagcttccgagggcatcaaatataccgatcgcaagtggtgctttgacggggaacgaaataaccagattctggaggagaatatggatgtggaaatctggactaaagagggagaaagaaagaagcttcggcccaggtggctggacgcccgcacgtactctgatcctctcgcattgaaagagttcaaggactttgctgccggcagaaaatcgatagcactggatctagttaccgaaatcggtagggtccccagccacctggcccatcggacacgtaacgctctcgacaatcttgtgatgctgcacacttcagagcacgggggccgcgcgtatcgacatgccgtggaggaattaccagagaccatggaaacattgctgctcctgggacttatgattctgctcaccggcggggcaatgttgttcctgatctccggaaagggtattggcaaaactagtatcgggttaatatgtgtcattgtttctagcggaatgctatggatggctgatgtgcctctgcagtggatcgcctccgccattgtactcgagtttttcatgatggtgcttctgatccccgagccagaaaagcaaagaacacctcaggacaaccagttggcatacgtcgtgataggcatcctgacgctcgctgccattgttgcggctaatgagatgggtctgcttgaaaccactaagagggatctcgggatgtcaaaagagccgggcgtggtctctcccacaagctatctggacgtagacttgcacccagccagtgcatggaccctgtacgccgtggctaccacagttatcactcctatgttacggcatacgattgaaaactccaccgcaaatgtgagcctagccgcgatcgctaaccaagccgtcgtgctgatgggactcgataagggctggcccatatctaaaatggaccttggggtcccactgttggcactgggatgctattcacaggtgaaccctctcacactgactgccgctgttcttttactggtgacccactacgccattatcggccccggtctccaggcaaaggctacacgcgaggcccagaaaagaaccgcggccgggatcatgaagaatccgactgtagatggaattatgacgatcgacttggatccagtgatatacgactccaagtttgagaaacaactgggccaggtcatgctactggttctctgtgcagtgcagcttctgttgatgaggacaagttgggctctgtgcgaagccctcaccctggcaactggtcctattaccacattatgggagggcagccccgggaagttctggaacgctactatcgccgtctcgatggccaatatttttcggggatcttatcttgcgggcgctgggctggcattctccatcatgaaaagcgtgggaaccggcaagcgaggtacagggtcacagggagaaacgctcggcgagaaatggaagaagaaactaaaccaactgagtagacgcgaatttgagttgtacaagaaatctggtataaccgaggtagataggactgaagccaaggagggcctgaaacggggggaaacaacccatcacgctgtgtcccgtggaagcgccaagctccagtggttcgttgagagaaatatggtgatcccagaaggcagggtcattgaccttgggtgtggacgcggcggttggtcatattactgcgcagggctgaaaaaggtgactgaggtccggggatatacaaagggcggccccgggcacgaggaacctgtgccgatgagtacctacggatggaacacggttaaattgatgagcggtaaggatgtattttatctgcccccagagaaatgtgacaccctcttatgcgatatcggcgaatcctctcctagccccacagtggaggagtcccgaactattagagtcctgaagatggtggaaccttggcttaaaaataaccagttctgtatcaaggttctgaatccatacatgcccaccgtgattgagcatctagaaaggctccagcgcaagcacgggggaatgctggtccggaaccctttgtcaagaaattctacacatgagatgtactggatcagtaacggcactggtaatatagtgtcgagcgtaaacatggtgtcccgtctgctccttaataggttcaccatgacacaccggcgcccaaccattgaaaaagacgttgatctgggggccggaactcgacacgtcaacgctgagcccgagacgccgaacatggacgtgatcggcgaaagaatcaagaggattaaagaggaacattcttcaacatggcactatgacgatgagaatccttacaagacctgggcgtatcatggcagctacgaagtgaaagccactgggtccgcaagttctatgataaacggagtcgttaagttactgaccaagccatgggacgtggtacccatggtgacacaaatggctatgacggataccactccttttggtcagcagcgggtcttcaaagagaaggtggacacacgcaccccaagacccatgccgggcactaggaaagttatggagatcacagccgaatggttgtggcgaaccctcgggcggaataagcgtcctagactgtgcacacgcgaggaatttactaaaaaggtgaggaccaacgcagccatgggagctgtcttcacggaggaaaatcaatgggagagcgcccgggcggcagtggaggatgaagagttttggaagctagtaggcagagaacgcgagcttcacaaactgggtaagtgtgggtcatgcgtttataacatgatgggaaaaagggagaagaaactcggcgaattcggcaaggccaaagggtcccgagctatttggtacatgtggctgggagcccggtatttggagtttgaagcactgggtttcctcaatgaggaccattggtttagtagagaaaacagctactctggcgtggagggggagggacttcacaagctgggctacatcttaagggatatttccaagatccccggtggggctatgtatgccgacgataccgctggatgggacacacgcataactgaagatgacctgcacaatgaggaaaaaatcacccagcagatggacccagagcatcgtcagttggccaacgcaattttcaagctcacataccaaaataaagtcgtgaaggtgcagcggcctactcccaaaggcaccgtcatggatatcatttcaagaaaggaccagaggggcagcgggcaggttggaacgtatggtctgaacacatttaccaatatggaagcgcaactaatccgccagatggagggcgagggggtgctttcgaaggccgatctggaaaacccacacctcctggagaaaaagataactcagtggttggaaacaaaaggagtagagcgattaaagcggatggctatttctggcgacgattgcgtggtcaaacccatcgacgatagattcgccaatgcactgctcgctcttaacgacatgggtaaggtgaggaaggatatccctcagtggcaaccaagtaaagggtggcatgactggcagcaggttccgttttgttcccaccacttccatgaactgattatgaaggatggacgcaaactagtggtcccctgcagacctcaggacgagctgataggccgggccaggatcagccaaggcgcagggtggtcactcaaggagaccgcctgtttgggaaaagcgtacgctcagatgtggtccctgatgtatttccaccgtcgagatcttcgcctggcctctaacgcaatttgcagcgccgtgccagtacattgggttcccactagtagaaccacatggtccatccacgctcatcaccagtggatgacgaccgaagacatgctcactgtgtggaatcgggtctggattgaggacaacccttggatggaagataagacaccagtgaccacttgggaggacgttccctacttaggtaagagggaggatcaatggtgtggcagcctgatcgggttgacatctcgcgccacctgggcacagaatatactgacggctatccagcaggtgagatcactcattggagacgaagagtttcttgattatatgcctagtatgaaacggttcaggaaggaagaggaatccgagggcgccatctggtga

SEQ ID NO: 15612 - RNA, 9873 nt, synthetic construct
  misc_feature 1..9873: note = derived and/or modified CDS sequence (opt3) from DENV-3__KJ622195__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaatcacagagacccctacttggaataggaaagaactgttggtaacatttaagaacgctcacgccaaaaagcaagaggttgtggtcctcggctcacaggaaggagctatgcacacggccctgaccggcgcaactgagattcagaatagtgggggaacaagcatattcgccggtcatttaaagtgtcggctgaaaatggataagctagaactcaaaggcatgtcttatgctatgtgcctgaacacctttgtgcttaagaaagaggtctccgagacacagcacgggactatcttgattaaggtggaatacaagggagaggacgcgccatgtaaaatccccttctcaaccgaagatggccaaggtaaggcacataacgggcgtctgataacggccaatcctgttgtgaccaaaaaggaggagccagtaaacattgaagctgagcccccgttcggcgaaagcaatatcgtcatcggaattggcgacaaagccctcaagatcaactggtacaagaaagggagttctattggaaagatgtttgaggcaacagcccgcggtgctagaaggatggccatactgggcgatactgcatgggacttcgggtccgtgggaggcgttcttaatagcctgggtaaaatggtgcaccagatctttgggtcggcgtataccgctttgttcggcggagtctcttggattatgaagatcggcatcggggtgctcctgacatggattggattaaactccaaaaatacttcaatgagttttagctgcatagtaatcggcattatcaccctgtacctaggtacggtggttcaggccgatatggggtgtgtcattaactggaagggaaaggaactcaaatgcggctccggtatcttcgtgacaaatgaggtgcatacctggactgagcagtataagtttcaagcagactctcctaaacggctggccacagctatagccggcgcatgggaaaacggggtctgtggaatccgaagcaccactcgcatggagaatcttttgtggaagcagattgctaacgaactgaattacatcctctgggagaacaatattaaactgaccgttgtggtgggcgatatcataggggtattagaacagggaaagagaacactgacgccccagccaatggagcttaaatattcatggaagacctggggcaaggccaaaattgtcactgcggagatccaaaacagttccttcattatcgacggtcctaacacacccgaatgcccaagcgcctctagggcttggaatgtgtgggaggttgaagactacgggtttggagtgttcaccacaaacatatggttgaagctccgggaggtctatactcagacctgtgatcaccgcctgatgtcagcagccatcaaagacgaaagagctgtgcacgccgatatgggctactggattgagagtcagaagaatggtagctggaaactagagaaggcatcctttatcgaagttaagacgtgcacatggcccaaatctcataccctgtggtcgaacggcgtgctcgagagcgacatgattatccctaagtccctggcggggccaatatcacagcacaatcataggccgggataccacactcaaaccgccggcccctggcaccttgggaaattggaactggatttcaactattgcgagggaacaactgtagtcattaccgagaattgtggcacacgtggtcctagtttacggacgaccactgtgtctgggaagctcatccatgaatggtgctgtcgaagctgcacactgccaccccttagatacatgggagaggacggctgttggtatggtatggaaatcaggcctattaacgagaaagaagagaatatggtgaagtccctggtctcagctggcagcgggaaggttgataactttaccatgggagtgttgtgcctcgccatcctgttcgaggaagtaatgcgcggcaaattcgggaagaaacacatgattgcaggagtgctactgacttttatgctcctgctttctggccagataacatggcgggacatggctcataccttgatcatgattggttccaatgccagtgatagaatggggatgggagtcacgtacctggcattaatcgccactttcaagattcagccatttctcgctctgggcttctttcttaggaaactgaccagccgcgagaacctactcctgggcgtggggttggcgatggccacaaccctgcaattacccgaagacatcgagcagatggcaaatggaatagctctcggtctgatggcccttaagctgatcactcagttcgaaacatatcagttgtggaccgccctcgtttctctgacatgttccaacactatttttaccctaacggtggcttggcgaacagcaaccctgatccttgccggcgtctcactcctgccggtgtgccaaagtagctcgatgcggaagactgattggttgcctgttgcggtggctgccatgggggtcccacccctgcctttattcattttttccctcaaagacaccctgaagcgtagatcttggccccttaatgagggagtaatggcagtgggcctggttagcatcttggcctcaagtctcctgaggaacgatgtgccaatggctggtcctctagtcgcagggggactgcttatagcctgttacgtgattacaggcacttccgcggacctcaccgtagagaaagctgccgacgtgacgtgggaagaggaagcagagcagacaggcgtctctcacaacctgatgatcaccgttgatgacgatgggactatgcgcatcaaggacgatgaaacagagaatattttgaccgtgttactgaaaactgccctcctgatagtgagcggaatcttcccctattccattccagctacacttctggtctggcatacctggcagaagcagacgcaacggtcaggtgtgttgtgggacgttccgagccctcccgagactcagaaagccgaactagaggaaggcgtatacagaatcaagcagcaggggatttttggaaagacccaagtgggcgtcggtgtgcagaaagagggggttttccacacaatgtggcacgtgaccaggggagcagtcctgacacataacggcaagcgactcgagccaaattgggctagtgtgaaaaaggatctgatctcttacggcgggggatggcgcctttccgcccagtggcaaaaaggtgaagaggtacaggtcatagcggtggaacccggccggaaccctaagaattttcagactatgccagggatcttccagaccacgacaggagagattggcgccatcgcattagacttcaagcccggtactagcgggtcgcctattatcgatagagaaggaaaagttgtgggcctgtatggcaacggggtcgtgaccaagaatggaggttacgtttcaggcatagctcaagccaacgctgagccggacgggccaacacccgagctcgaagaggaaatgtttaaaaagaggaatttgaccattatggatctgcaccctggatctggcaaaactcgtaagtatctcccagcaatcgtgcgcgaggccatcaagcggagactgaggacccttattctggcccccacacgagtcgtggctgcggaaatggaggaggcattgaaaggtctacctatccggtaccagacgactgccaccaagagtgaacatacagggcgcgagatagtagacctgatgtgccacgctaccttcactatgagactcttatccccggtgagggttcccaactataatctgattatcatggatgaagcccattttacagacccagcaagcattgccgctcggggatacatctctacccgagtcggcatgggcgaggcggccgcaatattcatgacggctactcctcccgggacagccgaagcatttccacagagcaacgcccctattcaggacgaggagagagatatccccgaacgctcctggaattcaggaaacgagtggatcaccgacttcgtgggtaaaaccgtgtggtttgtcccaagtattaaggctggcaatgatatcgccaactgtcttaggaaaaacgggaagaaggtaattcaactgagccgtaaaactttcgacacagaatatcagaagaccaaactcaatgattgggactttgtggttacaactgatatatctgagatgggagcgaacttcaaggcagaccgggtgatcgatccgagaaggtgcttgaaacctgtcattctgacggacggccccgagcgcgtgatcctcgccggtccaatgcccgttaccgctgcctccgctgcacagcgaagagggcgggtgggcaggaatcctcagaaggaaaacgatcaatacatctttacaggacagccactgaataacgacgaggaccacgcccactggactgaagctaagatgcttctagataatattaacacccccgagggcataatccctgccctgttcgaaccggagcgcgagaaatcagcagcgattgacggggaataccgtttgaagggagagagtagaaaaacattcgtcgaattaatgcggaggggtgatctgccagtgtggctcgcccataaggtagctagcgagggcatcaaatataccgaccgcaagtggtgctttgatggggaacgaaataaccagattctggaggagaatatggacgtggaaatctggactaaagagggagaaagaaagaagcttcggcccaggtggctggatgcccgcacgtactccaaccctctcgcattgaaagagttcaaggactttgctgccggcagaaaatctatagcactggatctagttaccgaaatcggtagggtcccctcgcacctggcccatcggacacgtaatgctctcgacaaccttgtgatgctgcacactagcgagcacgggggccgcgcgtatcgacatgccgtggaggaattaccagagaccatggaaacattgctgctcctgggacttatgattctgctcaccggcggggcaatgttgttcctgatctcaggaaagggtattggcaaaacttccatcgggttaatatgtgtcattgttagttctggaatgctatggatggctgatgtgcctctgcagtggatcgccagcgccattgtactcgagtttttcatgatggtgcttctgatccccgagccagaaaagcaaagaacacctcaggacaatcagttggcatacgtcgtgataggcatcctgacgctcgctgccattgttgcggctaacgagatgggtctgcttgaaaccactaagagggatctcgggatgtccaaagagccgggcgtggtctcacccacatcttatctggacgtagacttgcacccagccagcgcatggaccctgtacgccgtggctaccacagttatcactcctatgttacggcatacgattgaaaatagtaccgcaaacgtgtccctagccgcgatcgctaaccaagccgtcgtgctgatgggactcgataagggctggcccataagcaaaatggaccttggggtcccactgttggcactgggatgctattctcaggtgaatcctctcacactgactgccgctgttcttttactggtgacccactacgccattatcggccccggtctccaggcaaaggctacacgcgaggcccagaaaagaaccgcggccgggatcatgaagaacccgactgtagatggaattatgacgatcgacttggatccagtgatatacgactcaaagtttgagaaacaactgggccaggtcatgctactggttctctgtgcagtgcagcttctgttgatgaggacatcctgggctctgtgcgaagccctcaccctggcaactggtcctattaccacattatgggagggcagtcccgggaagttctggaatactaccatcgctgtcagcatggccaacatttttcggggatcgtatcttgccggcgcggggctggctttctctatcatgaaatccgtgggaacaggcaagcgaggtacggggagccagggagaaaccctcggcgagaaatggaagaagaaactaaatcaactgtcaagacgcgaatttgagttgtacaagaaaagtggtataactgaggtagataggacagaagcaaaggagggcctgaaacggggggaaaccactcatcacgccgtgtctcgtggatccgctaagctccagtggttcgttgagagaaacatggtgatcccagaaggcagggtcattgaccttgggtgtggacgcggcggttggagctattactgcgccgggctgaaaaaggtgacagaggtccggggatataccaagggcggccccgggcacgaggaacctgtgccgatgtcaacgtacggatggaataccgttaaattgatgagtggtaaggatgtattttatctgcccccagagaaatgtgacacactcttatgcgatatcggcgaaagctccccttctcccactgtggaggagagccgaaccattagagtcctgaagatggtggaaccttggcttaaaaacaatcagttctgtatcaaggttctgaacccatacatgcccacagtgattgagcatctagaaaggctccagcgcaagcacgggggaatgctggtccggaatcctttgtccagaaactcaactcatgagatgtactggatctctaatggcaccggtaacatagtgagttcggtaaatatggtgagccgtctgctccttaacaggttcacaatgacccaccggcgcccaactattgaaaaagacgttgatctgggggcaggaacgcgacacgtcaacgccgagcccgagacaccgaatatggacgtgatcggcgaaagaatcaagaggattaaagaggaacattcctctacctggcactatgacgatgagaacccttacaagacttgggcttatcatggctcatacgaagtgaaagcgaccgggagcgcctccagtatgataaatggagtcgttaagttactgacaaagccatgggacgtggtacccatggtgacgcaaatggcaatgaccgatactacaccttttggtcagcagcgggtcttcaaagagaaggtggacacccgcactccaagacccatgccgggcacaaggaaagttatggagatcaccgctgaatggttgtggcgaacactcgggcggaacaagcgtcctagactgtgcactcgcgaggaatttaccaaaaaggtgaggacgaatgccgcaatgggagccgtcttcaccgaggaaaaccaatgggagtctgctcgggccgcggtggaggatgaagagttttggaagctagtaggcagagaacgcgagcttcacaaactgggtaagtgtgggagctgcgtttataatatgatgggaaaaagggagaagaaactcggcgaattcggcaaggcaaaagggtcacgagccatttggtacatgtggctgggagctcggtatttggagtttgaagccctgggtttcctcaacgaggaccattggttttccagagaaaatagttacagcggcgtggagggggagggacttcacaagctgggctacatcttaagggatatttctaagatccccggtggggcaatgtatgctgacgatacagccggatgggacactcgcataaccgaagatgacctgcacaacgaggaaaaaatcacacagcagatggacccagagcatcgtcagttggctaatgccattttcaagctcacttaccaaaacaaagtcgtgaaggtgcagcggcctacccccaaaggcacggtcatggatatcatttccagaaaggaccagaggggctcagggcaggttggaacatatggtctgaatacctttactaacatggaagcacaactaatccgccagatggagggcgagggggtgcttagcaaggcggatctggaaaatccacacctcctggagaaaaagataacacagtggttggaaaccaaaggagtagagcgattaaagcggatggccatttcgggcgacgattgcgtggtcaaacccatcgacgatagattcgctaacgccctgctcgcacttaacgacatgggtaaggtgaggaaggatatccctcagtggcaaccatctaaagggtggcatgactggcagcaggttccgttttgtagtcaccacttccatgaactgattatgaaggatggacgcaaactagtggtcccctgcagacctcaggacgagctgataggccgggctaggatctcccaaggcgccgggtggagcctcaaggagactgcatgtttgggaaaagcctacgcgcagatgtggtcactgatgtatttccaccgtcgagatcttcgcctggcttccaatgccatttgctctgcagtgccagtacattgggttcccaccagcagaacaacgtggagtatccacgcccatcaccagtggatgaccactgaagacatgctcacagtgtggaaccgggtctggattgaggacaatccttggatggaagataagaccccagtgactacatgggaggacgttccctacttaggtaagagggaggatcaatggtgtggctccctgatcgggttgaccagccgcgctacgtgggcccagaacatactgacagcaatccagcaggtgagatctctcattggagacgaagagtttcttgattatatgccttcaatgaaacggttcaggaaggaagaggaaagtgagggcgctatctggtga

SEQ ID NO: 15613 - RNA, 9873 nt, synthetic construct
  misc_feature 1..9873: note = derived and/or modified CDS sequence (opt3) from DENV-3__KJ622196__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaatcacagagacccctacttggaataggaaagaactgttggtaacatttaagaacgctcacgccaaaaagcaagaggttgtggtcctcggctcacaggaaggagctatgcacacggccctgaccggcgcaactgagattcagaatagtgggggaacaagcatattcgccggtcatttaaagtgtcggctgaaaatggataagctagaactcaaaggcatgtcttatgctatgtgcctgaacacctttgtgcttaagaaagaggtctccgagacacagcacgggactatcttgattaaggtggaatacaagggagaggacgcgccatgtaaaatccccttctcaaccgaagatggccaaggtaaggcacataacgggcgtctgataacggccaatcctgttgtgaccaaaaaggaggagccagtaaacattgaagctgagcccccgttcggcgaaagcaatatcgtcatcggaattggcgacaaagccctcaagatcaactggtacaagaaagggagttctattggaaagatgtttgaggcaacagcccgcggtgctagaaggatggccatactgggcgatactgcatgggacttcgggtccgtgggaggcgttcttaatagcctgggtaaaatggtgcaccagatctttgggtcggcgtataccgctttgttcggcggagtctcttggattatgaagatcggcatcggggtgctcctgacatggattggattaaactccaaaaatacttcaatgagttttagctgcatagtaatcggcattatcaccctgtacctaggtacggtggttcaggccgatatggggtgtgtcattaactggaagggaaaggaactcaaatgcggctccggtatcttcgtgacaaatgaggtgcatacctggactgagcagtataagtttcaagcagactctcctaaacggctggccacagctatagccggcgcatgggaaaacggggtctgtggaatccgaagcaccactcgcatggagaatcttttgtggaagcagattgctaacgaactgaattacatcctctgggagaacaatattaaactgaccgttgtggtgggcgatatcataggggtattagaacagggaaagagaacactgacgccccagccaatggagcttaaatattcatggaagacctggggcaaggccaaaattgtcactgcggagatccaaaacagttccttcattatcgacggtcctaacacacccgaatgcccaagcgcctctagggcttggaatgtgtgggaggttgaagactacgggtttggagtgttcaccacaaacatatggttgaagctccgggaggtctatactcagacctgtgatcaccgcctgatgtcagcagccatcaaagacgaaagagctgtgcacgccgatatgggctactggattgagagtcagaagaatggtagctggaaactagagaaggcatcctttatcgaagttaagacgtgcacatggcccaaatctcataccctgtggtcgaacggcgtgctcgagagcgacatgattatccctaagtccctggcggggccaatatcacagcacaatcataggccgggataccacactcaaaccgccggcccctggcaccttgggaaattggaactggatttcaactattgcgagggaacaactgtagtcattaccgagaattgtggcacacgtggtcctagtttacggacgaccactgtgtctgggaagctcatccatgaatggtgctgtcgaagctgcacactgccaccccttagatacatgggagaggacggctgttggtatggtatggaaatcaggcctattaacgagaaagaagagaatatggtgaagtccctggtctcagctggcagcgggaaggttgataactttaccatgggagtgttgtgcctcgccatcctgttcgaggaagtaatgcgcggcaaattcgggaagaaacacatgattgcaggagtgctactgacttttatgctcctgctttctggccagataacatggcgggacatggctcataccttgatcatgattggttccaatgccagtgatagaatggggatgggagtcacgtacctggcattaatcgccactttcaagattcagccatttctcgctctgggcttctttcttaggaaactgaccagccgcgagaacctactcctgggcgtggggttggcgatggccacaaccctgcaattacccgaagacatcgagcagatggcaaatggaatagctctcggtctgatggcccttaagctgatcactcagttcgaaacatatcagttgtggaccgccctcgtttctctgacatgttccaacactatttttaccctaacggtggcttggcgaacagcaaccctgatccttgccggcgtctcactcctgccggtgtgccaaagtagctcgatgcggaagactgattggttgcctgttgcggtggctgccatgggggtcccacccctgcctttattcattttttccctcaaagacaccctgaagcgtagatcttggccccttaatgagggagtaatggcagtgggcctggttagcatcttggcctcaagtctcctgaggaacgatgtgccaatggctggtcctctagtcgcagggggactgcttatagcctgttacgtgattacaggcacttccgcggacctcaccgtagagaaagctgccgacgtgacgtgggaagaggaagcagagcagacaggcgtctctcacaacctgatgatcaccgttgatgacgatgggactatgcgcatcaaggacgatgaaacagagaatattttgaccgtgttactgaaaactgccctcctgatagtgagcggaatcttcccctattccattccagctacacttctggtctggcatacctggcagaagcagacgcaacggtcaggtgtgttgtgggacgttccgagccctcccgagactcagaaagccgaactagaggaaggcgtatacagaatcaagcagcaggggatttttggaaagacccaagtgggcgtcggtgtgcagaaagagggggttttccacacaatgtggcacgtgaccaggggagcagtcctgacacataacggcaagcgactcgagccaaattgggctagtgtgaaaaaggatctgatctcttacggcgggggatggcgcctttccgcccagtggcaaaaaggtgaagaggtacaggtcatagcggtggaacccggccggaaccctaagaattttcagactatgccagggatcttccagaccacgacaggagagattggcgccatcgcattagacttcaagcccggtactagcgggtcgcctattatcaacagagaaggaaaagttgtgggcctgtatggcaatggggtcgtgaccaagaacggaggttacgtttcaggcatagctcaagccaatgctgagccggatgggccaacacccgagctcgaagaggaaatgtttaaaaagaggaacttgaccattatggacctgcaccctggatctggcaaaactcgtaagtatctcccagcaatcgtgcgcgaggccatcaagcggagactgaggacccttattctggcccccacacgagtcgtggctgcggaaatggaggaggcattgaaaggtctacctatccggtaccagacgactgccaccaagagtgaacatacagggcgcgagatagtagatctgatgtgccacgctaccttcactatgagactcttatccccggtgagggttcccaattataacctgattatcatggacgaagcccattttacagatccagcaagcattgccgctcggggatacatctctacccgagtcggcatgggcgaggcggccgcaatattcatgacggctactcctcccgggacagccgaagcatttccacagagcaatgcccctattcaggacgaggagagagacatccccgaacgctcctggaactcaggaaatgagtggatcaccgatttcgtgggtaaaaccgtgtggtttgtcccaagtattaaggctggcaacgacatcgccaactgtcttaggaaaaatgggaagaaggtaattcaactgagccgtaaaactttcgatacagaatatcagaagaccaaactcaacgactgggattttgtggttacaactgacatatctgagatgggagcgaatttcaaggcagatcgggtgatcgacccgagaaggtgcttgaaacctgtcattctgacggatggccccgagcgcgtgatcctcgccggtccaatgcccgttaccgctgcctccgctgcacagcgaagagggcgggtgggcaggaaccctcagaaggaaaatgaccaatacatctttacaggacagccactgaacaatgatgaggaccacgcccactggactgaagctaagatgcttctagacaacattaatacccccgagggcataatccctgccctgttcgaaccggagcgcgagaaatcagcagcgattgatggggaataccgtttgaagggagagagtagaaaaacattcgtcgaattaatgcggaggggtgacctgccagtgtggctcgcccataaggtagctagcgagggcatcaaatataccgatcgcaagtggtgctttgacggggaacgaaacaatcagattctggaggagaacatggatgtggaaatctggactaaagagggagaaagaaagaagcttcggcccaggtggctggacgcccgcacgtactccaatcctctcgcattgaaagagttcaaggattttgctgccggcagaaaatctatagcactggacctagttaccgaaatcggtagggtcccctcgcacctggcccatcggacacgtaacgctctcgataatcttgtgatgctgcacactagcgagcacgggggccgcgcgtatcgacatgccgtggaggaattaccagagaccatggaaacattgctgctcctgggacttatgattctgctcaccggcggggcaatgttgttcctgatctcaggaaagggtattggcaaaacttccatcgggttaatatgtgtcattgttagttctggaatgctatggatggctgacgtgcctctgcagtggatcgccagcgccattgtactcgagtttttcatgatggtgcttctgatccccgagccagaaaagcaaagaacacctcaggataaccagttggcatacgtcgtgataggcatcctgacgctcgctgccattgttgcggctaatgagatgggtctgcttgaaaccactaagagggacctcgggatgtccaaagagccgggcgtggtctcacccacatcttatctggatgtagacttgcacccagccagcgcatggaccctgtacgccgtggctaccacagttatcactcctatgttacggcatacgattgaaaacagtaccgcaaacgtgtccctagccgcgatcgctaatcaagccgtcgtgctgatgggactcgacaagggctggcccataagcaaaatggatcttggggtcccactgttggcactgggatgctattctcaggtgaaccctctcacactgactgccgctgttcttttactggtgacccactacgccattatcggccccggtctccaggcaaaggctacacgcgaggcccagaaaagaaccgcggccgggatcatgaagaatccgactgtagacggaattatgacgatcgatttggacccagtgatatacgattcaaagtttgagaaacaactgggccaggtcatgctactggttctctgtgcagtgcagcttctgttgatgaggacatcctgggctctgtgcgaagccctcaccctggcaactggtcctattaccacattatgggagggcagtcccgggaagttctggaacactaccatcgctgtcagcatggccaatatttttcggggatcgtatcttgccggcgcggggctggctttctctatcatgaaatccgtgggaacaggcaagcgaggtacggggagccagggagaaaccctcggcgagaaatggaagaagaaactaaaccaactgtcaagacgcgaatttgagttgtacaagaaaagtggtataactgaggtagacaggacagaagcaaaggagggcctgaaacggggggaaaccactcatcacgccgtgtctcgtggatccgctaagctccagtggttcgttgagagaaatatggtgatcccagaaggcagggtcattgatcttgggtgtggacgcggcggttggagctattactgcgccgggctgaaaaaggtgacagaggtccggggatataccaagggcggccccgggcacgaggaacctgtgccgatgtcaacgtacggatggaacaccgttaaattgatgagtggtaaggacgtattttatctgcccccagagaaatgtgatacactcttatgcgacatcggcgaaagctccccttctcccactgtggaggagagccgaaccattagagtcctgaagatggtggaaccttggcttaaaaataaccagttctgtatcaaggttctgaatccatacatgcccacagtgattgagcatctagaaaggctccagcgcaagcacgggggaatgctggtccggaaccctttgtccagaaattcaactcatgagatgtactggatctctaacggcaccggtaatatagtgagttcggtaaacatggtgagccgtctgctccttaacaggttcacaatgacccaccggcgcccaactattgaaaaagatgttgacctgggggcaggaacgcgacacgtcaatgccgagcccgagacaccgaacatggatgtgatcggcgaaagaatcaagaggattaaagaggaacattcctctacctggcactatgacgacgagaatccttacaagacttgggcttatcatggctcatacgaagtgaaagcgaccgggagcgcctccagtatgataaacggagtcgttaagttactgacaaagccatgggatgtggtacccatggtgacgcacatggcaatgaccgacactacaccttttggtcaacagcgggtcttcaaagagaaggtggatacccgcactccaagacccatgccgggcacaaggaaagttatggagatcaccgctgaatggttgtggcgaacactcgggcggaataagcgtcctagactgtgcactcgcgaggaatttaccaaaaaggtgaggacgaacgccgcaatgggagccgtcttcaccgaggaaaatcagtgggagtctgctcgggccgcggtggaggacgaagagttttggaagctagtaggcagagaacgcgagcttcataaactgggtaagtgtgggagctgcgtttataacatgatgggaaaaagggagaagaaactcggcgaattcggcaaggcaaaagggtcacgagccatttggtacatgtggctgggagctcggtatttggagtttgaagccctgggtttcctcaatgaggatcactggttttccagagaaaacagttacagcggcgtggagggggagggacttcacaagctgggctacatcttaagggacatttctaagatccccggtggggcaatgtatgctgatgacacagccggatgggatactcgcataaccgaagacgatctgcataatgaggaaaaaatcacacaacagatggacccagagcaccgtcagttggctaacgccattttcaagctcacttaccagaataaagtcgtgaaggtgcaacggcctacccccaaaggcacggtcatggacatcatttccagaaaggatcagaggggctcagggcaggttggaacatatggtctgaacacctttactaatatggaagcacagctaatccgccaaatggagggcgagggggtgcttagcaaggcggacctggaaaacccacatctcctggagaaaaagataacacagtggttggaaaccaaaggagtagagcgattaaagcggatggccatttcgggcgatgactgcgtggtcaaacccatcgatgacagattcgctaacgccctgctcgcacttaatgatatgggtaaggtgaggaaggacatccctcagtggcagccatctaaagggtggcacgattggcaacaggttccgttttgtagtcaccatttccacgaactgattatgaaggacggacgcaaactagtggtcccctgcagacctcaggatgagctgataggccgggctaggatctcccagggcgccgggtggagcctcaaggagactgcatgtttgggaaaagcctacgcgcaaatgtggtcactgatgtatttccatcgtcgagaccttcgcctggcttccaacgccatttgctctgcagtgccagtacactgggttcccaccagcagaacaacgtggagtatccatgcccaccaccagtggatgaccactgaagatatgctcacagtgtggaatcgggtctggattgaggacaacccttggatggaagacaagaccccagtgactacatgggaggatgttccctacttaggtaagagggaggaccagtggtgtggctccctgatcgggttgaccagccgcgctacgtgggcccaaaatatactgacagcaatccagcaggtgagatctctcattggagatgaagagtttcttgactatatgccttcaatgaaacggttcaggaaggaagaggaaagtgagggcgctatctggtga

SEQ ID NO: 15614 - RNA, 9873 nt, synthetic construct
  misc_feature 1..9873: note = derived and/or modified CDS sequence (opt3) from DENV-3__KJ830751__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttgggccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgtcaatgagttttagctgcattgccataggaatcattacactgtatttaggcgcagtggttcaggccgacatgggttgtgtcatcaattggaaagggaaggagctgaagtgcggatccggcattttcgtgaccaacgaggtgcatacttggacagaacagtacaaatttcaagctgattctcccaagcggctagccaccgcaatcgctggtgcctgggagaatggcgtctgtgggatacgaagcactacccgcatggaaaacctcctgtggaaacagatcgcgaatgagcttaactatattttgtgggaaaataacatcaagctgacagttgtggtgggagacacgattggcgtactcgagcaggggaaaagaaccctgactccacagcctatggagttaaagtactcatggaaaacatggggaaaggccaagatcgtcaccgctgaaacacaaaacagttccttcataattgatggccccaatactccagagtgccccagcgcatctagggcctggaacgtgtgggaagttgaggactatggttttggggtgttcaccacgaatatctggctgaaacttcgggaagtctacacacagttgtgtgaccaccgcctcatgtcagctgccgtgaaggatgagagagcagttcacgcggacatgggatactggattgagagtcagaaaaacggcagctggaagctggaaaaagcctccctaatcgaggtgaagacctgcacttggcctaagtctcataccctgtggtcgaatggtgtactcgaaagcgatatgataatcccaaaatccctggctggcccgatttcacagcacaactataggcccgggtaccatacacaaactgccggaccttggcaccttggcaagttggagctggactttaattattgcgaggggaccacagtcgtgatcacggaaagttgtggaacccgtggcccatctttacggactacaaccgtgagcggtaaactcattcacgagtggtgctgtcgatcctgcactctgccccctcttagatacatgggggaagatggatgttggtatggcatggagatcaggccaatatcagaaaaggaggagaacatggtcaaaagcctggtttctgcaggttccggcaaggtggacaatttcacaatgggggtattgtgcctcgctattctgtacgaagaggtgatgcgcggaaagtttggcaaaaagcatatgatcgccggggtcttcttcacctttgtgctactgctcagtggacagatcacgtggcggaacatggcacacactctgattatgatcggcagcaatgcctctgatagaatgggtatgggggttacctatcttgctttgattgcgacattcaaaatacagccctttctggccttaggattctttctcaggaagctgacctcccgcgaaaaccttctgctaggcgtgggcctcgcaatggctactacactgcaattgccggacgatatcgagcagatggccaatgggattgccctgggattaatggctctcaaactgatcacccagttcgaaacataccagctttggactgcactggtctcattgacctgtagtaacacgatgtttacactcaccgtggcctggcgaactgcgaccctgattctagctggtgttagcctgcttcctgtgtgccaatcgtcctctatgcggaagacagactggctcccaatggccgtcgcagccatgggcgtaccccctctgcccttgttcatctttaatctgaaggatactttaaaacgtagaagctggccactcaacgagggggtgatggctgttggactggtgtcaatacttgcaagttccctgttgaggaacgacgtccctatggccggccccctcgtggcgggtgggctgctaatcgcttgttacgtaattaccggaacgtctgccgatctgacagtggagaaggcagccgacgtcacctgggaagaggaagctgagcagactggcgttagccataatcttatgatcacagtggacgatgacggcaccatgcgcattaaagatgacgaaatcgagaacatactcactgtgctgttgaagacagccttactgattgtctccgggatcttcccatattcaatcccggcaaccctcctggtgtggcacacgtggcagaaacagactcaacggagcggagttctttgggatgtacctagtcccccagagacccagaaggctgaactggaggaaggtgtgtacagaattaaacagcagggcatatttgggaagacacaagtcggagtgggcgttcagaaggagggtgtgttccataccatgtggcacgtcacaaggggggccgtgttgactcacaatggaaaacgactagagcccaactgggcgtctgtaaagaaagacctgatctcctatggcggcgggtggcgcctcagcgcccagtggcaaaagggagaagaggtccaggtgattgcagttgaacctggtaaaaatccaaagaactttcagaccatgcccggcacgttccagacaactaccggggagatcggagctattgccctggatttcaagcctggcacatcgggttcaccgatcataaatcgggaagggaaagtggtcggactttacggcaacggcgtggttaccaagaatgggggatatgtgtctggtatcgctcaaactaacgcagagccagacggccccacccctgagttagaagaggaaatgtttaaaaagagaaatctgacaattatggatctccatccagggagtggaaaaacgaggaagtacttgcccgccatcgtccgtgaggccattaagcgccggctgagaactctcatcctggctcctaccagggtggtagcggcagaaatggaggaggcccttaaaggcctgccgatacgatatcagacaaccgctactaagtccgaacacacaggtcgggagattgtggacttgatgtgccatgccaccttcacgatgcgcctactgagccccgttagagtcccaaactacaatctcatcatcatggatgaagcacactttactgaccctgcctctattgctgcgagggggtacatcagcacacgggtgggaatgggcgaggccgcagctatattcatgaccgccacccccccaggcactgcagatgcctttcctcagtccaacgctcccattcaggacgaagagcgagacatcccagagagatcatggaatagtgggaacgaatggattacagatttcgccggaaaaaccgtgtggtttgtcccgagcatcaaggcgggtaacgacatagcaaattgtttacgcaaaaacggcaagaaggtaattcaactgtctaggaaaacattcgatactgagtatcagaagacgaaacttaatgactgggattttgtggttaccacagacatctccgaaatgggggccaacttcaaggctgatcgtgtgatcgaccctcggagatgcctgaaacccgtcattctcactgatggaccagagagggtgatcttggccggccccatgcctgttaccgctgcatcagccgctcagcgccgaggtagagtggggcggaatccacagaaggagaacgaccaatacatttttacaggccagcccctgaataacgatgaagaccatgcccactggaccgaggcaaagatgctcctggacaatataaacactcctgaaggaatccttccggcgctattcgagccagaaagggagaaaagtgccgctattgatggcgagtatcgcctgaagggggaaagccgtaaaacgttcgtcgagttgatgagacggggagacttacccgtgtggctggcccacaaggtagcatccgaaggtatcaaatacaccgataggaagtggtgctttgacggccagcgcaataaccagatcctcgaggaaaatatggatgtggagatttggacaaaagagggggaaaagaagaaactgcgacctagatggcttgacgctcggacttattctgatcccctggccctcaaggagttcaaagactttgcagccggaaggaagtcgatagctttggatctggttaccgaaatcggccgcgtcccaagccatctagcgcacagaacaaggaacgccctggacaatctcgtgatgcttcatacctcagagcacggtgggcgggcataccgtcacgctgtggaagagctgcctgagactatggaaacattattgctgctcggcctgatgattcttctgacgggaggcgccatgctcttcttgatctccgggaaaggaattggtaagaccagtatcggcctgatatgtgtcatcgcctctagcgggatgttatggatggcagaggttcccctacaatggattgcttccgccatcgtgctggaatttttcatgatggtactccttattccagagcctgagaagcagcgcactccgcaggataaccaactggcgtatgtggtcatcggaatattgacactggctgccattatcgcagccaatgaaatgggcctcctggagaccaccaaacgagaccttggtatgtcaaaggaacccggggtggtttctccaacaagctacctcgatgtggacctgcatcctgctagtgcatggactttgtacgccgtcgcgacgaccgtaattacacccatgctgagacacactatcgagaactccaccgctaacgtgagcttagccgcaatagccaatcaggctgttgtgctaatgggcctggacaaaggatggccaatctctaagatggatctcggcgtccctcttctggccttggggtgctattcacaggtgaaccccctgacactcaccgcagctgtcctgcttttaattactcattacgccatcattggaccgggcctgcaggcgaaagccacgagggaagcacaaaagcggacagctgccggtatcatgaagaatccaaccgtggacgggataatgactattgatctcgaccctgttatctatgattccaaatttgagaagcagttgggacaggtgatgctgctagtactgtgtgcagtgcagctccttctgatgcgcaccagttgggctttgtgcgaggccctgacactcgccactggccccatcaccacactgtgggaaggtagcccaggcaaattctggaacacgaccattgcggtctcgatggctaatatctttagagggtcttacttagcaggagccggccttgctttctccataatgaagagcgttgggactggaaaaaggggcacaggttcacaaggggagaccctgggagaaaagtggaagaaaaagctcaaccagctaagtcggaaagagtttgacctgtataagaaatctggcattactgaagtggatcgaacagaggccaaggagggtttgaaaagaggcgaaaccacgcaccatgcagtctcccgcgggagcgccaagctgcagtggttcgtggagaggaatatggtagtgcccgaaggacgggttatcgacctcggctgtgggcgtggaggctggtcatactattgcgctggtcttaagaaagtgaccgaggtcagagggtacacaaagggaggccctggccacgaagagccggtgcccatgagtacttacgggtggaacattgtcaaactgatgagcggaaaggatgtgttttatttgccacctgagaaatgtgacaccctgctctgcgatatcggtgaatcctctcccagccctacagttgaggaatccaggactatacgcgtattaaagatggtggagccatggctgaagaataaccagttctgtatcaaagtccttaatccctacatgcctaccgtgattgagcacctggaacggctacaacgaaagcatggcgggatgctcgttagaaacccactgtcaaggaattctacacacgagatgtattggatcagtaacggaaccggcaatattgtgtcgagcgtcaacatggtgtcccgcttgctgctcaaccggttcactatgacgcatagacgtcccacaatcgaaaaagacgtagatcttggtgcggggaccaggcacgtgaatgccgagccggaaactcctaacatggacgttattggagagcggatcaagcgcataaaagaggaacacaattctacctggcattacgacgatgagaacccatataagacatgggcataccacggctcatatgaagtcaaggctacgggcagcgcctccagtatgattaatggggtggtgaaactgttaaccaagccctgggacgtcgttcctatggtgactcagatggcaatgacagataccactccatttggacagcaacgagtattcaaagagaaggtggacacaagaacccccaggccgatgcctggtacacggaaagtcatggaaatcactgccgagtggctgtggcgcaccttgggcagaaacaagaggccccgactctgcacgcgggaggaatttaccaagaaagtgcgtacaaatgctgccatgggggcggttttcactgaggaaaaccagtgggattctgcaaaggccgctgtggaggacgaagagttttggaaactggtcgatagagagcgcgaactacataagcttggaaaatgtggcagctgcgtgtacaatatgatgggtaagagggagaaaaagctgggggaattcggaaaggccaaaggctcacgggcaatctggtacatgtggctcggcgctagatatctggagtttgaggccttggggttcctgaacgaagaccactggttttcccgcgagaatagttacagcggagtagaaggtgagggcctccataagcttgggtatattctgagggatatatctaaaatcccaggaggcgctatgtacgccgacgataccgcaggttgggacacacgaattactgaagacgatttacacaacgaggagaagatcattcagcagatggaccctgaacaccggcaactggcgaatgccatcttcaaattgacctatcagaacaaggttgtgaaggtccagagacccacgccaacagggaccgtgatggatataatctccaggaaagaccagcgcggatcaggccaagtgggcacttacgggctcaatacatttaccaacatggaggctcagctggtccgtcagatggaaggagagggtgttctaactaaggccgatcttgaaaacagccatctgcccgagaaaaagattacccagtggctcgagacaaaaggcgtggaacggctgaagagaatggcaatctcgggggacgattgcgtagtgaagcctattgacgataggttcgctaatgccttggtcgcattaaacgacatgggaaaagtgcgcaaggatatcccacaatggcagccgtctcgaggctggcacgactggcagcaggttcccttttgtagtcatcacttccacgagctgataatgaaagatggtcggaagctcgtggtcccttgcagaccacaagacgaacttattgggagggcccgcatctcccagggagcgggctggagcctgagagagacggcttgtctaggcaaagcctatgcacagatgtggtcactgatgtacttccatcggagggacctccgtttggcctccaatgctatctgctctgccgtgcccgtacactgggttcctaccagccgaactacatggagtattcatgcacaccatcaatggatgaccactgaagatatgctgacagtgtggaaccgcgtctggatagaggagaatccatggatggaagacaagacccccgtgacgacatgggagaacgttccttaccttgggaagagagaagatcagtggtgtggatccctgatcggtctcaccagccgggctacttgggcccagaatattccgaccgcgatccagcaagtgaggtctttaattggcaacgaggagtttctggactatatgccatcaatgaaacgcttcagaaaggaagaggaaagtgagggggctatctggtga

SEQ ID NO: 15615 - RNA, 9873 nt, synthetic construct
  misc_feature 1..9873: note = derived and/or modified CDS sequence (opt3) from DENV-3__KC762681__SS-prME
  source 1..9873: mol_type = other RNA
accagcctgtgcctcatgatgatgcttcccgccactctggctttccacttgacttccagagacggcgaacctaggatgatcgtggggaagaacgaacggggaaaatctttactgtttaagacggcctcaggtattaatatgtgtaccctgatagccatggatctcggcgaaatgtgcgacgataccgtcacttacaaatgtccactgatcaccgaagttgagccggaagacattgattgctggtgtaaccttacaagtacctgggtgacttatgggacatgcaatcaggcgggagagcaccgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtttatcgagggaaaagtggtccagcacgaaaatctgaagtatactgtgataattaccgttcatacaggtgaccagcaccaggtgggcaacgagacccaaggggtcactgccgaaatcacgccccaggcatccacagtggaggctattctccctgaatacggaacccttggcctggagtgctctccacgaactggtttggacttcaatgagatgatcctactgaccatgaaaaacaaggcctggatggtacatagacagtggtttttcgatctcccgctgccctggacaagcggggcgaccactgaaacacctacgtggaataaaaaggagcttctggttacctttaaaaacgcccacgcaaagaagcaagaagtggtcgtgttgggctcccaggagggagctatgcacactgccctcacaggcgctaccgaaatccagacatcagggggaacaagtattttcgccggtcatctgaaatgtaggttaaagatggacaaactggagctaaagggcatgagctatgcaatgtgcctcaatgccttcgtcctgaaaaaggaggtgtctgaaacccagcacgggacgatacttatcaaggttgagtacaaaggagaagatgctccatgtaagattcccttttccaccgaggacggccaaggtaaagcgcataacgggcggttgatcacagcaaaccctgtggtaactaagaaagaggaaccagtcaatatagaggccgaacccccgttcggcgagtcaaacattgtgatcggaatcggcgataaggctctgaagattaattggtacaaaaaggggagcagtatcggaaaaatgtttgaagccaccgcacgtggtgcccgcagaatggctattctcggcgacacagcctgggatttcgggtctgttggaggcgtgctgaactcccttggtaagatggtccaccagatatttgggagcgcatatactgcgctgttctcgggcgtgtcttggatcatgaaaattggaatcggcgtattgctcacctggatcgggctaaattccaagaacacgtcaatgagttttagctgcattgtgataggaatcattacattatacctgggcgctgttgtccaggccgacatgggttgtgtgatcaattggaaggggaaagagctaaagtgcggatccggcattttcgtgaccaacgaggtccatacttggacagaacagtataaatttcaagcagattctcctaagaggctcgccaccgctatcgccggtgcatgggagaatggcgtttgtgggatacggagcactacccgaatggaaaacctgctttggaaacagatcgctaatgagttgaactacattctgtgggaaaataacatcaagctcacagtggtggtaggagacattatcggcgtcctggagcaggggaaacgcacgttaacaccccagccaatggatctgaagtattcatggaagacttggggaaaagccaagatagtgacagcggagacccaaaatagttccttcattatcgacggccctaacacacccgaatgcccaagcgcctctagagcttggaacgtttgggaggtggaagactacggttttggggtcttcactaccaatatttggcttaaattgagggagatgtatacgcagctctgtgatcaccggctgatgtcagcagccgtgaaggacgaacgcgctgttcacgccgatatgggatactggatcgagagtcagaaaaacggcagctggaagctagagaaggcatccctgatagaagtgaaaacatgcacctggcccaagtctcatactctctggtcgaatggtgtactggagagcgacatgatcattcctaaatcccttgcgggcccagtctcacagcacaactacagaccggggtatcatacccaaacagccggaccctggcacttgggcaagctggaattagattttaattactgcgaggggactaccgtggtgatcacagagaactgtggaacgaggggccctagtctccgtaccactacagtctctggtaaactgattcacgaatggtgctgtcggagctgcacccttccacccctgcgatatatgggggaggacggatgttggtacggcatggaaatcagacctataaatgagaaggaagagaacatggttaagtccttggtgtcagctggtagcggcaaagtagataatttcactatgggggtgctctgcctggccattctattcgaggaagtcatgaggggaaagtttggcaaaaagcatatgatcgcaggggtgctgttcacatttgttctcctgctttctggacagatcacctggcgcgacatggctcggacgttgattatgatcggctccaacgccagtgatagaatgggtatgggggtgacttatctggcattaattgccaccttcaaaatacagccatttctcgctctgggattctttcttaggaagctgacaagccgcgagaatctactcctgggcgtcggcttggcgatggccaccactctgcaattacccgaagacatcgagcagatggcaaacgggattgctctcggactgatggcccttaagctgatcacacagttcgaaacctaccagttgtggacagccctcgtgtctctgatgtgttccaatactatgtttaccctaacggttgcttggcgaacagcaaccctgattcttgccggtatctcactcctgccggtgtgccaaagtagctcgatgcggaaaactgattggttgcctgtcaccgtagcggctatgggcgtgccacccctgcctttattcatattttccctcaaggacacactgaaacgtagatcttggccccttaacgagggggttatggccgtgggactggtcagcatcttggcatcaagtctcctgaggaatgatgtgccaatggccggccctctagtagctggtgggctgcttattgcatgttatgtgatcactggaacctccgccgacctcacggtcgagaaggcggctgacgttatttgggaagaggaagccgagcagacaggcgtgtctcacaacctgatgatcaccgtggatgacgatggcactatgcgcataaaagacgatgaaacagagaacattttgaccgtcttactgaagactgcactcctgatcgtgagcgggatcttcccctactccattccagccacacttctggtttggcatacctggcagaaacagacgcaacggtcaggagtattgtgggacgtgccgagccctcccgagactcagaaggctgaactagaggaaggtgtctacagaataaagcagcagggcatctttgggaaaacccaagtgggagttggcgtgcagaaggagggtgtcttccacacaatgtggcatgtgaccagaggggccgtactgacacacaatggaaaacgactcgagccaaactgggcaagtgtcaagaaagatctgatttcttatggcggcgggtggcgcctttccgctcagtggcaaaagggagaagaggtgcaggttatcgccgtggaacccggtaagaatcctaaaaacttccagactatgccaggcatttttcagaccacgacaggggagatcggagcgatagccttagacttcaagcccggcactagcggttcgcctatcattaatcgggaagggaaagtcgtgggactgtacggcaacggcgttgtgaccaagaatgggggatatgtctcaggtatcgcacaaacaaacgctgagccggatggcccaacccccgagctcgaagaggaaatgtttaaaaagagaaatttgactattatggacctgcaccctgggtctggaaagaccaggaaatacctcccagccatcgtgcgtgaggctataaagcgccggctgagaacacttattctggcacccacgagggtagtggccgccgaaatggaggaggctttgaaaggcctacctatccgatatcagactaccgcgacaaagagtgcacataccggtaaagaaatcgttgatctgatgtgccacgccactttcacaatgcggctcttatccccggtccgcgtgcccaactacaatctgattatcatggacgaggctcattttaccgatccagccagcatagcagccagagggtatatttctacgagggtgggaatgggcgaagctgcggccatcttcatgactgcaacacctcccggcaccgctgacgcctttccacagagcaacgcacctattcaggacgaggaacgggatatccccgagcgatcctggaactcagggaacgagtggataaccgacttcgccggaaagactgtctggtttgtaccaagtattaaggctggtaatgatatcgccaactgtcttaggaagaatggcaagaaagtgatccaactgagccgcaagacattcgacaccgaataccagaaaacaaagctcaatgattgggactttgttgtgactacggatatttctgagatgggggcgaacttcaagaccgacagggtcatcgatccgcgtcggtgcttgaaacctgtgattctgacagacggacccgaaagagttatactcgcaggcccaatgcccgtgactgtcgcctccgctgcccagaggcgcggtcgagtggggagaaatcctcagaaggagaacgatcaatacatcttcaccggccagccactgaataacgacgaggaccacgctcattggacagaagcaaaaatgcttctagataatattaacacccccgagggaatcatccctgccctgtttgaaccggagcgggaaaagtcagctgccattgacggcgagtataggttgaaaggggagagtcgcaagactttcgtagaattaatgcgtagaggagatctgccagtgtggctcgcacacaaagttgcgagcgagggtataaagtacacggaccggaagtggtgctttgatggcgaaaggaataaccagatcctggaggaaaatatggacgtcgagatttggaccaaagagggggaaaagaagaaacttcgcccccgatggctggatgccagaacatattccgaccctctcgctttgaaagagttcaaagattttgccgcaggacggaagtctatcgctctggacctagtgactgaaattggcagggtgccctcgcacctggcccatcgcaccagaaacgcactcgataatcttgtcatgctgcacacaagcgagcatggtgggagggcctaccggcacgctgttgaagagttaccagagaccatggaaactttgctgctcctgggccttatgatcctgctcacaggaggcgcgatgttgttcctgatatcagggaaaggaatcggtaagacgtccattggcttaatctgtgtggtagccagttctgggatgctatggatggcagacgtgcctctgcagtggattgctagcgccatcgtcctcgagtttttcatgatggtgcttctgatacccgaaccagagaaacaacgtacccctcaggataaccagttggcctatgttgtgattggaatcctgactctcgcagctattgtcgccgcgaatgagatgggcctgcttgaaacaaccaagcgcgacctcggtatgtccaaagagccgggggtagtgtcacccacctcttacctggacgttgatttgcacccagctagcgcctggacactgtatgcagtggccactacggtcatcacccctatgttacgacatacaatagaaaacagtactgctaatgtgtccctagcagccatcgcgaaccaagctgtcgtgctgatgggcctcgacaagggatggcccattagcaagatggatcttggcgttccactgttggccctggggtgctactctcaggtgaaccctctcaccctgacagcagccgtacttttactggtgacccactacgctatcattggacccggcctccaggccaaagcaactagagaggctcagaagaggacggccgcgggtatcatgaaaaatccgacagtcgacgggataatgaccattgatttggacccagttatctatgattcaaagtttgaaaaacaactgggacaggtgatgctactggtcctctgtgccgtgcagcttctgttgatgcggacttcctgggcattctgcgaggctctgaccctcgccacaggccctatcactaccctgtgggagggtagtcccggcaagttttggaacacaacgattgcagtaagcatggctaatatcttccgcgggtcgtacttagccggagccggccttgcgttttctataatgaagtccgtggggaccggaaaaagaggcactggtagccagggggaaacactgggagagaagtggaaaaagaaactcaaccaactatcaaggaaggagttcgacctgtataaaaagagtggcattaccgaggttgatcggactgaagctaaggagggtttgaaacgaggcgagatcacacatcacgcagtgtctagagggtccgccaagctgcagtggttcgtcgaacgcaatatggtgattccagagggaagggtcatcgacctcggctgtgggcggggaggctggagctactattgcgctggtcttaaaaaggtgaccgaagttcgtgggtacacgaaaggaggccccggccatgaggaacctgtaccgatgtcaacctatgggtggaacatagtgaagctgatgagtggaaaggatgtcttttacttgcccccagagaaatgtgacacactgctctgcgatatcggtgagagctccccttctcccactgtggaagagagcagaaccattagggttttaaagatggtggaaccttggctgaaaaataaccagttctgtatcaaggtccttaatccatacatgcccacagtgattgagcacctggagcgcctacagcggaaacacggcgggatgctcgtacgaaaccctctgtccagaaattcaactcatgaaatgtattggatctctaacggaaccggcaatattgtgagttcggttaacatggtcagcaggttgctgctcaatcgctttacaatgacccaccggagaccaactatcgagaaggacgtggaccttggtgccgggacgcgtcatgtgaacgcagaacccgagacaccgaacatggatgtcataggagaaaggattcggcgcatcaaggaggagcactcctctacctggcactacgacgaagagaatccttataaaacttgggcctaccatggctcatatgaagttaaggctaccggcagcgcgtccagtatgatcaacggggtggtaaaactgttaacaaagccatgggatgtggtccccacggtgacccaaatggccatgactgacacaacccctttcggacagcagcgagtttttaaagagaaggtggatactagaacaccaaggcccatgccgggtacccggaaggcaatggaaattacagctgagtggctgtggcgcactttgggcagaaataaaaggcctcgactctgcacccgggaggagttcacgaagaaagtccgtaccaacgccgcaatgggggccgtgtttacagaggaaaatcaatgggactctgctagagccgcggtagaggatgaagagttctggaagctggttgaccgcgagagggaactacacaaacttggaaagtgtggcagctgcgtgtacaacatgatgggtaaacgggagaagaagctgggggaatttggaaaagcaaagggctcaagagccatatggtatatgtggctcggcgctcgctacctggagttcgaggccttggggtttctgaatgaagatcattggttctccagggagaacagttttagcggagtcgaaggtgagggcctccacaaacttgggtacatcctgcgagacatttctaagatccccggaggcgcaatgtatgctgatgacactgccggttgggacacccggattacagaagatgacttacataatgaggagaaaatcactcagcagatggatccagaacacagacagctggctaacgccatattcaagttgacctaccaaaataaggtggtgaaagtccagaggcctacgcccaaggggacagttatggacatcatttcccgcaaagatcagcgtggatcaggccaggtgggcacctatgggctcaacactttcacaaatatggaggtacaactgatccggcagatggaaggagagggtgtgctaagcaaggcagaccttgaaaacccacatctgctcgagaaagagattacccagtggctggaaactaagggcgtcgagagattgaagaggatggcgatctcgggggatgactgcgtggttaaacccatagatgaccgctttgccgatgctttactggccctcaatgacatgggaaaggtgcgaaaagatattcctcagtggcaaccatctaagggctggcatgactggcagcaggtcccgttctgtagtcaccattttcacgaacttatcatgaaagacggtcggaagctggtggtaccctgcagacctcaggatgagctaatcgggagggcacgcatttcccaaggagctggctggagcctgaaggaaaccgcctgtctcggcaaagcatacgcccagatgtgggcgttgatgtatttccacagacgggacctgaggcttgcttcaaacgccatatgctccgcagttccagtgcattgggtccccacatctcgtacgacctggagcatccacgcccatcaccagtggatgactacagaggatatgctgaccgtgtggaaccgagtttggattgaggacaatccttggatggaagataagactccagtgacaacctgggaggacgtcccctacctcgggaaacgcgaagatcaatggtgtggaagtttaatcggtctggcttccagagccacgtgggcacagaacattttgacagctatccaacaggtgcggagcctgataggcaatgaggagtttctcgactatatgccttctatgaagaggttccgcaaagaagaggaatcagagggggccatctggtga

SEQ ID NO: 15616 - RNA, 9873 nt, synthetic construct
  misc_feature 1..9873: note = derived and/or modified CDS sequence (opt3) from DENV-3__KC762684__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagagcacaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgtccataactgttcataccggtgaccagcaccaggtgggcaacgagacacaaggggtcaccgcagaaattactccccaggcttctacggtggaggccatccttcctgaatacggaacactgggcttggagtgcagcccacgaaccggtctagactttaatgagatgattctgctcactatgaaaaacaaggcgtggatggtacatagacagtggttctttgatctgccgcttccctggacctccggggccacaaccgaaactcctacatggaataaaaaggagctgttggttacgttcaaaaacgcacacgctaagaagcaagaagtggtcgtgctcggctcacaggagggagccatgcacaccgctctgactggcgccacagaaatccagaccagtgggggaacaagcatctttgcaggtcatttaaaatgtaggctgaagatggacaaactagagctcaagggcatgtcttatgccatgtgctccaatgctttcgtcctgaaaaaggaggtgtcagaaactcagcacgggaccattcttataaaggttgagtacaaaggagaagatgcgccatgtaagatccccttcagcacggaggacggccaaggtaaagcacataacgggcggttgattaccgccaaccctgtggtaacaaagaaagaggaaccagtcaatatcgaggctgaacccccgtttggcgagagtaacataattatcggaatcggcgataaggccctgaagattaattggtacaaaaaggggtcttccatcggaaaaatgttcgaagcaactgcccgtggtgctcgcagaatggccattctcggcgacaccgcatgggattttgggagcgtgggaggcgttctgaactcgcttggtaagatggtgcaccagatattcgggtctgcgtatacagctctgttttccggcgtctcatggatcatgaaaattggaatcggcgtgttgctcacttggatcgggctgaatagtaagaacaccagcatgtccttctcttgcattgtaataggaatcattacgttatacctgggcgccgtggttcaggcagacatgggttgtgtcatcaattggaaggggaaagagctaaagtgcggaagcggcatttttgtgacaaacgaggtgcatacctggactgaacagtataaattccaagccgattcacctaagaggctcgctacagccatcgcaggtgcttgggagaatggcgtctgtgggatacggagtaccactcgaatggaaaacctgctttggaaacagatcgccaatgagttgaactacattctgtgggaaaataacatcaagctcaccgttgtggtgggagacattatcggcatactggagcaggggaaacgcacattaacgccccagccaatggagctgaagtattcctggaagacctggggaaaagcgaagattgtaactgccgaaatgcaaaatagctcttttatcattgatggccctaacacacccgagtgcccaaacgcttcaagagcatggaatgtctgggaagtggaggactacggtttcggggtttttaccacaaacatctggcttaaattgagggaaatgtatactcagctctgtgaccaccggctgatgagtgccgctataaaggatgagcgcgccgtgcacgcagacatgggatactggatcgagagccagaaaaatggctcctggaagctagaaaaggcgtctctgattgaggtcaaaacctgcacgtggcccaagtcgcatacactctggagcaacggtgtgctggaatccgatatgatcattcctaaatcacttgccggcccaatcagtcagcacaattacagaccggggtatcatacccaaactgctggaccctggcacttgggcaagctggagttagacttcaactactgcgaggggaccacagttgtgataactgaaaattgtggaaccaggggcccttctctccgtacaacgaccgtaagcggtaaactgattcacgagtggtgctgtcggtcctgcactcttccacccctgcgatatatgggggaagatggatgttggtacggcatggagatcagacctatcaacgaaagggaggagaatatggtcaagtcattggtgagcgccggttctggcaaggtggacaactttacaatgggggtcctctgcctggcaattctattcgaagaggttatgcgcggaaaattcggcaagaaacatatgatcgctggggtgtttttcacctttgtactgctcctgtccggacagattacttggcgggatatggccagaacacttataatgatcggcagtaatgcaagcgacaggatgggtatgggggtgacctatttggccctgattgctacgttcaagatccagccatttttagcgctcggattctttctgcgcaaacttacttctcgagaaaacctgctactcggcgtcggcctggccatggcaaccacattgcaactgcccgaggatattgaacagatggctaatgggatcgccttaggactcatggccctgaagcttgtgacccagttcgagacttaccagctgtggacagctttggtttccctcatgtgttcaaacaccatatttacactgactgtggcatggcggaccgccacgctaatcctggcgggtattagtcttctcccgctgtgccaaagctcgggcatgcgtaagacagactggttgcctatgaccgtcgctgccatgggggtgccacccctgcctttattcatcttttccctcaaagatactctgaagagaaggtcttggccccttaatgagggagttatggcagtgggcctggtcagcattttggcctcaagtctcctgcgcaacgacgtaccaatggctggtcctctagtggcagggggactgcttatcgcctgttatgttataaccggcacatccgcggatctcactgtggaaaaagctgccgacgtcacctgggaggaagaggcagaacagacgggcgtgtctcacaacctgatgattacagtagacgatgacgggaccatgcggatcaaggatgacgagactgagaatatcttgacagtgttactgaaaaccgccctcctgattgtcagcggaatattcccctactccatcccagctactcttctggtttggcatacatggcagaagcagacccaaagatcaggtgtgttgtgggatgtgccgagccctcccgaaacgcagaaagccgagctagaagagggcgtctacaggattaagcagcaggggatctttggaaagactcaagtgggcgttggtgtacagaaagagggggtgttccacaccatgtggcatgtcacacgaggagcagtgctgacctataacggcaagcgcctcgaaccaaattgggctagtgttaaaaaggacctgatttcttacggcgggggatggcggctttccgcccagtggcaaaaaggtgaggaagtgcaggtcatcgcggtggagcccggcaagaaccctaagaatttccagacaatgccagggatatttcagactaccacgggagaaatcggcgccattgcattagatttcaaacccggtacaagcgggtcgcctatcattaacagagagggaaaggtagtcggcctgtatggcaatggggtggttactaaaaacggaggttacgtgtcaggcatcgctcaaacctctgccgagccggacgggccaacacccgaactcgaggaagagatgtttaagaaaaggaatttgaccataatggatctgcaccctggaagtggcaagactcgtaagtatctcccagctattgtccgcgaagcaatcaaacggagactgaggacccttatcctggcccccacacgagtggttgccgctgagatggaggaagcgttgaagggtctacctattcggtaccagacgactgcaaccaaatccgagcacacagggaaggaaatcgtggacctgatgtgccatgccaccttcactatgcgcctcttaagcccggtcagagtgcccaactataatctgataattatggatgaggctcactttacagacccagcctctatcgcagccaggggatacattagcacccgggtaggcatgggcgaagctgcggccatcttcatgacggcaactcctcccgggacagctgatgcctttccacagtccaacgcacctatacaggacgaggagcgagacattcccgaaagatcatggaatagtggaaacgattggatcaccgacttcgccggtaaaaccgtgtggtttgttccaagcatcaaggctggcaatgatattgccaactgtcttcgcaagaacgggaaaaaggtcatccaactgtctaggaaaactttcgacacagagtaccagaagaccaaactcaatgattgggactttgtggtgacaactgatatttccgaaatgggagcgaacttcaaggcagaccgtgtcatagatccgcggagatgcttgaagcctgtaatcctgacggacggccccgagagggtgattctcgccggtccaatgcccgttaccgtggcttcagccgctcagcgccgagggagagtcggccggaatcctcagaaagagaacgatcaatatatcttcacaggacagccactgaataacgacgaagaccatgcacactggactgaggccaagatgcttctagataatatcaacacccccgaaggcattatacctgctctgtttgagccggaaagggagaaaagtgccgcaatcgacggggagtaccgcttgaagggagaaagccgtaaaacattcgtggagttaatgagacggggtgatctgccagtttggctcgcgcataaggtggcctccgaaggcattaaatataccgacaggaagtggtgctttgatggggagcgcaataaccagatcctggaagagaatatggacgtcgagatttggactaaggaaggagagaaaaagaaacttcgacccagatggctggatgctcggacgtactctgaccctctcgccttgaaggaattcaaagattttgcagctggcaggaagtcgatcgccctggacctagtgaccgagataggtcgcgtacccagccacctggcacacagaacaaggaacgccctcgataatcttgtgatgctgcatacttcagaacacgggggccgggcttatcgtcatgcggttgaggagttaccagaaaccatggagacattgctgctcctgggacttatgatcctgctcaccggcggggtcatgttgttcctgatttccggaaagggtgtgggcaaaactagtatcgggttaatttgtgtggtcgcctctagctccatgctatggatggcagacatccctctgcagtggatagcttcagccattgttctcgaatttttcatgatggtgcttctgatccccgagccagagaagcaacgcacacctcaggataaccagttggcctacgtagtgattggaatcctgacgctcgcagctatagtcgccgcgaatgaaatgggcctgcttgagaccactaaacgagacctcggtatgtctaaggaaccgggggtggttagccccacaagttatctggacgtggatttgcacccagcttccgcctggaccctgtacgcagtcgccaccacagtaatcactcctatgttaagacacacgattgagaacagcaccgctaatgtgtctctagcagccatcgcgaaccaagctgttgtgctgatgggcctcgacaaaggatggcccatttcaaagatggatcttggcgtcccactgttggccctggggtgctactcccaggtgaaccctctcacactgactgcagccgtccttttactggtgacccattatgctatcataggacccggcctccaggccaaggcaacaagggaagctcagaaacggaccgccgcgggtattatgaagaatccgactgttgacgggatcatgacgatcgatttggacccagtgatttacgatagtaaatttgagaagcaactgggacaggtaatgctactggtgctctgtgccgtccagcttctgttgatgcgcacaagctgggcattctgcgaggctctgaccctcgccactggccctatcaccacactgtgggaaggttcgcccggcaaattttggaacactaccatagcagtttctatggctaatattttcagagggtcctatttagccggagccggccttgcgtttagcatcatgaagtcagtggggacaggaaagaggggcacgggtagtcagggggagaccctgggagaaaaatggaagaaaaagctcaaccaactatctcggaaagagttcgacctgtacaagaaatccggcattactgaagtcgatcgaacagaggctaaggagggtttgaagagaggcgaaatcacccaccatgcagtgagccgcgggtcagccaaactgcagtggttcgtagagaggaatatggtgataccagaaggacgggttatcgacctcggctgtgggcgtggaggctggagttattactgcgctggtcttaagaaagtgactgaggtcagagggtatacaaagggaggccccggccacgaagagcctgtgccgatgagcacctacgggtggaacattgtcaaactgatgtccggaaaggatgtgttttacttgcccccagagaagtgtgacacgctgctctgcgatatcggtgaatctagcccttcccccaccgttgaggaatcaaggacaattcgcgtattaaaaatggtggagccttggctgaagaataaccagttctgtatcaaagtccttaatccatatatgcccgccgtgattgagcatctggaacggctacagcgaaagcacggcgggatgctcgttagaaaccctctgtctaggaatagtactcacgagatgtactggatctcgaacggaaccggcaatatagtgagctccgtcaacatggtgtctcgcttgctgctcaatcggtttacaatgacttatagacgtccaaccattgaaaaagacgtagaccttggtgcagggacaaggcatgtgaacgccgagcccgaaaccccgaacatggatgttatcggagagcggatccgccgaattaaggaggaacactcaagcacttggcattacgacgatgagaatccttataagacgtgggcttaccacggctcctatgaagtcaaagcgacaggcagtgcctctagcatgataaacggggtggtgaagctgttaaccaaaccatgggacgtcgttcccactgtgacccaaatggcaatgacagatacgacccctttcggacagcagagagtatttaaggagaaagtggacactaggacaccaaagcccatgccgggtacccggaaggtcatggaaatcactgctgagtggctgtggcgcacattgggcagaaataaaaggcctcgactctgcacccgggaggaattcacaaagaaagtgcgtactaacgccgcaatgggggccgtttttaccgaggaaaatcaatgggattcagctagagccgcggtggaggacgaagagttctggaagctggtcgatcgcgagagggaactacacaaacttggaaagtgtggctcctgcgtgtacaacatgatgggtaaacgggagaagaagctgggggaatttggaaaagcaaagggcagtagagccatttggtacatgtggctcggcgctcgctatctggagttcgaggccttggggtttctgaatgaagaccattggttcagcagggagaactcttactccggagtagaaggtgagggcctccacaaacttgggtatatcctgcgagatatttcaaagatccccggaggcgcaatgtacgctgacgacacggccggttgggatacccggataacagaagacgatttacataatgaggagaaaatcactcagcagatggacccagaacacagacagctggctaacgccatttttaagttgacctatcaaaataaggttgtgaaagtccagaggcctacacccaaggggactgtgatggatatcattagccgcaaagaccagcgtggatcgggccaggtgggcacctacgggctcaacacgttcacaaatatggaggcacaactgatccggcagatggaaggagagggtgtcctatctaagaccgatcttgaaaacccacatctgctcgagaaaaagataactcagtggctggagacaaagggcgttgaaagattgaaaaggatggcgattagtggggacgattgcgtggtaaagcccatcgacgatcgcttcgccaatgctttactggccctcaacgacatgggaaaagtgcgaaaggatatccctcagtggcaaccatccaaaggctggcacgactggcagcaggtcccgttttgtagccaccatttccacgagcttattatgaaggacggtcggaagctggtggttccctgcagacctcaggatgaactaatagggagggcacgcatctcacaaggagctggctggtccctgaaagagaccgcctgtctcggcaaggcatatgcccagatgtgggcgttgatgtactttcatagacgggacctgaggcttgcttctaacgccatttgcagcgcagtgccagtccactgggtgcccactagtcgtaccacatggtccatccacgcccatcaccagtggatgacgaccgaagatatgctgactgtatggaatcgagtttggattgaggacaacccttggatggaggataaaacaccagtgaccacttgggaagacgtcccctacctcgggaagcgcgaggatcaatggtgtggaagcttaatcggtctgacatctagagctacctgggcccagaatatattgacggcaatccagcaggtgcggtcactgattggcaacgaagagttcctcgactatatgcctagtatgaaaaggtttcgcaaggaggaagagtccgaaggggctatctggtga

SEQ ID NO: 15617 - RNA, 9873 nt, synthetic construct
  misc_feature 1..9873: note = derived and/or modified CDS sequence (opt3) from DENV-3__KC762686__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaaatctttactgtttaagacggcctcaggtattaatatgtgtaccctgattgccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagtttatcgagggaaaagtggtccagcacgaaaatctgaagtatacagtgataattactgttcataccggtgaccagcaccaggtgggcaacgagacacaaggggtcaccgcagaaatcactccccaggcttccacggtggaggccattctccctgaatacggaacacttggcctggagtgctctccacgaaccggtttggacttcaatgagatgatcctactgactatgaaaaacaaggcgtggatggtacatagacagtggtttttcgatctcccgctgccctggaccagcggggccacaaccgaaactcctacatggaataaaaaggagcttctggttacgtttaaaaacgcacacgctaagaagcaagaagtggtcgtgttgggctcccaggagggagccatgcacaccgctctcactggcgccacagaaatccagacctcagggggaacaagtattttcgcaggtcatctgaaatgtaggttaaagatggacaaactggagctaaagggcatgagctatgccatgtgcctcaatgctttcgtcctgaaaaaggaggtgtctgaaactcagcacgggaccatacttatcaaggttgagtacaaaggagaagatgcgccatgtaagattcccttttccacggaggacggccaaggtaaagcacataacgggcggttgatcaccgccaaccctgtggtaacaaagaaagaggaaccaataaatattgaggctgaacccccgttcggcgagtcaaacatcgtcatcggaattggcgataaggccctgaagatcaattggtacaaaaaggggagcagtattggaaaaatgtttgaagcaactgcccgtggtgctcgcagaatggccatactcggcgacaccgcatgggatttcgggtctgtgggaggcgttctgaactcccttggtaagatggtgcaccagatctttgggagcgcgtatacagctctgttctcgggcgtctcttggattatgaaaatcggaatcggcgtgttgctcacttggattgggctaaattccaagaacacctcaatgagttttagctgcatagtaatcggaattatcacgttatacctgggcgccgtggttcaggcagacatgggttgtgtcattaattggaaggggaaagagctaaagtgcggatccggcatcttcgtgacaaacgaggtgcatacctggactgaacagtataaatttcaagccgattctcctaagaggctcgctacaaccatagccggtgcatgggagaatggcgtctgtgggatccggagcactacccgaatggaaaacctgctttggaaacagattgctaatgagttgaactacatcctgtgggaaaataacattaagctcacagttgtggtgggagacatcataggcgtactggagcaggggaaacgcacgttaacaccccagccaatggagctgaagtattcatggaagacttggggaaaagccaagattgtcacagcggaaacccaaaatagttccttcatcattgatggccctaacacacccgagtgcccaagcgcctctagagcttggaacgtgtgggaagttgaggactacggttttggggtgttcactaccaatatctggcttaaattgagggaaatgtatacgcagctctgtgaccaccggctgatgtcagcagccgtcaaggatgagcgcgctgtgcacgccgacatgggatactggatagagagtcagaaaaacggcagctggaagctagaaaaggcatccctgatcgaggttaaaacatgcacctggcccaagtctcatactctctggtcgaatggtgtgctggaaagcgatatgattatccctaaatcccttgcgggcccagtatcacagcacaaccatagaccggggtaccacacccaaacagccggaccctggcacttgggcaagctggagttagactttaattattgcgaggggactaccgtcgtgattacagaaaactgtggaacgaggggccctagtctccgtaccactacagtgtctggtaaactgatccatgagtggtgctgtcggagctgcacccttccacccctgcgatacatgggggaagatggatgttggtatggcatggagataagacctattaatgaaaaggaggagaacatggtcaagtccttggtttcagctggtagcggcaaagtggacaatttcactatgggggtactctgcctggccatcctattcgaagaggtgatgaggggaaagtttggcaaaaagcacatgatcgcaggggtcctgttcacatttgtgctcctgctttctggacagattacctggcgcgatatggctcggacgttgatcatgattggctccaacgccagtgacagaatgggtatgggggttacttacctggcattaatagccaccttcaaaatccagccatttctcgctctgggattctttcttaggaagctgacaagccgcgaaaatctactcctgggcgtgggcttggcgatggccaccactctgcaattacccgaggatattgaacagatggcaaacgggatcgctctcggactgatggcccttaagctgattacacagttcgagacctatcagttgtggacagccctcgtctctctgatgtgttccaatactatctttaccctaacggtggcttggcgaacagcaaccctgatacttgccggtatctcactcctgccggtttgccaaagtagctcgatgcggaaaactgactggttgcctgtgaccgtcgcggctatgggcgtaccacccctgcctttattcatattttccctcaaggatacactgaaacgtagatcttggccccttaacgagggggtgatggccgttggactggtgagcatcttggcatcaagtctcctgaggaatgacgtcccaatggccggccctctagtggctggtgggctgcttattgcatgttacgtaatcactggaacctccgccgatctcacggtggaaaaggcggctgacgtcatatgggaggaagaggccgaacagacaggcgtttctcataacctgatgattaccgtggacgatgacggcactatgcgcatcaaagatgacgagacagagaacatcttgaccgtgttactgaagactgcactcctgattgtcagcgggatattcccctattccatcccagccacacttctggtgtggcacacctggcagaaacagacgcaacggtcaggagttttgtgggatgtaccgagccctcccgaaactcagaaggctgagctagaagagggtgtgtacagaattaagcagcagggcatctttgggaaaacccaagtcggagtgggcgttcagaaggagggtgtgttccatacaatgtggcacgtcaccagaggggccgtgctgacacacaatggaaaacgactcgaaccaaactgggcaagtgtaaagaaagacctgatttcttacggcggcgggtggcgcctttccgctcagtggcaaaagggagaggaagtccaggtgatcgccgttgagcccggtaagaatcctaaaaacttccagactatgccaggcatatttcagaccacgacaggggaaatcggagcgattgccttagatttcaagcccggcactagcggttcgcctatcattaatcgggaggggaaagtggtcggactgtatggcaacggcgtggttaccaagaatgggggatacgtgtcaggtatcgcacaaacaaacgctgagccggacggcccaacccccgaactcgaggaagagatgtttaaaaagagaaatttgactataatggatctgcatcctgggtctggaaagaccaggaaatatctcccagccattgtccgtgaagctatcaagcgccggctgagaacacttatcctggcacccacgagggtggtagccgccgagatggaggaggctttgaaaggcctacctattcgataccagactaccgcgacaaagagtgcacacaccggtaaagagatcgtggacctgatgtgccatgccactttcacaatgcggctcttatccccggttcgcgtccccaactataatctgataattatggatgaagctcactttaccgacccagccagcatcgcagccagagggtacatttctacgagggtgggaatgggcgaggctgcggccatcttcatgactgcaacacctcccggcaccgctgatgcctttccacagagcaacgcacctatacaggacgaagaacgggacattcccgagcgatcctggaactcagggaacgaatggatcaccgatttcgccggaaagactgtgtggtttgtcccaagtatcaaggctggtaatgacattgccaactgtcttaggaagaatggcaagaaagtaatccaactgagccgcaagacattcgataccgagtatcagaaaacaaagctcaatgactgggattttgtggttactacggacatttctgaaatgggggcgaacttcaaggcagatagggtgatagacccgcgtcggtgcttgaaacctgtcatcctgaccgatggacccgagagagtgattctcgccggcccaatgcccgttacagtggcttccgccgctcagaggcgcggtcgagtcgggagaaatcctcagaaggagaacgaccaatacatcttcactggccagccactgaataacgatgaagaccatgcacactggaccgaggccaaaatgcttctagacaatatcaacacacccgaaggaattatacctgctctgtttgagccggaacgggagaagtcagccgcaatcgatggcgagtacaggttgaaaggggaaagtcgcaagaccttcgtggagttaatgcgtagaggagacctgccagtatggctcgcgcacaaagtggccagcgaaggtattaagtatactgatcggaagtggtgctttgacggcgagaggaataaccagatcctggaagagaatatggatgttgagatttggacgaaagaaggggagaagaagaaacttcgcccccgatggctggacgctagaacctactccgatcctctcgccttgaaagagttcaaagactttgcagctggacggaagtctatcgccctggatctagtcacagagataggcagggtgccctcgcatctggcacaccgcactagaaacgccctcgacaatcttgtgatgctgcataccagcgaacacggtgggagggcttatcggcacgcggtcgaggagttaccagaaacaatggagaccttgctgctcctgggccttatgatcctgctcactggaggcgccatgttgttcctgatttcagggaaaggaatcggtaagacatccattggcttaatctgtgttgtggcaagttctgggatgctatggatggctgatgtacctctgcagtggatagccagcgccattgtgctcgaatttttcatgatggtccttctgatccccgagccagagaaacaacgtacgcctcaggacaaccagttggcatacgtggttattggaatcctgaccctcgctgccatagtggcggctaatgaaatgggcctgcttgagactacaaagcgcgatctcggtatgtccaaagaaccgggggtcgtatcacccacctcttatctggacgtggacttgcatccagccagcgcatggaccctgtacgccgttgctacaactgtgatcacgcctatgttacgacacaccattgagaacagtacagcaaatgtctccctagccgcgatcgctaaccaagccgtggtcctgatgggcctcgataagggatggcccattagcaagatggaccttggcgtgccactgttggcactggggtgctattctcaggttaaccctctcactctgaccgccgctgtgcttttactggtaacacattacgccatcataggacccggcctccaggcaaaagctaccagagaagcccagaagaggactgcggccggtattatgaaaaatccgacggtggatgggatcatgacaatcgacttggatccagtcatttacgactcaaagtttgagaaacaactgggacaggttatgctactggtgctctgtgcagtccagcttctgttgatgcggacctcctgggctttctgcgaggccctgactctcgcaaccggccctatcacaactctgtgggaaggtagtcccggcaagttttggaacaccacaatagctgtgagcatggccaatattttccgcgggtcgtatttagccggagcgggccttgctttttctatcatgaagtccgtagggacgggaaaaagaggcaccggtagccagggggagactctgggagaaaagtggaaaaagaaactcaaccaactatcaaggaaggagttcgatctgtacaaaaagagtggcattacagaagtggaccggaccgaggcaaaggagggtttgaaacgaggcgaaatcactcaccatgccgtttctagagggtccgctaagctgcagtggttcgtggagcgcaatatggtcataccagaaggaagggtgatcgatctcggctgtgggcggggaggctggagctattactgcgccggtcttaaaaaggtcacagaggtgcgtgggtataccaaaggaggccccggccacgaagaacctgttccgatgtcaacgtacgggtggaacattgtaaagctgatgagtggaaaggacgtgttttatttgcccccagagaaatgtgataccctgctctgcgacatcggtgaaagctccccttctcccacagtcgaggaaagcagaactattagggtgttaaagatggttgagccttggctgaaaaataaccagttctgtatcaaggtgcttaatccatacatgcccaccgtcattgagcacctggaacgcctacagcggaaacatggcgggatgctcgtgcgaaaccctctgtccagaaattcaacacacgagatgtactggatctctaacggaactggcaatatagtaagttcggtgaacatggttagcaggttgctgctcaatcgctttaccatgacacatcggagaccaaccattgaaaaggatgtcgaccttggtgcagggactcgtcacgtgaacgccgagcccgaaacgccgaacatggacgtgatcggagagaggatccggcgcattaaggaggaacactcctctacatggcattatgatgaggaaaatccttacaaaacctgggcttatcacggctcatacgaggtcaaggcgactggcagcgcctccagtatgataaacggggttgtgaaactgttaaccaagccatgggacgtagtgcccacagtcacgcaaatggcaatgaccgatactacacctttcggacagcagcgagtgtttaaagaaaaggttgacaccagaactccaaggcccatgccgggtacacggaaggctatggagatcaccgccgagtggctgtggcgcacattgggcagaaataaaaggcctcgactctgcactcgggaagagttcaccaagaaagtgcgtacgaacgcagccatgggggctgtctttaccgaagagaatcaatgggattctgccagagcggcagtggaagacgaggagttctggaagctggtagatcgcgaaagggagctacataaacttggaaagtgtggcagctgcgtttataacatgatgggtaaacgggaaaagaagctgggggagtttggaaaagccaagggctcaagagctatttggtacatgtggctcggcgcccgctatctggagttcgaagcattggggtttctgaatgaggaccactggttctccagggaaaacagttttagcggagtggagggtgaaggcctccataaacttgggtacatcctgcgagatatttctaagatccccggaggcgctatgtacgccgacgatacagctggttgggacactcggataaccgaggacgatttacacaatgaggagaaaatcacacagcagatggagccagaacacagacagctggccaacgcaattttcaagttgacttatcaaaataaggtcgtgaaagtgcagaggcctacccccaaggggacggtcatggacatcatttcccgcaaagatcagcgtggatcaggccaggttggcacatacgggctcaacaccttcactaatatggaggtgcaactgatccggcagatggaaggagagggtgtactaagcaaggcggaccttgagaacccacatctgctcgaaaaagagataacacagtggctggaaaccaagggcgtggagagattgaagaggatggccatttcgggggatgactgcgtcgtgaaacccatcgatgaccgctttgctgatgccttactggcactcaatgacatgggaaaggttcgaaaagatatccctcagtggcaaccatctaagggctggcacgactggcaacaggtgccgttctgtagtcatcactttcacgaacttattatgaaagatggtcggaagctggtcgtgccctgcagacctcaggacgagctaatagggagggctcgcatctcccaaggagccggctggagcctgaaggagactgcatgtctcggcaaagcctatgcgcagatgtgggctttgatgtacttccatagacgggacctgaggcttgcctcaaacgcaatttgctccgccgtaccagttcactgggtgcccacctctcgtacaacgtggagcatccatgctcaccatcagtggatgaccactgaagatatgctgacagtctggaaccgagtgtggattgaggacaatccttggatggaagataagaccccagttactacatgggaggacgtgccctatctcgggaaacgcgaggatcaatggtgtggaagtttaatcggtctggcctccagagcaacctgggctcagaacatattgacggccatccagcaggtccggagcctgattggcaatgaagagtttctcgactacatgccttctatgaagaggttccgcaaagaagaggaatcagagggggcgatctggtga

SEQ ID NO: 15618 - RNA, 9873 nt, synthetic construct
  misc_feature 1..9873: note = derived and/or modified CDS sequence (opt3) from DENV-3__KC762685__SS-prME
  source 1..9873: mol_type = other RNA
accagcctgtgcctcatgatgatgcttcccgccactctggctttccacttgacttccagagacggagaacctaggatgatcgtggggaagaacgaacggggaaaatctttactgtttaagacggcctcaggtattaatatgtgtaccctgatagccatggatctcggcgagatgtgcgacgataccgtcacttacaaatgtccactgatcaccgaagttgagccggaagacattgattgctggtgtaaccttacaagtacctgggtgacttatgggacatgcaatcaggcgggagagcaccgccgagacaagcgtagcgtagctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcacaaagttccaatgtttagagtttatcgagggaaaagtggtccagcacgaaaatctgaagtatactgtgataattaccgttcatacaggtgaccagcaccaggtgggcaacgagacccaaggggtcactgccgaaatcacgccccaggcatccacagtggaggctattctccctgaatacggaacccttggcctggagtgctctccacgaactggtttggacttcaatgagatgatcctactgaccatgaaaaacaaggcctggatggtacatagacagtggtttttcgatctcccgctgccctggacaagcggggcgaccactgaaacacctacgtggaataaaaaggagcttctggttacctttaaaaacgcccacgcaaagaagcaagaagtggtcgtgttgggctcccaggagggagctatgcacactgccctcacaggcgctaccgaaatccagacatcagggggaacaagtattttcgccggtcatctgaaatgtaggttaaagatggacaaactggagctaaagggcatgagctatgcaatgtgcctcaatgccttcgtcctgaaaaaggaggtgtctgaaacccagcacgggacgatacttatcaaggttgagtacaaaggagaagatgctccatgtaagattcccttttccaccgaggacggccaaggtaaagcgcataacgggcggttgatcacagcaaaccctgtggtaactaagaaagaggaaccagtcaatatagaggccgaacccccgttcggcgagtcaaacattgtgatcggaatcggcgataaggctctgaagattaattggtacaaaaaggggagcagtatcggaaaaatgtttgaagccaccgcacgtggtgcccgcagaatggctattctcggcgacacagcctgggatttcgggtctgttggaggcgtgctgaactcccttggtaagatggtccaccagatatttgggagcgcatatactgcgctgttctcgggcgtgtcttggatcatgaaaattggaatcggcgtattgctcacctggatcgggctaaattccaagaacacgtcaatgagttttagctgcattgtgataggaatcattacattatacctgggcgctgttgtccaggccgacatgggttgtgtgatcaattggaaggggaaagagctaaagtgcggatccggcattttcgtgaccaacgaggtccatacttggacagaacagtataaatttcaagcagattctcctaagaggctcgccaccgctatcgccggtgcatgggagaatggcgtttgtgggatacggagcactacccgaatggaaaacctgctttggaaacagatcgctaatgagttgaactacattctgtgggaaaataacatcaagctcacagtggtggtaggagacattatcggcgtcctggagcaggggaaacgcacgttaacaccccagccaatggagctgaagtattcatggaagacttggggaaaagccaagatagtgacagcggaaacccaaaatagttccttcattatcgatggccctaacacacccgagtgcccaagcgcctctagagcttggaacgtttgggaagtggaggactacggttttggggtcttcactaccaatatttggcttaaattgagggaaatgtatacgcagctctgtgaccaccggctgatgtcagcagccgtgaaggatgagcgcgctgttcacgccgacatgggatactggatcgagagtcagaaaaacggcagctggaagctagaaaaggcatccctgatagaggtgaaaacatgcacctggcccaagtctcatactctctggtcgaatggtgtactggaaagcgatatgatcattcctaaatcccttgcgggcccagtctcacagcacaactacagaccggggtatcatacccaaacagccggaccctggcacttgggcaagctggagttagactttaattactgcgaggggactaccgtggtgatcacagaaaactgtggaacgaggggccctagtctccgtaccactacagtctctggtaaactgattcacgagtggtgctgtcggagctgcacccttccacccctgcgatatatgggggaagatggatgttggtacggcatggagatcagacctataaatgaaaaggaggagaacatggttaagtccttggtgtcagctggtagcggcaaagtagacaatttcactatgggggtgctctgcctggccattctattcgaagaggtcatgaggggaaagtttggcaaaaagcatatgatcgcaggggtgctgttcacatttgttctcctgctttctggacagatcacctggcgcgatatggctcggacgttgattatgatcggctccaacgccagtgacagaatgggtatgggggtgacttatctggcattaattgccaccttcaaaatacagccatttctcgctctgggattctttcttaggaagctgacaagccgcgaaaatctactcctgggcgtcggcttggcgatggccaccactctgcaattacccgaggatatcgaacagatggcaaacgggattgctctcggactgatggcccttaagctgatcacacagttcgagacctaccagttgtggacagccctcgtgtctctgatgtgttccaatactatttttaccctaacggttgcttggcgaacagcaaccctgatccttgccggtatatcactcctgccggtgtgccaaagtagctcgatgcggaaaactgactggttgcctgtcaccgtagcggctatgggcgtgccacccctgcctttattcatcttttccctcaaggatacactgaaacgtagatcttggccccttaacgagggggttatggccgtgggactggtcagcattttggcatcaagtctcctgaggaatgacgtgccaatggccggccctctagtagctggtgggctgcttatcgcatgttatgtgattactggaacctccgccgatctcacggtcgaaaaggcggctgacgttatctgggaggaagaggccgaacagacaggcgtgtctcacaacctgatgataaccgtggacgatgacggcactatgcgcattaaagatgacgagacagagaacatcttgaccgtcttactgaagactgcactcctgatcgtgagcgggattttcccctactccataccagccacacttctggtttggcatacctggcagaaacagacgcaacggtcaggagtattgtgggatgtgccgagccctcccgaaactcagaaggctgagctagaagagggtgtctacagaatcaagcagcagggcatttttgggaaaacccaagtgggagttggcgtgcagaaggagggtgtcttccacacaatgtggcatgtgaccagaggggccgtactgacacacaatggaaaacgactcgaaccaaactgggcaagtgtcaagaaagacctgatctcttatggcggcgggtggcgcctttccgctcagtggcaaaagggagaggaagtgcaggttattgccgtggagcccggtaagaatcctaaaaacttccagactatgccaggcatctttcagaccacgacaggggaaataggagcgatcgccttagatttcaagcccggcactagcggttcgcctattatcaatcgggaggggaaagtcgtgggactgtacggcaacggcgttgtgaccaagaatgggggatatgtctcaggtattgcacaaacaaacgctgagccggacggcccaacccccgaactcgaggaagagatgtttaaaaagagaaatttgactatcatggatctgcaccctgggtctggaaagaccaggaaatacctcccagccatagtgcgtgaagctattaagcgccggctgagaacacttatcctggcacccacgagggtagtggccgccgagatggaggaggctttgaaaggcctacctatccgatatcagactaccgcgacaaagagtgcacataccggtaaagagattgttgacctgatgtgccacgccactttcacaatgcggctcttatccccggtccgcgtgcccaactacaatctgatcataatggatgaagctcattttaccgacccagccagcattgcagccagagggtatatctctacgagggtgggaatgggcgaggctgcggccattttcatgactgcaacacctcccggcaccgctgatgcctttccacagagcaacgcacctatccaggacgaagaacgggacatacccgagcgatcctggaactcagggaacgaatggattaccgatttcgccggaaagactgtctggtttgtaccaagtatcaaggctggtaatgacatcgccaactgtcttaggaagaatggcaagaaagtgattcaactgagccgcaagacattcgataccgagtaccagaaaacaaagctcaatgactgggattttgttgtgactacggacatctctgaaatgggggcgaacttcaaggcagatagggtcattgacccgcgtcggtgcttgaaacctgtgatactgaccgatggacccgagagagttatcctcgccggcccaatgcccgtgacagtcgcttccgccgctcagaggcgcggtcgagtggggagaaatcctcagaaggagaacgaccaatacattttcactggccagccactgaataacgatgaagaccacgcacattggaccgaggccaaaatgcttctagacaatatcaacacacccgaaggaatcattcctgctctgtttgagccggaacgggagaagtcagccgcaatagatggcgagtataggttgaaaggggaaagtcgcaagaccttcgtagagttaatgcgtagaggagacctgccagtgtggctcgcgcacaaagttgccagcgaaggtatcaagtacactgatcggaagtggtgctttgacggcgagaggaataaccagattctggaagagaatatggatgtcgagatctggacgaaagaaggggagaagaagaaacttcgcccccgatggctggacgctagaacctattccgatcctctcgccttgaaagagttcaaagactttgcagctggacggaagtctattgccctggatctagtgacagagatcggcagggtgccctcgcacctggcacatcgcactagaaacgccctcgacaatcttgtcatgctgcacaccagcgaacatggtgggagggcttaccggcacgcggttgaggagttaccagaaacaatggagaccttgctgctcctgggccttatgatactgctcactggaggcgccatgttgttcctgatctcagggaaaggaattggtaagacatccatcggcttaatttgtgtggtagcaagttctgggatgctatggatggctgatgtgcctctgcagtggatcgccagcgccatagtcctcgaatttttcatgatggtgcttctgattcccgagccagagaaacaacgtacgcctcaggacaaccagttggcatatgttgtgatcggcattctgaccctcgctgccatcgtcgcggctaatgaaatgggcctgcttgagactacaaagcgcgatctcggtatgtccaaagaaccgggggtagtgtcacccacctcttacctggacgttgacttgcacccagccagcgcatggaccctgtatgccgtggctacaactgtcataacgcctatgttacgacataccatcgagaacagtacagcaaatgtgtccctagccgcgattgctaaccaagccgtcgtgctgatgggcctcgataagggatggcccatcagcaagatggaccttggcgttccactgttggcactggggtgctactctcaggtgaaccctctcactctgaccgccgctgtacttttactggtgacacactacgccattatcggacccggcctccaggcaaaagctaccagagaagcccagaagaggactgcggccggtataatgaaaaatccgacggtcgatgggattatgacaatcgacttggatccagttatctatgactcaaagtttgagaaacaactgggacaggtgatgctactggtcctctgtgcagtgcagcttctgttgatgcggacctcctgggctttctgcgaggccctgactctcgcaaccggccctattacaactctgtgggaaggtagtcccggcaagttttggaacaccacaatcgctgtaagcatggccaatatattccgcgggtcgtacttagccggagcgggccttgctttttctattatgaagtccgtggggacgggaaaaagaggcaccggtagccagggggagactctgggagaaaagtggaaaaagaaactcaaccaactatcaaggaaggagttcgatctgtataaaaagagtggcatcacagaagttgaccggaccgaggcaaaggagggtttgaaacgaggcgaaattactcatcacgccgtgtctagagggtccgctaagctgcagtggttcgtcgagcgcaatatggtgatcccagaaggaagggtcatagatctcggctgtgggcggggaggctggagctactattgcgccggtcttaaaaaggtgacagaggttcgtgggtacaccaaaggaggccccggccatgaagaacctgtaccgatgtcaacgtatgggtggaacatcgtgaagctgatgagtggaaaggacgtcttttacttgcccccagagaaatgtgataccctgctctgcgacattggtgaaagctccccttctcccacagtggaggaaagcagaactatcagggttttaaagatggtggagccttggctgaaaaataaccagttctgtattaaggtccttaatccatacatgcccaccgtgatcgagcacctggaacgcctacagcggaaacacggcgggatgctcgtacgaaaccctctgtccagaaattcaacacatgagatgtattggatttctaacggaactggcaatatcgtgagttcggttaacatggtcagcaggttgctgctcaatcgctttaccatgacacaccggagaccaaccatagaaaaggatgtggaccttggtgcagggactcgtcatgtgaacgccgagcccgaaacgccgaacatggacgtcattggagagaggatccggcgcatcaaggaggaacactcctctacatggcactacgatgaggaaaatccttataaaacctgggcttaccatggctcatatgaggttaaggcgactggcagcgcctccagtatgattaacggggtggtaaaactgttaaccaagccatgggacgtggtccccacagtgacgcaaatggcaatgaccgatactacacctttcggacagcagcgagtttttaaagaaaaggtggacaccagaactccaaggcccatgccgggtacacggaaggctatggagataaccgccgagtggctgtggcgcacattgggcagaaataaaaggcctcgactctgcactcgggaagagttcaccaagaaagtccgtacgaacgcagccatgggggctgtgtttaccgaagagaatcaatgggattctgccagagcggcagtagaagacgaggagttctggaagctggttgatcgcgaaagggagctacacaaacttggaaagtgtggcagctgcgtgtacaacatgatgggtaaacgggaaaagaagctgggggagtttggaaaagccaagggctcaagagctatctggtatatgtggctcggcgcccgctacctggagttcgaagcattggggtttctgaatgaggaccattggttctccagggaaaacagttttagcggagtcgagggtgaaggcctccacaaacttgggtacattctgcgagatatctctaagattcccggaggcgctatgtatgccgacgatacagctggttgggacactcggatcaccgaggacgatttacataatgaggagaaaataacacagcagatggagccagaacacagacagctggccaacgcaatcttcaagttgacttaccaaaataaggtggtgaaagtccagaggcctacccccaaggggacggttatggacattatctcccgcaaagatcagcgtggatcaggccaggtgggcacatatgggctcaacaccttcactaatatggaggtacaactgattcggcagatggaaggagagggtgtgctaagcaaggcggaccttgagaacccacatctgctcgaaaaagagatcacacagtggctggaaaccaagggcgtcgagagattgaagaggatggccatatcgggggatgactgcgtggttaaacccattgatgaccgctttgctgatgccttactggcactcaatgacatgggaaaggtgcgaaaagatatccctcagtggcaaccatctaagggctggcatgactggcagcaggtcccgttctgtagtcaccattttcacgaacttatcatgaaagatggtcggaagctggtggtaccctgcagacctcaggacgagctaattgggagggctcgcatatcccaaggagccggctggagcctgaaggagactgcatgtctcggcaaagcctacgcgcagatgtgggctttgatgtatttccacagacgggacctgaggcttgcctcaaacgcaatctgctccgccgttccagtgcattgggtccccacctctcgtacaacgtggagcattcacgctcatcaccagtggatgaccactgaagatatgctgacagtgtggaaccgagtttggatcgaggacaatccttggatggaagataagaccccagtgactacatgggaggacgtcccctacctcgggaaacgcgaggatcaatggtgtggaagtttaattggtctggcctccagagcaacctgggctcagaacatcttgacggccatacaacaggtgcggagcctgatcggcaatgaagagtttctcgactatatgccttctatgaagaggttccgcaaagaagaggaatcagagggggcgatttggtga

SEQ ID NO: 15619 - RNA, 9873 nt, synthetic construct
  misc_feature 1..9873: note = derived and/or modified CDS sequence (opt3) from DENV-3__KC762687__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagagcacaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagtttatcgagggaaaagtggtccagcacgaaaatctgaagtatacagtgataattactgttcataccggtgaccagcaccaggtgggcaacgagacacaaggggtcaccgcagaaatcactccccaggcttccacggtggaggccattctccctgaatacggaacacttggcctggagtgctctccacgaaccggtttggacttcaatgagatgatcctactgactatgaaaaacaaggcgtggatggtacatagacagtggtttttcgatctcccgctgccctggaccagcggggccacaaccgaaactcctacatggaataaaaaggagcttctggttacgtttaaaaacgcacacgctaagaagcaagaagtggtcgtgttgggctcccaggagggagccatgcacaccgctctcactggcgccacagaaatccagacctcagggggaacaagtattttcgcaggtcatctgaaatgtaggttaaagatggacaaactggagctaaagggcatgagctatgccatgtgcctcaatgctttcgtcctgaaaaaggaggtgtctgaaactcagcacgggaccatacttatcaaggttgagtacaaaggagaagatgcgccatgtaagattcccttttccacggaggacggccaaggtaaagcacataacgggcggttgatcaccgccaaccctgtggtagtcaagaaagaggaaccagtgaatatagaggctgaacccccgttcggcgagtcaaacattgttatcggaatcggcgataaggccctgaagattaattggtacaaaaaggggagcagtatcggaaaaatgtttgaagcaacagcccgtggtgctcgcagaatggccattctcggcgacactgcatgggatttcgggtctgtgggaggcgtcctgaactcccttggtaagatggtgcaccagatatttgggagcgcgtataccgctctgttctcgggcgtatcttggatcatgaaaattggaatcggcgtgttgctcacatggatcgggctgaattccaagaacacttcaatgagttttagctgcattgttataggaatcattaccttatacctgggcgccgtcgtgcaggcagacatgggttgtgtgatcaattggaaggggaaagagctaaagtgcggatccggcattttcgtcacgaacgaggttcatacatggaccgaacagtataaatttcaagccgattctcctaagaggctcgctactgccatcgcaggtgcttgggagaatggcgtgtgtgggatacggagcacaacccgaatggaaaacctgctttggaaacagatcgccaatgagttgaactacattctgtgggaaaataacatcaagctcactgtggtagtcggagacattatcggcgtgctggagcaggggaaacgcaccttaacaccccagccaatggagctgaagtattcatggaagacgtggggaaaagcgaagatagttaccgccgaaactcaaaatagttccttcattatcgatggccctaacacacccgagtgcccaagcgcttctagagcatggaacgtgtgggaagtcgaggactacggttttggggtgttcaccacaaatatttggcttaaattgagggaaatgtatactcagctctgtgaccaccggctgatgtcagccgctgttaaggatgagcgcgccgtgcacgcagacatgggatactggatcgagagtcagaaaaacggcagctggaagctagaaaaggcgtccctgatagaggtaaaaacctgcacgtggcccaagtctcatacactctggtcgaatggtgtcctggaaagcgatatgatcattcctaaatcccttgccggcccagtgtcacagcacaactacagaccggggtatcatacccaaactgctggaccctggcacttgggcaagctggagttagactttaattactgcgaggggaccacagtggtcatcactgaaaactgtggaaccaggggccctagtctccgtacaacgaccgtttctggtaaactgattcacgagtggtgctgtcggagctgcactcttccacccctgcgatatatgggggaagatggatgttggtacggcatggagatcagacctataaatgaaaaggaggagaacatggtgaagtccttggtatcagccggtagcggcaaagtggacaatttcacaatgggggtcctctgcctggcaattctattcgaagaggtgatgaggggaaagtttggcaaaaagcatatgatcgctggggttctgttcacctttgtgctcctgctttctggacagatcacttggcgcgatatggcccggacattgattatgatcggctccaacgcaagtgacagaatgggtatgggggtcacctatctggccttaattgctacgttcaaaatacagccatttctcgcgctgggattctttcttaggaagctgactagccgcgaaaatctactcctgggcgtgggcttggccatggcaaccacactgcaattacccgaggatatcgaacagatggctaacgggattgccctcggactgatggcccttaagctgatcacccagttcgagacttaccagttgtggacagctctcgtttctctgatgtgttccaataccatttttacactaactgtggcatggcgaaccgccacgctgatccttgcgggtatatcactcttcccggtctgccaaagtagctcgatgcggaaaacagactggctgcctgtaaccgtggctgccatgggcgttccacccttgcctctgtttatcttctccttaaaggatactctcaaacgtagatcttggcccctgaacgagggggtgatggcagtcggacttgtgagcattctggcctcaagtttgctcaggaatgacgtaccaatggctggccctctggtggcaggtgggctactgatcgcctgttatgtcattaccggaacatccgcggatcttactgttgaaaaggctgccgacgtgatctgggaggaagaggcagaacagaccggcgtgtctcacaacctcatgataacggtcgacgatgacggcacaatgcgcattaaagatgacgagaccgagaacatcctgactgtgttgttaaagacagccctgctcatcgttagcgggatttttccctactccataccagctaccctgcttgtatggcatacttggcagaaacagacacaacggtcaggagtgctgtgggatgtcccgagccctcccgaaacccagaaggccgagttggaagagggtgtgtacagaatcaagcagcagggcattttcgggaaaacgcaagttggagtgggcgtccagaaggagggtgtgttccacactatgtggcatgtaaccaggggggcagtcctaacacacaatggaaaacgactggaaccaaactgggctagtgtgaagaaagacctcatctcttatggcggcgggtggcgcctgtccgcccagtggcaaaagggagaggaagttcaggtgattgcggtcgagcccggtaagaatcctaaaaactttcagaccatgccaggcacattccagactaccacgggggaaatcggagccatagcacttgattttaagcccggcacaagcggttcgcctatcattaatcgggaggggaaagtggttggattatacggcaacggcgtggtcactaagaatgggggatatgtgtcaggtatcgctcaaaccaacgccgagccggacggcccaacacccgaactggaggaagagatgttcaaaaagagaaatctcaccattatggatttgcaccctgggtctggaaagactaggaaatacctgccagctatcgtacgtgaagcaataaagcgccggctcagaaccctgattcttgcccccacaagggtggttgccgctgagatggaggaagcgctgaaaggcttgcctatccgatatcagacgactgcaaccaagagtgtccatacaggtaaagagatcgtggacctaatgtgccacgccacctttactatgcggctgctctccccggtgcgcgtccccaactacaatttaattatcatggatgaagctcatttcacagacccagccagcatagcagccagagggtatatttctaccagggtaggaatgggcgaggctgcggccatctttatgacggcaactcctcccggcacagctgatgccttcccacagagcaacgcacctattcaggacgaagagcgggacatccccgagcgatcctggaattcagggaacgaatggataaccgattttgccggaaagaccgtgtggttcgttccaagtattaaggctggtaatgacatcgccaactgtctgagaaaaaacggcaagaaagtgatccaacttagccgcaagacttttgatacagagtaccagaaaaccaagctgaatgactgggatttcgtcgtgacaactgacatttctgaaatgggggcgaacttcaaggcagatagggttatcgacccgcgtcggtgcctcaaacctgtgattttgacggatggacccgagagagtcatactggccggcccaatgcccgtgaccgtagcttccgccgctcagaggcgcggtcgagtggggagaaatcctcagaaggagaacgaccaatacatctttacaggccagccactcaataacgatgaagaccacgcacattggactgaggccaaaatgctgcttgacaatattaacacccccgaaggaatcatccctgctctattcgagccggaacgggagaagtcagccgcaattgatggcgagtataggctgaaaggggaaagtcgcaagacatttgttgagttgatgcgtagaggagacttaccagtctggctggcgcacaaagtggccagcgaaggtataaagtacaccgatcggaagtggtgcttcgacggcgagaggaataaccagatcctcgaagagaatatggatgtggagatttggactaaagaaggggagaagaaaaagctgcgcccccgatggcttgacgctagaacgtattccgatcctctggccctcaaagaatttaaggacttcgcagctggacggaagtctatcgccttggatctggtcaccgagattggcagggttccctcgcacctagcacataaaacacgcagcgccctggacaacctcgtgatgcttcacacttcagaacatggtgggagagcttacaggcacgcggtagaggagctgccagaaaccatggagacattattgctgctcggcctgatgatccttctgaccggaggcgccatgctctttttgatatccgggaagggaatcggtaaaactagtattggcctgatctgtgtggtcgcatctagcgggatgttatggatggctgatgtgcctctacagtggattgcctccgccatcgttctggaattctttatgatggtgctccttatacccgagccagagaagcaacggacacctcaggacaatcagctggcatatgtcgtaattggaatcttgacgctggctgccattgtggcggctaacgaaatgggcctcctggagaccactaaacgtgatcttggtatgtcaaaggaaccgggggttgtgtctcccacaagctacctcgacgtcgacctgcacccagccagtgcatggaccttgtatgccgtggctaccacagtcatcactcctatgctgcgccatacgatagagaattccaccgcaaacgtgagcttagccgcgatcgctaatcaagccgttgtgctaatgggcctggataagggatggcccatttctaaaatggacctcggcgtaccacttctggcattggggtgctactcacaggtgaaccctctgacactcactgccgctgtcctgcttttagttacccactacgccatcattggacccggcctgcaggcaaaggctacacgagaagcccagaaaagaaccgcggccggtatcatgaagaacccgactgtggatgggataatgacgattgacctcgatccagtcatctatgactccaaattcgagaagcaattgggacaggtgatgctgctagtactgtgtgcagtgcagctccttctgatgaggacaagttgggctttttgcgaggccttgaccctggcaactggccctatcaccacactctgggaaggtagccccggcaagttctggaatactaccattgctgtttcgatggccaacatctttcgggggtcttacctggccggagcgggcttagctttctccataatgaaaagcgtggggacaggaaagcgcggcacgggttcacagggggagacccttggagaaaaatggaagaaaaagctgaatcaactcagtagaaaagagttcgatctatataagaagtctggcattactgaagtcgacaggacagaggcaaaagagggtctgaagcggggcgaaatcacccatcacgccgtgtcccgagggagcgctaaattgcagtggtttgtcgagagaaacatggtgattccagaaggacgcgttatcgatctgggctgtgggaggggaggctggtcatactattgcgccggtctcaagaaagtaactgaggtgcgggggtacacaaagggaggccccggccatgaagagcctgtcccgatgagtacctatgggtggaatatagtgaagcttatgagcggaaaagacgttttctacctgcccccagagaagtgtgatacgttgctgtgcgacatcggtgaatcctctcctagccccaccgtggaggaatcccgtacaattagagtcctcaaaatggtggagccttggttaaagaacaatcagttttgtatcaaagtactgaacccatacatgcccactgtgattgagcaccttgaaaggctgcagcgcaagcacggcgggatgctagttcggaatcctctctcacgaaactctacccatgagatgtattggatcagtaatggaacaggcaacattgtctcgagcgtgaatatggtgtccagactgttgctgaacaggttcactatgacccaccgccggccaacaatcgaaaaggatgtcgacctcggtgcagggaccagacatgttaatgccgagcccgaaactccgaacatggacgtgataggagagcgtattaggcggatcaaagaggaacactcttcaacgtggcactacgatgaggaaaacccttataagacatgggcttaccatggcagctatgaggtaaaagcgaccggctccgccagttctatgatcaatggggtggtcaagcttctgactaaaccatgggacgtggttcccaccgtgacacaaatggcaatgacggataccactccttttggacagcagcgcgtcttcaaggaaaaggtggacacacgaaccccaagacccatgccgggtactaggaaagctatggagattacagccgagtggttatggcggaccctgggccgcaacaagagacctaggttgtgcacacgagaagagtttactaaaaaggtacggaccaatgcagccatgggggctgttttcacggaagagaaccaatgggatagcgccaaagcggcagtggaagacgaggagttttggaagctcgtcgatcgtgaaagagagctgcacaaactaggaaagtgtggctcatgcgtgtacaatatgatgggtaagcgcgaaaaaaagcttggggagttcggaaaagccaagggctccagggctatatggtatatgtggctgggcgcccggtacctcgagtttgaagcactggggttcttgaacgaggaccattggtttagtagagaaaatagcttctctggagtggagggtgaaggcctgcacaaactcgggtacatccttcgcgatatttccaagatccccggaggcgctatgtatgccgacgataccgctggttgggacacaaggattactgaggacgatctgcataacgaggaaaagatcacccagcagatggacccagagcaccgacagttagccaatgcaatattcaaactgacataccaaaacaaggtcgttaaagtgcagcggcctactcccaaggggaccgtaatggatatcatttcaagaaaagaccagaggggaagcggccaggtgggcacgtatgggttgaatacatttaccaacatggaagtccaactcatccgccagatggagggagaaggtgtgctgtcgaaggcggatctagagaatccacaccttctggagaaggaaattactcagtggctcgagacaaaaggcgttgaacgtctgaagcggatggccatctctggggacgattgcgtggtcaaacccatagacgatagattcgctgacgccttgttagcactgaacgatatgggaaaggtgaggaaagacattcctcagtggcaaccaagtaagggctggcatgattggcagcaggtaccgttttgttcccaccatttccacgagctcatcatgaaggacggtcgcaaacttgttgtgccctgccgacctcaggacgaactgatcgggcgggctagaattagccaaggagccggctggtcactaagggagaccgcatgtctgggcaaggcctacgcgcagatgtgggctctcatgtattttcaccgcagagatttgcggctggcctccaatgcaatatgctctgccgtcccagtgcattgggttcccactagcaggaccacatggagtatccacgctcatcaccagtggatgacgaccgaggacatgcttactgtgtggaaccgtgtctggattgaagataacccttggatggaggacaaaacaccagtgaccacttgggaagatgtaccctacctggggaagcgagaggaccaatggtgtggatccctcatcggtttagccagccgcgcaacatgggctcagaatattctgaccgccatccagcaggtgagatctttgataggcaacgaggaattcctggattatatgccttcaatgaaacggtttaggaaggaggaagagagtgaaggggcgatctggtga

SEQ ID NO: 15620 - RNA, 9873 nt, synthetic construct
  misc_feature 1..9873: note = derived and/or modified CDS sequence (opt3) from DENV-3__KC762688__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagagcacaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagtttatcgagggaaaagtggtccagcacgaaaatctgaagtatacagtgataattactgttcataccggtgaccagcaccaggtgggcaacgagacacaaggggtcaccgcagaaatcactccccaggcttccacggtggaggccattctccctgaatacggaacacttggcctggagtgctctccacgaaccggtttggacttcaatgagatgatcctactgactatgaaaaacaaggcgtggatggtacatagacagtggtttttcgatctcccgctgccctggaccagcggggccacaaccgaaactcctacatggaataaaaaggagcttctggttacgtttaaaaacgcacacgctaagaagcaagaagtggtcgtgttgggctcccaggagggagccatgcacaccgctctcactggcgccacagaaatccagacctcagggggaacaagtattttcgcaggtcatctgaaatgtaggttaaagatggacaaactggagctaaagggcatgagctatgccatgtgcctcaatgctttcgtcctgaaaaaggaggtgtctgaaactcagcacgggaccatacttatcaaggttgagtacaaaggagaagatgcgccatgtaagattcccttttccacggaggacggccaaggtaaagcacataacgggcggttgatcaccgccaaccctgtggtaacaaagaaagaggaaccagtcaatatagaggctgaacccccgttcggcgagtcaaacattgtgatcggaatcggcgataaggccctgaagattaattggtacaaaaaggggagcagtatcggaaaaatgtttgaagcaactgcccgtggtgctcgcagaatggccattctcggcgacaccgcatgggatttcgggtctgttggaggcgtgctgaactcccttggtaagatggtccaccagatatttgggagcgcgtatacagctctgttctcgggcgtgtcttggatcatgaaaattggaatcggcgtattgctcacttggatcgggctgaattccaagaacacctcaatgagttttagctgcattgtgataggaatcattacgttatacctgggcgccgttgtccaggcagacatgggttgtgtgatcaattggaaggggaaagagctaaagtgcggatccggcattttcgtgacaaacgaggtccatacctggactgaacagtataaatttcaagccgattctcctaagaggctcgctacagccatcgcaggtgcttgggagaatggcgtttgtgggatacggagcaccactcgaatggaaaacctgctttggaaacagatcgccaatgagttgaactacattctgtgggaaaataacatcaagctcaccgtggtggtaggagacattatcggcgtcctggagcaggggaaacgcacattaacgccccagccaatggagctgaagtattcatggaagacctggggaaaagcgaagatagtgactgccgaaacacaaaatagttccttcattatcgatggccctaacacccccgagtgcccaagcgcttctagagcatggaacgtttgggaagtggaggactacggttttggggtcttcacaactaatatttggcttaaattgagggaaatgtatacccagctctgtgaccaccggctgatgtcagccgctgtgaaggatgagcgcgccgttcacgcagacatgggatactggatcgagagtcagaaaaacggcagctggaagctagaaaaggcgtccctgatagaggtgaaaacgtgcacatggcccaagtctcataccctctggtcgaatggtgtactggaaagcgatatgatcattcctaaatcccttgccggcccagtctcacagcacaactacagaccggggtatcatactcaaaccgctggaccctggcacttgggcaagctggagttagactttaattactgcgaggggacaactgtggtgatcaccgaaaactgtggaacaaggggccctagtctccgtacgaccactgtctctggtaaactgattcacgagtggtgctgtcggagctgcacacttccacccctgcgatatatgggggaagatggatgttggtacggcatggagatcagacctataaatgaaaaggaggagaacatggttaagtccttggtgtcagccggtagcggcaaagtagacaatttcaccatgggggtgctctgcctggcaattctattcgaagaggtcatgaggggaaagtttggcaaaaagcatatgatcgctggggtgctgttcacttttgttctcctgctttctggacagatcacatggcgcgatatggcccggaccttgattatgatcggctccaacgcaagtgacagaatgggtatgggggtgacgtatctggccttaattgctactttcaaaatacagccatttctcgcgctgggattctttcttaggaagctgaccagccgcgaaaatctactcctgggcgtcggcttggccatggcaacaaccctgcaattacccgaggatatcgaacagatggctaacgggattgccctcggactgatggcccttaagctgatcactcagttcgagacataccagttgtggaccgctctcgtgtctctgatgtgttccaatacactatttactctgaccgttgcatggcgaacggccacacttattctcgcgggtatctcactgttgccggtgtgccaaagtagctcgatgcggaaaaccgactggctgcctgtcactgtagctgccatgggcgtgccacccttacctctcttcatattttccctgaaggatacccttaaacgtagatcttggcccctgaacgagggggttatggcagtgggattggtcagcatcctcgcctcaagtctgctaaggaatgacgtgccaatggctggccctctggtagcaggtgggcttctcattgcctgttatgtgatcacaggaacttccgcggatctgaccgtcgaaaaggctgccgacgttatttgggaggaagaggcagaacagacgggcgtgtctcacaacttgatgatcacagtggacgatgacggcaccatgcgcataaaagatgacgagactgagaacattttaacagtcctgctcaagaccgccctgcttatcgtgagcgggatcttcccctactccattccagctactctgttggtttggcatacatggcagaaacagacccaacggtcaggagtactatgggatgtgccgagccctcccgaaacgcagaaggccgagctggaagagggtgtctacagaataaagcagcagggcatctttgggaaaactcaagtgggagttggcgtgcagaaggagggtgtcttccacaccatgtggcatgtgacaaggggggcagtactcacccacaatggaaaacgactggaaccaaactgggctagtgtcaagaaagaccttatttcttatggcggcgggtggcgcttatccgcccagtggcaaaagggagaggaagtgcaggttatcgcggtggagcccggtaagaatcctaaaaacttccagacaatgccaggcatttttcagactaccacgggggaaatcggagccatagcactggatttcaagcccggcacaagcggttcgcctatcattaatcgggaggggaaagtcgtgggactctacggcaacggcgttgtgactaagaatgggggatatgtctcaggtatcgctcaaaccaacgccgagccggacggcccaacacccgaattggaggaagagatgtttaaaaagagaaatctgaccattatggatctccaccctgggtctggaaagactaggaaatacctgccagctatcgtgcgtgaagcaataaagcgccggcttagaaccctgattttggcccccacaagggtagtggccgctgagatggaggaagcgctaaaaggcctgcctatccgatatcagacgactgcaaccaagagtgcccatacaggtaaagagatcgttgacctcatgtgccacgctaccttcactatgcggttactgtccccggtccgcgtgcccaactacaatcttattatcatggatgaagcccattttacagacccagcaagcatagccgctagagggtatatttctaccagggtgggaatgggcgaggcggccgcaatcttcatgacggctactcctcccggcacagccgatgcatttccacagagcaacgcccctattcaggacgaagagcgggacatccccgagcgatcctggaattcagggaacgaatggataaccgatttcgctggaaagaccgtctggtttgtaccaagtattaaggccggtaatgacatcgcgaactgtctgagaaaaaacggcaagaaagtgatccaactcagccgcaagactttcgatacagagtaccagaaaaccaagttgaatgactgggattttgttgtgacaactgacatttctgaaatgggggcaaacttcaaggccgatagggtcatcgacccgcgtcggtgcctgaaacctgtgattctcacggatggacccgagagagttatactggctggcccaatgcccgtgaccgtcgcctccgctgcacagaggcgcggtcgagtggggagaaatcctcagaaggagaacgaccaatacatcttcacaggccagccacttaataacgatgaagaccacgcccattggactgaggctaaaatgctactggacaatattaacacccccgaaggaatcatccctgccttgtttgagccggaacgggagaagtcagcagcgattgatggcgagtataggttaaaaggggaaagtcgcaagacattcgtagagctgatgcgtagaggagacctcccagtgtggctggcccacaaagttgctagcgaaggtataaagtacaccgatcggaagtggtgctttgacggcgagaggaataaccagatccttgaagagaatatggatgtcgagatttggactaaagaaggggagaagaaaaagctgcgcccccgatggctcgacgccagaacgtattccgatcctttggcactgaaagaattcaaggactttgctgccggacggaagtctatcgcactagatctggtgaccgagattggcagggtgccctcgcacctcgcccatcgcacaagaaacgctcttgacaatctggtcatgttacacactagcgaacatggtgggagggcgtaccggcacgccgttgaggagttcccagaaaccatggagacattgctgctcctgggccttatgatcctgctcaccggaggcgcaatgttgtttctgatatcagggaaaggaatcggtaagacttccattggcttaatctgtgtggtagctagttctgggatgctatggatggccgatgtgcctctgcagtggattgccagcgcaatcgtcctcgaattctttatgatggtgcttctgatacccgagccagagaaacaacgtacacctcaggacaaccagttggcttatgttgtgattggaatcctgacgctcgccgcgattgtcgctgccaatgaaatgggcctgcttgagaccactaagcgcgatctcggtatgtccaaagaaccgggggtagtgtcacccacatcttacctggacgttgacttgcacccagcaagcgcctggaccctgtatgctgtggcaaccacagtcatcactcctatgttacgacatacgatagagaacagtaccgccaatgtgtccctagcggctatcgccaaccaagcagtcgtgctgatgggcctcgataagggatggcccattagcaagatggaccttggcgttccactgttggccctggggtgctactctcaggtgaaccctctcacactgactgctgccgtacttttactggtgacccactacgcaatcattggacccggcctccaggctaaagccacaagagaagcgcagaagaggaccgccgcaggtatcatgaaaaatccgactgtcgatgggataatgacgattgacttggatccagttatctatgactcaaagttcgagaaacaactgggacaggtgatgctactggtcctctgtgctgtgcagcttctgttgatgcggacatcctgggccttttgcgaggcactgaccctcgctactggccctatcaccacactgtgggaaggtagtcccggcaagttctggaacactaccattgccgtaagcatggccaatatctttcgcgggtcgtacttagcgggagctggccttgcattctctataatgaagtccgtggggacaggaaaaagaggcacgggtagccagggggagaccctgggagaaaagtggaaaaagaaactcaaccaactatcaaggaaggagttcgatctgtataaaaagagtggcattactgaagttgaccggacagaggccaaggagggtttgaaaaagggcgaaatcacccatcacgctgtgtctcgagggtccgccaaactgcagtggtttgtcgagagaaatatggtgattccagaaggacgcgtcatcgatctcggctgtgggaggggaggctggagctactattgcgcaggtcttaagaaagtgactgaggttcgggggtacacaaagggaggccccggccatgaagagcctgtaccgatgtcaacctatgggtggaacatagtgaagctgatgagtggaaaagacgtcttctacttgcccccagagaagtgtgatacgctgctctgcgacatcggtgaaagctccccttctcccaccgtggaggaaagccgtacaattagagttttaaaaatggtggagccttggctgaagaataaccagttttgtatcaaagtccttaatccatacatgcccactgtgattgagcacctggaaaggctacagcgcaagcacggcgggatgctcgtacggaaccctctgtcccgaaattcaacccatgagatgtattggatctctaacggaacaggcaatattgtgagttcggttaacatggtcagcagattgctgctcaataggttcactatgacccaccgccggccaacaatcgaaaaggatgtggaccttggtgccgggaccagacatgtgaacgctgagcccgaaactccgaacatggacgtcataggagagcgtattaggcggatcaaagaggaacactcctctacgtggcactacgatgaggaaaatccttataagacatgggcgtaccatggctcatatgaggttaaagccaccggcagcgcatccagtatgatcaacggggtggtaaagctgttaactaaaccatgggacgtggtccccaccgtgacacaaatggctatgacggataccactccttttggacagcagcgcgttttcaaggaaaaggtggacacacgaaccccaagacccatgccgggtactaggaaagccatggagattacagcagagtggctgtggcggaccttgggccgcaataagagacctaggctctgcacacgagaagagtttactaaaaaggtccggaccaacgccgctatgggggccgtgttcacggaagagaatcaatgggattctgcgcgtgcagccgtagaagacgaggagttttggaaactggttgatagagaacgcgagctacacaagcttggaaaatgtggcagctgcgtgtacaacatgatgggtaagagggaaaagaaactgggggagttcggaaaggctaaaggctcacgggccatatggtatatgtggctcggcgcaagatacctggagtttgaagctttggggttcctgaatgaggaccattggttttcccgcgaaaacagtttcagcggagtcgagggtgaaggcctccacaagcttgggtacatcctgagggatatttctaaaatccccggaggcgccatgtatgctgacgataccgccggttgggacacacgaattactgaggacgatttacataatgaggaaaagatcacccagcagatggacccagagcaccggcagctggcaaacgcgatattcaagttgacataccaaaataaagtggtgaaggtccagagacctactcccaaagggaccgttatggatatcatttccaggaaggaccagcgcggatcaggccaggtgggcacgtatgggctcaacacatttaccaatatggaagtacaactgatccgtcagatggagggagaaggtgtgctaagcaaagccgatcttgagaacccacacctgctcgagaaggaaattactcagtggctggagacaaagggcgtcgaacggttgaaaagaatggctatctcgggggacgattgcgtggttaagcccatagacgataggttcgccgacgcattactggctctcaatgatatgggaaaagtgcgcaaggacattcctcagtggcaaccatctaaaggctggcatgattggcagcaggtcccgttttgtagtcaccatttccacgagcttatcatgaaggacggtcgaaagctggtggtaccctgccggcctcaggacgaactaatcgggagagccaggatttcccaaggagcaggctggagcctgaaagagaccgcctgtctcggcaaggcgtacgctcagatgtgggccttgatgtattttcaccgcagagatctgcggcttgcatcaaacgccatatgctccgctgttccagtgcattgggtccccacttctaggaccacatggagcatccacgcccatcaccagtggatgacgaccgaggacatgctgactgtgtggaaccgtgtttggattgaagataatccttggatcgaggacaaaacaccagtgaccacttgggaagatgtcccctacctcgggaagcgagaggaccaatggtgtggaagtttaattggtctggcatcccgcgctacatgggcccagaacatcttgaccgcgatacagcaggtgagaagcctgatcggcaatgaggaattcctcgattatatgccttctatgaaacggtttaggaaggaggaagagtcagaaggggctatttggtga

SEQ ID NO: 15621 - RNA, 9873 nt, synthetic construct
  misc_feature 1..9873: note = derived and/or modified CDS sequence (opt3) from DENV-3__KC762689__SS-prME
  source 1..9873: mol_type = other RNA
accagcctgtgcctcatgatgatgatccccgccacacttgctttccacctgacttccagagacggcgagcctaggatgattgtggggaagaacgaacggggaaaatctttgttatttaagacggcatcaggtataaatatgtgtaccctgatcgccatggatctaggcgagatgtgcgacgatacagtcacttacaaatgtccactcattaccgaagttgagccggaagacatcgattgctggtgtaacctgacaagtacctgggtgacttatgggacatgcaatcaggcgggagagcatcgccgagacaagcgtagcgtagctcttgccccccacgtgggcatgggtctggataccagagcacaaacgtggatgtccgccgagggggcttggaggcaggtcgaaaaagtggagacttgggcattccggcatcctggatttaccattttggccctcttcctggctcactacatcggcacatctctgactcagaaggttgtgatatttatcctcttaatgctggtcaccccatcgatgacaatgcgctgtgtgggcgtagggaacagagacttcgttgaaggactttcaggtgccacctgggtggatgtcgtgttggagcatggcgggtgcgtgacgactatggcgaagaataaacccacactggacattgagctacagaagaccgaagcaactcaactcgccacactgaggaaactttgtatcgagggaaagattaccaacgtcacgaccgatagccggtgccctacacagggcgaagctatcctgccagaggaacaggaccagaattatgtttgtaaacacacttacgtggatcgcggttgggggaacggatgcggcttgtttggcaaggggagtctcgtaacctgcgccaagttccaatgtctggagtttatagagggaaaagtggtccagcacgaaaatttaaagtatacagtgattatcactgttcataccggtgaccagcaccaggtgggcaacgagacacaaggggtcaccgcagaaattactccccaggcttccacggtggaggccatcctgcctgaatacggaacactcggccttgagtgctctccacgaaccggtctggacttcaatgagatgatcttgctaactatgaaaaacaaggcgtggatggtacatagacagtggtttttcgatctgccgctcccctggaccagcggggccacaaccgaaactcctacatggaataaaaaggagctgcttgttacgtttaaaaacgcacacgctaagaagcaagaagtggtcgtgctgggctcccaggagggagccatgcacaccgctttgactggcgccacagaaattcagacctcagggggaacaagtatattcgcaggtcatctcaaatgtaggctgaagatggacaaattagagctgaagggcatgagctatgccatgtgcctaaatgctttcgtcctcaaaaaggaggtgtctgaaactcagcacgggaccatcctgattaaggttgagtacaaaggagaagatgcgccatgtaagatccccttttccacggaggacggccaaggtaaagcacataacgggcggcttataaccgccaaccctgtggtaacaaagaaagaggaaccagtcaatattgaggctgaacccccgttcggcgagtcaaacatcgtgatcggaattggcgataaggccttgaagatcaattggtacaaaaaggggagcagtattggaaaaatgtttgaagcaactgcccgtggtgctcgcagaatggccatactgggcgacaccgcatgggatttcgggtctgttggaggcgtgctcaactccctgggtaagatggtccaccagatctttgggagcgcgtatacagctcttttctcgggcgtgtcttggattatgaaaatcggaatcggcgtactgttgacttggattgggctcaattccaagaacacctcaatgagttttagctgcatagtgatcggaattatcacgctgtacttaggcgccgttgtccaggcagacatgggttgtgtgattaattggaaggggaaagagctgaagtgcggatccggcatcttcgtgacaaacgaggtccatacctggactgaacagtataaatttcaagccgattctcctaagaggctagctacagccatagcaggtgcttgggagaatggcgtttgtgggatccggagcaccactcgaatggaaaacctcctgtggaaacagattgccaatgagcttaactacatcttgtgggaaaataacattaagctgaccgtggtggtaggagacatcataggcgtcctcgagcaggggaaacgcacactgacgccccagccaatggagttaaagtattcatggaagacctggggaaaagcgaagattgtgactgccgaaacacaaaatagttccttcatcattgatggccctaacacccccgagtgcccaagcgcttctagagcatggaacgtttgggaagtggaggactacggttttggggtcttcacaactaatatctggctgaaacttagggaaatgtatacccagttgtgtgaccaccggctcatgtcagccgctgtgaaggatgagcgcgccgttcacgcagacatgggatactggatagagagtcagaaaaacggcagctggaagctggaaaaggcgtccctaatcgaggtgaaaacgtgcacatggcccaagtctcataccctgtggtcgaatggtgtactcgaaagcgatatgattatccctaaatccctggccggcccagtctcacagcacaactacagaccggggtatcatactcaaaccgctggaccctggcaccttggcaagttggagctggactttaattactgcgaggggacaactgtggtgattaccgaaagttgtggaacaaggggcccttctttacgtacgaccactgtcagcggtaaactcatccacgagtggtgctgtcggtcctgcacactgccaccccttcgatatatgggggaagatggatgttggtacggcatggagataagacctattaacgaaaaggaggagaatatggttaagtcactggtgagcgccggttctggcaaagtagacaacttcaccatgggggtgttgtgcctcgcaatcctgttcgaagaggtcatgaggggaaagtttggcaaaaagcatatgatcgctggggtgctattcacttttgttctgctcctgtccggacagattacatggcgcgatatggcccggacccttatcatgattggcagtaatgcaagcgacagaatgggtatgggggtgacgtatttggccctgatagctactttcaaaatccagccatttttagcgctcggattctttctgaggaagcttacctctcgcgaaaacctgctactcggcgtcggcctggccatggcaacaaccttgcaactgcccgaggatattgaacagatggctaatgggatcgccttaggactcatggccctgaagcttattactcagttcgagacataccagctgtggaccgctttggtgtccctcatgtgttcaaacacaatctttactctgaccgttgcatggcgaacggccacactaatactggcgggtatcagtcttctcccggtgtgccaaagctcgtccatgcggaaaaccgactggctgcctgtcactgtagctgccatgggcgtgccacccttgcctctgttcattttttctttaaaggataccctcaaacgtagaagctggcccctgaatgagggggttatggcagtgggacttgtctcaatcctggccagttccttgctcaggaacgacgtgccaatggctggccctctggtagcaggtgggctactgattgcctgttatgtgatcacaggaacttctgcggatcttaccgtcgaaaaggctgccgacgttatatgggaggaagaggcagaacagacgggcgtgagccacaatctcatgattacagtggacgatgacggcaccatgcgcatcaaagatgacgagactgagaacatcctgacagtcttgttaaagaccgccctgctcattgtgtccgggatattcccctactcaatcccagctactctgcttgtttggcatacatggcagaaacagacccaacggagcggagtactgtgggatgtgccgagtcctcccgaaacgcagaaggccgagttggaagagggtgtctacagaattaagcagcagggcatctttgggaaaactcaagtgggagttggcgtgcagaaggagggtgtcttccacaccatgtggcatgtgacaaggggggcagtactaacccacaacggaaaacgactggaaccaaattgggcttctgtcaagaaagacctcatttcctatggcggcgggtggcgcctgagcgcccagtggcaaaagggagaggaagtgcaggttgtggcggtcgagcccggtaagaaccctaaaaatttccagacaatgccaggcatctttcagactaccacgggggaaataggagccatcgcacttgatttcaagcccggcacatcgggttcacctattatcaaccgggaggggaaagtggttggattatacggcaatggcgtggtcactaagaacgggggatatgtgtctggtattgctcaaaccaatgccgagccggacggcccaacacccgatctggaagaggaaatgtttaaaaagagaaacctcaccatcatggacttgcaccctgggagtggaaagactaggaaatacctgccagctatagtacgtgaggcaattaagcgccggctcagaaccctgatccttgcccccacaagggtggttgccgctgaaatggaggaggcgctgaaaggcttgcctatccgatatcagacgactgcaaccaagtccgtccatacaggtaaagaaattgtggatctaatgtgccacgccaccttcactatgcggctgctcagcccggtgcgcgtccccaattacaacttaatcataatggacgaggctcattttacagatccagcctctattgcagccagagggtatatcagcaccagggtaggaatgggcgaagctgcggccattttcatgacggcaactcctcccggcacagctgacgcctttccacagtccaatgcacctatccaggacgaggaacgggatatacccgagcgatcatggaacagtgggaatgagtggattaccgacttcgccggaaagaccgtgtggtttgttccaagcatcaaggctggtaacgatatcgccaattgtctgagaaaaaacggcaagaaagtgattcaactttctcgcaagactttcgacacagaataccagaaaaccaagctgaacgattgggactttgtcgtgacaactgatatctccgagatgggggcgaatttcaaggcagacagggttattgatccgcgtcggtgcctcaaacctgtgatattgacggacggacccgaaagagtcatcctggccggcccaatgcccgtgaccgtagcttcagccgctcagaggcgcggtcgagtggggagaaaccctcagaaggagaatgatcaatacattttcacaggccagccactcaacaatgacgaggaccacgcacattggactgaagccaaaatgctgcttgataacatcaatacccccgagggaatcattcctgctctatttgaaccggagcgggaaaagagtgccgcaatagacggcgagtataggctgaaaggggagagccgcaagacattcgttgaattgatgcgtagaggagatttaccagtctggctggcgcacaaagtggcctccgagggtatcaagtacaccgaccggaagtggtgctttgatggcgaaaggaacaatcagattctcgaggaaaacatggacgtggagatctggactaaagagggggaaaagaaaaagctgcgcccccgatggcttgatgctagaacgtattctgaccctctggccctcaaagagttcaaggattttgcagctggacggaagtcgattgccttggacctggtcaccgaaatcggcagggttcccagccacctagcataccgcacaagaaatgccctggataacctcgtgatgcttcatacttcagagcacggtgggagggcttatcggcatgcggtagaagagctgccagagaccatggaaacattattgctgctcggcctgatgatacttctgaccggaggcgccatgctcttcttgatctccgggaaaggaattggtaagactagtatcggcctgatttgtgtggtcgcatctagcgggatgttatggatggctgacgtgcctctacagtggatcgcctccgccatagttctggagtttttcatgatggtgctccttattcccgaaccagagaaacaacgtacacctcaggataatcagctggcatacgtcgtaatcggaattttgacgctggctgccatcgtggcggctaacgagatgggcctcctggaaaccactaagcgcgaccttggtatgtcaaaagagccgggggttgtgtctcccacaagctatctcgacgtcgatctgcacccagccagtgcatggaccttgtacgccgtggctaccacagtcataactcctatgctgcgacacacgatcgaaaattccaccgcaaacgtgagcttagccgcgattgctaatcaagccgttgtgctaatgggcctggacaagggatggcccatctctaaggtagatctcggcgtgccacttctggcattggggtgctactcacaggtcaaccctctgacactcactgccgctgttctgcttttagtgacccattatgccattatcggacccggcctgcaggcaaaagctacaagagaggcccagaagaggaccgcggccggtataatgaaaaacccgactgtcgacgggattatgacgatcgatctcgacccagtgatctacgattccaagtttgaaaaacaattgggacaggtaatgctgctagtgctgtgtgcagttcagctccttctgatgcggacaagttgggctttctgcgaggccttgaccctggcaactggccctattaccacactctgggagggtagccccggcaagttttggaatactaccatcgctgtgtcgatggccaacatattccgcgggtcttatctggccggagcgggcttagctttttccattatgaagagcgtcgggacaggaaaaagaggcacgggttcacagggggaaacccttggagagaagtggaaaaagaaactgaatcaactcagtaggaaggaattcgacctatacaaaaagtctggcatcactgaggtggatcggacagaagcaaaggagggtctgaaacgaggcgagaccactcaccatgccgtctccagagggagcgctaagttgcagtggttcgtggaacgcaacatggttattccagagggaagggtaatcgacctgggctgtgggcggggaggctggtcatattactgcgccggtctcaaaaaggtgacagaagtccgtgggtataccaaaggaggccccggccacgaggaacctgtgccgatgagtacgtacgggtggaatatagttaagcttatgagcggaaaggatgtgttttacctgcccccagagaaatgtgacaccttgctgtgcgatatcggtgagtcctctcctagccccacagtcgaagagtccagaactattagggtgctcaagatggtagaaccttggttaaaaaacaatcagttctgtatcaaggtgctgaacccatatatgcccaccgttattgagcatcttgagcgcctgcagcggaaacacggcgggatgctagtccgaaatcctctctcaagaaactctacacacgaaatgtactggatcagtaatggaactggcaacattgtgtcgagcgtgaatatggtctccaggctgttgctgaaccgctttaccatgacacatcggagaccaaccatcgagaaggacgttgacctcggtgcagggactcgtcacgtgaatgccgaacccgagacgccgaacatggatgtaataggagaaaggattcggcgcatcaaggaggagcattcttcaacatggcactatgacgaagagaacccttacaaaacctgggcttatcacggcagctacgaagtgaaggcgactggctccgccagttctatgatcaatggggtcgtgaaacttctgaccaagccatgggatgttgtgcccacagtcacgcaaatggcaatgaccgacactacacctttcggacagcagcgagtgtttaaagagaaggtagataccagaactccaaggcccatgccgggtacacggaaggctatggaaattaccgccgagtggttatggcgcacactgggcagaaacaaaaggcctcgattgtgcactcgggaggaattcaccaagaaagttcgtacgaatgcagccatgggggctgtgtttaccgaggaaaaccaatgggacagcgccagagcggcagtcgaggatgaagagttctggaagctcgtggaccgcgagagggaactgcataaactaggaaagtgtggctcatgcgtgtataatatgatgggtaaacgggagaagaagcttggggaatttggaaaagccaagggctccagagctatatggtacatgtggctgggcgcccgctacctcgagttcgaggcactggggtttttgaacgaagatcactggttcagtagggagaatagcttttctggagtcgaaggtgagggcctgcataaactcgggtatatccttcgagacatttccaagatccccggaggcgctatgtacgccgatgacacagctggttgggacactcggattaccgaagatgacctgcacaacgaggagaaaatcacacagcagatggatccagaacatagacagttagccaatgcaatattcaagctgacttatcaaaacaaggttgtgaaagtacagaggcctacccccaaggggacggtgatggacatcatttcacgcaaagatcagcgtggaagcggccaggtcggcacatacgggttgaataccttcactaacatggaggtgcaactcatccggcagatggaaggagagggtgttctgtcgaaggcggacctagaaaatccacaccttctggagaaagagattacacagtggctcgaaaccaagggcgtggagagactgaagaggatggccatctctggggatgactgcgtcgtgaaacccatagatgaccgctttgctgatgccttgttagcactgaacgacatgggaaaggtacgaaaagatattcctcagtggcaaccaagtaagggctggcacgactggcagcaggttccgttctgttcccatcactttcatgaactcatcatgaaagacggtcggaagcttgtggtcccctgcagacctcaggatgagctgatcgggagggctcgcattagccaaggagccggctggtcactaaaggaaactgcatgtctgggcaaagcctatgcgcagatgtgggctctcatgtacttccacagacgggacttgaggctggcctccaatgcaatatgctctgccgtgccagttcactgggtgcccaccagccgtacaacgtggagtatccatgctcaccatcagtggatgaccactgaggatatgcttacagtctggaaccgagtgtggattgaggacaacccttggatggaagataagaccccagtaactacatgggaggacgtgccctatctggggaaacgcgaagatcaatggtgtggatccctcatcggtttagccagcagagcaacctgggctcagaatattctgacggccatccagcaggtccggtctttgataggcaacgaggagtttctggactacatgccttcaatgaagaggttccgcaaagaagaggaaagtgagggggcgatctggtga

SEQ ID NO: 15622 - RNA, 9873 nt, synthetic construct
  misc_feature 1..9873: note = derived and/or modified CDS sequence (opt3) from DENV-3__KC762690__SS-prME
  source 1..9873: mol_type = other RNA
accagcctgtgcctcatgatgatgcttcccgcaacactggctttccacttgacttccagagacggagaacctaggatgatcgtggggaagaacgaacggggaaaatctttactgtttaagacggcatcaggtattaatatgtgtaccctgatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcaccgccgagacaagcgtagcgtagctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagtttatcgagggaaaagtggtccagcacgaaaatctgaagtatacagtgataattactgttcataccggtgaccagcaccaggtgggcaacgagacacaaggggtcaccgcagaaatcactccccaggcttccacggtggaggccattctccctgaatacggaacacttggcctggagtgctctccacgaaccggtttggacttcaatgagatgatcctactgactatgaaaaacaaggcgtggatggtacatagacagtggtttttcgatctcccgctgccctggaccagcggggccacaaccgaaactcctacatggaataaaaaggagcttctggttacgtttaaaaacgcacacgctaagaagcaagaagtggtcgtgttgggctcccaggagggagccatgcacaccgctctcactggcgccacagaaatccagacctcagggggaacaagtattttcgcaggtcatctgaaatgtaggttaaagatggacaaactggagctaaagggcatgagctatgccatgtgcctcaatgctttcgtcctgaaaaaggaggtgtctgaaactcagcacgggaccatacttatcaaggttgagtacaaaggagaagatgcgccatgtaagattcccttttccacggaggacggccaaggtaaagcacataacgggcggttgatcaccgccaaccctgtggtaacaaagaaagaggaaccagtcaatatagaggctgaacccccgttcggcgagtcaaacattgtgatcggaatcggcgataaggccctgaagattaattggtacaaaaaggggagcagtatcggaaaaatgtttgaagcaactgcccgtggtgctcgcagaatggccattctcggcgacaccgcatgggatttcgggtctgttggaggcgtgctgaactcccttggtaagatggtccaccagatatttgggagcgcgtatacagctctgttctcgggcgtgtcttggatcatgaaaattggaatcggcgtattgctcacttggatcgggctaaattccaagaacacctcaatgagttttagctgcattgtgataggaatcattacgttatacctgggcgccgttgtccaggcagacatgggttgtgtgatcaattggaaggggaaagagctaaagtgcggatccggcattttcgtgacaaacgaggtccatacctggactgaacagtataaatttcaagccgattctcctaagaggctcgctacagccatcgccggtgcttgggagaatggcgtttgtgggatacggagcaccactcgaatggaaaacctgctttggaaacagatcgccaatgagttgaactacattctgtgggaaaataacatcaagctcaccgtggtggtaggagacattatcggcgtcctggagcaggggaaacgcacattaacgccccagccaatggagctgaagtattcatggaagacctggggaaaagcgaagatagtgactgccgaaacacaaaatagttccttcattatcgatggccctaacacccccgagtgcccaagcgcttctagagcatggaacgtttgggaagtggaggactacggttttggggtcttcacaactaatatttggcttaaattgagggaaatgtatacccagctctgtgaccaccggctgatgtcagccgctgtgaaggatgagcgcgccgttcacgcagacatgggatactggatcgagagtcagaaaaacggcagctggaagctagaaaaggcgtccctgatagaggtgaaaacgtgcacatggcccaagtctcataccctctggtcgaatggtgtactggaaagcgatatgatcattcctaaatcccttgccggcccagtctcacagcacaactacagaccggggtatcatactcaaaccgctggaccctggcacttgggcaagctggagttagactttaattactgcgaggggacaactgtggtgatcaccgaaaactgtggaacaaggggccctagtctccgtacgaccactgtctctggtaaactgattcacgagtggtgctgtcggagctgcacacttccacccctgcgatatatgggggaagatggatgttggtacggcatggagatcagacctataaatgaaaaggaggagaacatggttaagtccttggtgtcagccggtagcggcaaagtagacaatttcaccatgggggtgctctgcctggcaattctattcgaagaggtcatgaggggaaagtttggcaaaaagcatatgatcgctggggtgctgttcacttttgttctcctgctttctggacagatcacatggcgcgatatggcccggaccttgattatgatcggctccaacgcaagtgacagaatgggtatgggggtgacgtatctggccttaattgctactttcaaaatacagccatttctcgcgctgggattctttcttaggaagctgaccagccgcgaaaatctactcctgggcgtcggcttggccatggcaacaaccctgcaattacccgaggatatcgaacagatggctaacgggattgccctcggactgatggcccttaagctgatcactcagttcgagacataccagttgtggaccgctctcgtgtctctgatgtgttccaatacaatttttactctaaccgttgcatggcgaacggccacactgatccttgcgggtatatcactcctgccggtgtgccaaagtagctcgatgcggaaaaccgactggttgcctgtcactgtagctgccatgggcgtgccacccctgcctttattcatcttttccctcaaggataccctgaaacgtagatcttggccccttaacgagggggttatggcagtgggactggtcagcattttggcctcaagtctcctgaggaatgacgtgccaatggctggccctctagtagccggtgggctgcttatcgcctgttatgtgattacaggaacttccgcggatctcaccgtcgaaaaggctgccgacgttatctgggaggaagaggcagaacagacgggcgtgtctcacaacctgatgataacagtggacgatgacggcaccatgcgcattaaagatgacgagactgagaacatcttgacagtcttactgaagaccgccctcctgatcgtgagcgggattttcccctactccataccagctactcttctggtttggcatacatggcagaaacagacccaacggtcaggagtattgtgggatgtgccgagccctcccgaaacgcagaaggccgagctagaagagggtgtctacagaatcaagcagcagggcatttttgggaaaactcaagtgggagttggcgtgcagaaggagggtgtcttccacaccatgtggcatgtgacaagaggggcagtactgacccacaatggaaaacgactcgaaccaaactgggctagtgtcaagaaagacctgatctcttatggcggcgggtggcgcctttccgcccagtggcaaaagggagaggaagtgcaggttattgcggtggagcccggtaagaatcctaaaaacttccagacaatgccaggcatctttcagactaccacgggggaaataggagccatcgcattagatttcaagcccggcacaagcggttcgcctattatcaatcgggaggggaaagtcgtgggactgtacggcaacggcgttgtgactaagaatgggggatatgtctcaggtattgctcaaaccaacgccgagccggacggcccaacacccgaactcgaggaagagatgtttaaaaagagaaatttgaccatcatggatctgcaccctgggtctggaaagactaggaaatacctcccagctatagtgcgtgaagcaattaagcgccggctgagaacccttatcctggcccccacaagggtagtggccgctgagatggaggaagcgttgaaaggcctacctatccgatatcagacgactgcaaccaagagtgcccatacaggtaaagagattgttgacctgatgtgccacgctaccttcactatgcggctcttatccccggtccgcgtgcccaactacaatctgatcataatggatgaagcccattttacagacccagcaagcattgccgctagagggtatatctctaccagggtgggaatgggcgaggcggccgcaattttcatgacggctactcctcccggcacagccgatgcatttccacagagcaacgcccctatccaggacgaagaacgggacatacccgagcgatcctggaactcagggaacgaatggattaccgatttcgctggaaagaccgtctggtttgtaccaagtatcaaggccggtaatgacatcgcgaactgtcttaggaagaatggcaagaaagtgattcaactgagccgcaagactttcgatacagagtaccagaaaaccaagctcaatgactgggattttgttgtgacaactgacatctctgaaatgggggcaaacttcaaggccgatagggtcattgacccgcgtcggtgcttgaaacctgtgatactgacggatggacccgagagagttatcctcgctggcccaatgcccgtgaccgtcgcctccgctgcacagaggcgcggtcgagtggggagaaatcctcagaaggagaacgaccaatacattttcacaggccagccactgaataacgatgaagaccacgcccattggactgaggctaaaatgcttctagacaatatcaacacccccgaaggaatcattcctgccctgtttgagccggaacgggagaagtcagcagcgatagatggcgagtataggttgaaaggggaaagtcgcaagacattcgtagagttaatgcgtagaggagacctgccagtgtggctcgcccacaaagttgctagcgaaggtatcaagtacaccgatcggaagtggtgctttgacggcgagaggaataaccagattctggaagagaatatggatgtcgagatctggactaaagaaggggagaagaagaaacttcgcccccgatggctggacgccagaacgtattccgatcctctcgcattgaaagagttcaaagactttgctgccggacggaagtctattgcactggatctagtgaccgagatcggcagggtgccctcgcacctggcccatcgcacaagaaacgctctcgacaatcttgtcatgctgcacactagcgaacatggtgggagggcgtaccggcacgccgttgaggagttaccagaaaccatggagacattgctgctcctgggccttatgatactgctcaccggaggcgcaatgttgttcctgatctcagggaaaggaattggtaagacttccatcggcttaatttgtgtggtagctagttctgggatgctatggatggccgatgtgcctctgcagtggatcgccagcgcaatagtcctcgaatttttcatgatggtgcttctgattcccgagccagagaaacaacgtacacctcaggacaaccagttggcttatgttgtgatcggcattctgacgctcgccgcgatcgtcgctgccaatgaaatgggcctgcttgagaccactaagcgcgatctcggtatgtccaaagaaccgggggtagtgtcacccacatcttacctggacgttgacttgcacccagcaagcgcctggaccctgtatgctgtggcaaccacagtcataactcctatgttacgacatacgatcgagaacagtaccgccaatgtgtccctagcggctattgccaaccaagcagtcgtgctgatgggcctcgataagggatggcccatcagcaagatggaccttggcgttccactgttggccctggggtgctactctcaggtgaaccctctcacactgactgctgccgtacttttactggtgacccactacgcaattatcggacccggcctccaggctaaagccacaagagaagcgcagaagaggaccgccgcaggtataatgaaaaatccgactgtcgatgggattatgacgatcgacttggatccagttatctatgactcaaagtttgagaaacaactgggacaggtgatgctactggtcctctgtgctgtgcagcttctgttgatgcggacatcctgggccttctgcgaggcactgaccctcgctactggccctattaccacactgtgggaaggtagtcccggcaagttttggaacactaccatcgccgtaagcatggccaatatattccgcgggtcgtacttagcgggagctggccttgcattttctattatgaagtccgtggggacaggaaaaagaggcacgggtagccagggggagaccctgggagaaaagtggaaaaagaaactcaaccaactatcaaggaaggagttcgatctgtataaaaagagtggcatcactgaagttgaccggacagaggccaaggagggtttgaaacgaggcgaaattacccatcacgctgtgtctagagggtccgccaagctgcagtggttcgtcgagcgcaatatggtgatcccagaaggaagggtcatagatctcggctgtgggcggggaggctggagctactattgcgcaggtcttaaaaaggtgactgaggttcgtgggtacacaaaaggaggccccggccatgaagaacctgtaccgatgtcaacctatgggtggaacatcgtgaagctgatgagtggaaaggacgtcttttacttgcccccagagaaatgtgatacgctgctctgcgacattggtgaaagctccccttctcccaccgtggaggaaagcagaacaatcagggttttaaagatggtggagccttggctgaaaaataaccagttctgtattaaggtccttaatccatacatgcccactgtgatcgagcacctggaacgcctacagcggaaacacggcgggatgctcgtacgaaaccctctgtccagaaattcaacccatgagatgtattggatttctaacggaacaggcaatatcgtgagttcggttaacatggtcagcaggttgctgctcaatcgctttactatgacccaccggagaccaacaatagaaaaggatgtggaccttggtgccgggacccgtcatgtgaacgctgagcccgaaactccgaacatggacgtcattggagagaggatccggcgcatcaaggaggaacactcctctacgtggcactacgatgaggaaaatccttataaaacatgggcgtaccatggctcatatgaggttaaggccaccggcagcgcatccagtatgattaacggggtggtaaaactgttaactaagccatgggacgtggtccccaccgtgacacaaatggctatgacggataccactcctttcggacagcagcgagtttttaaagaaaaggtggacacaagaaccccaaggcccatgccgggtactcggaaggccatggagataacagcagagtggctgtggcgcaccttgggcagaaataaaaggcctcgactctgcacacgggaagagttcactaagaaagtccgtaccaacgccgctatgggggccgtgtttacggaagagaatcaatgggattctgcgagagcagccgtagaagacgaggagttctggaagctggttgatcgcgaaagggagctacacaaacttggaaagtgtggcagctgcgtgtacaacatgatgggtaaacgggaaaagaagctgggggagtttggaaaagctaagggctcaagagccatctggtatatgtggctcggcgcacgctacctggagttcgaggctttggggtttctgaatgaggaccattggttctccagggaaaacagttttagcggagtcgagggtgaaggcctccacaaacttgggtacattctgcgagatatctctaagattcccggaggcgccatgtatgctgacgataccgccggttgggacacacggatcactgaggacgatttacataatgaggagaaaataacccagcagatggagccagaacacagacagctggcaaacgcgatcttcaagttgacataccaaaataaggtggtgaaagtccagaggcctactcccaaggggaccgttatggacattatctcccgcaaagatcagcgtggatcaggccaggtgggcacgtatgggctcaacacattcaccaatatggaggtacaactgattcggcagatggaaggagagggtgtgctaagcaaggccgaccttgagaacccacatctgctcgaaaaagagatcactcagtggctggaaacaaagggcgtcgagagattgaagaggatggctatatcgggggatgactgcgtggttaaacccattgatgaccgctttgccgatgcattactggctctcaatgacatgggaaaggtgcgaaaagatatccctcagtggcaaccatctaagggctggcatgactggcagcaggtcccgttctgtagtcaccattttcacgaacttatcatgaaagatggtcggaagctggtggtaccctgcagacctcaggacgagctaattgggagggcccgcatatcccaaggagcaggctggagcctgaaggagaccgcctgtctcggcaaagcgtacgctcagatgtgggccttgatgtatttccacagacgggacctgaggcttgcatcaaacgccatctgctccgctgttccagtgcattgggtccccacttctcgtaccacatggagcattcacgcccatcaccagtggatgacgaccgaagatatgctgactgtgtggaaccgagtttggatcgaggacaatccttggatggaagataagacaccagtgaccacttgggaggacgtcccctacctcgggaaacgcgaggatcaatggtgtggaagtttaattggtctggcatccagagctacatgggcccagaacatcttgaccgcgatacaacaggtgcggagcctgatcggcaatgaagagtttctcgactatatgccttctatgaagaggttccgcaaagaagaggaatcagagggggctatttggtga

SEQ ID NO: 15623 - RNA, 9873 nt, synthetic construct
  misc_feature 1..9873: note = derived and/or modified CDS sequence (opt3) from DENV-3__KC762691__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagagcacaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaagataaggcgtggatggtacatagacagtggttctttgacctgccgcttccctggaccagcggggccacaaccgaaactcctacatggaacaaaaaggagctgttggttacgttcaaaaatgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggataaactagagctcaagggcatgagctatactatgtgctctaacgccttcgtcctgaaaaaggaggtgtccgaaacccagcacgggacgatacttatcaaggttgagtacaaaggagaagacgctccatgtaagattcccttctcaaccgaggatggccaaggtaaagcgcataatgggcggttgatcacagcaaaccctgtggtaactaagaaagaggaaccagtcaacatagaggccgaacccccgtttggcgagagcaatattatcatcggaattggcgacaaggctctgaagatcaactggtacaaaaaggggagttctattggaaaaatgttcgaagccaccgcacgtggtgcccgcagaatggctatactcggcgatacagcctgggactttgggtccgtgggaggcgttctgaatagccttggtaagatggtgcaccagatcttcgggtcggcatatactgcgctgttttctggcgtctcctggattatgaaaatcggaatcggcgtgttgctcacctggattgggctgaactcaaagaatacgagtatgagcttctcctgcatagtaatcggaattatcacattatacctgggcgctgtggttcaggccgatatgggttgtgtcattaactggaaggggaaagagctaaagtgcggatctggcatctttgtgaccaatgaggtgcatacttggacagaacagtataaattccaagcagacagccctaggcggctcgccaccgctatagccggtgcatgggagaacggcgtctgtgggatccgatcaactacccgcatggaaaatctgctttggaagcagattgctaacgagttgaattacatcctgtgggaaaacaatattaaactcacagttgtggtgggagatacgatcggcgtactggagcaggggaagagaaccttaactccccagccaatggagctgaaatatagttggaagacatggggaaaggccaaaatagtcaccgcggaaacacaaaactccagctttattatcgacggccctaatactcccgagtgcccaaacgcctctagggcttggaacgtgtgggaagttgaggactacggtttcggggtgtttaccacgaatatttggcttaagttgcgggaaatgtatacacagctctgtgatcaccgcctgatgtcagcagccgtcaaagacgagagagctgtgcacgccgatatgggatactggatcgagagtcagaagaacggcagctggaaactagaaaaggcatccctgatagaggttaagacctgcacttggcccaaatctcataccctctggtcgaatggtgtgctggaaagcgacatgatcattcctaagtcccttgcgggcccaatctcacagcacaactacaggccggggtatcatacacaaactgccggaccctggcacttgggcaaactggagttagatttcaattactgcgaggggaccacagtagtcattacggaaaactgtggagctcgtggccctagtctccggaccactacagtgtctggtaagctgatccacgagtggtgctgtcgaagctgcacccttccacccctgagatatatgggggaagacggatgttggtacggcatggagataaggcctattaatgaaaaagaggagaacatggtgaagtccttggtctcagccggtagcggcaaggttgataattttactatgggggtgctctgcctggcaatcctattcgaagaggtaatgcgcggaaaattcggcaagaaacatatgatcgctggggtgctgtttacattcgtcctcctgctttctggacagattacctggcgggacatggccagaacgttgatcatgattggctccaacgcaagtgataggatgggtatgggggtgacttatctggccttaatagctacctttaagatccagccattcctcgcgctgggatttttccttcgcaaactgacaagccgagaaaatctactcctgggcgttggcttggccatggcaaccactctgcaattacccgaggacattgaacagatggctaacgggatcgccctcggactgatggcccttaagctgattacacagtttgagacctaccagttgtggacagctctcgtgtctctgatgtgttccaatactatcttcaccctaacggtcgcatggcggacagccaccctgatacttgcgggtatctcactctttccggtgtgccaaagtagctcgatgcgtaagactgattggctgcctatgaccgttgctgccatgggcgtgccacccttgcctctgttcattttttccttaaaagacacactcaagagaaggtcttggcccctgaacgagggggtcatggcagtaggacttgtgagcatcctggcctcaagtttgctccgcaatgatgttccaatggctggccctctggtggcaggtgggctactgattgcctgttatgtcatcactggaacctccgcggaccttacggtggaaaaagctgccgacgtaacatgggaggaagaggcagaacagaccggcgtgtctcacaacctcatgataactgtcgatgacgatggcacaatgcggattaaggacgatgagaccgagaacatcctgactgttttgttaaaaacagccctgctcatcgtgagcgggattttcccctactccataccagctaccctgcttgtgtggcatacgtggcagaagcagactcaaagatcaggagtcctgtgggacgtgccgagccctcccgaaacccagaaagccgagttggaagagggtgtttacaggatcaagcagcagggcatttttgggaagacacaagtaggagtgggcgtccagaaagagggtgtgttccacaccatgtggcatgttacacgaggggcagtgctaacttataatggaaagcgcctggaaccaaactgggctagtgtcaaaaaggatctcatctcttacggcggcgggtggcggctgtccgcccagtggcaaaaaggagaggaagtgcaggtaattgcggtcgagcccggtaagaatcctaagaacttccagaccatgccaggcatctttcagacgacaactggggaaataggagccatcgcacttgacttcaaacccggcaccagcggttcgcctattatcaatagagaggggaaggtggttggattatatggcaacggcgtggtcacaaaaaatgggggatacgtgtcaggtattgctcaaaccaacgccgagccggatggcccaactcccgaactggaggaagagatgtttaagaaaaggaatctcaccatcatggacttgcaccctgggtctggaaagacacgtaagtatctgccagctatagttcgcgaagcaattaaacggagactcaggacgctgatccttgcccccactcgagtggtcgccgctgagatggaggaagcgctgaagggcttgcctatccggtaccagaccacagcaaccaaaagtgagcacactggtaaggaaattgtggatctaatgtgccatgccacattcaccatgcgcctgctctccccggtaagagtgcccaactataatttaatcataatggacgaggctcactttacggatccagccagcattgcagccagggggtacatctctactcgggttggaatgggcgaagctgcggccattttcatgacagcaacccctcccggcaccgctgacgcctttccacagagcaacgcacctatccaggacgaggagcgagatatacccgaaagatcctggaattcagggaacgactggattactgatttcgccggaaaaacagtctggtttgtgccaagtatcaaggctggtaatgacatcgccaactgtctgcgcaagaacggcaaaaaggtgattcaacttagcaggaaaaccttcgatacagagtaccagaagactaaactgaatgactgggattttgtcgtaacgaccgacatctctgaaatgggggcgaacttcaaggcagatcgtgtgattgacccgcggagatgcctcaagcctgttatattgacagatggacccgagagggtgatcctggccggcccaatgcccgtcactgtggcttccgccgctcagcgccgaggtagaattgggcggaatcctcagaaagagaacgaccaatatatcttcaccggccagccactcaataacgacgaagatcatgcacactggacagaggccaagatgctgcttgacaatatcaacacccccgaaggaattatacctgctctatttgagccggaaagggagaaatcagccgcaatcgatggcgagtaccgcctgaagggggaaagtcgtaaaactttcgttgagttgatgagacggggagacttaccagtgtggctggcgcataaggtcgccagcgaaggtattaaatatacggataggaagtggtgctttgacggcgagcgcaataaccagatcctcgaagagaatatggatgtggagatttggaccaaggaaggggagaaaaagaaactgcgacccagatggcttgacgctcggacatactccgatcctctggccctcaaggaattcaaagactttgcagctggaaggaagtctatcgccttggatctggtaactgagataggccgcgtgccctcgcacctagcacacagaaccaggaacgccctggacaatctcgttatgcttcatacaagcgaacacggtgggcgggcttatcgtcatgcggtcgaggagctgccagaaaccatggagactttattgctgctcggcctgatgatccttctgacaggaggcgccatgctcttcttgatttcagggaagggagtgggtaaaacgtccatcggcctgatttgtgtggtcgcaagttctgggatgttatggatggctgatatccctctacagtggatagccagcgccattgttctggaatttttcatgatggtgctccttatccccgagccagagaagcaacgcacccctcaggacaaccagctggcatacgtagtgattggaatcttgactctggctgccatagtcgcggctaatgaaatgggcctcctggagacaaccaaacgagaccttggtatgtccaaggaaccgggggtggtttcacccacctcttatctcgatgtggacctgcacccagccagcgcatggacattgtacgccgtcgctactacggtaatcacccctatgctgagacacacaattgagaacagtactgcaaatgtgtccttagccgcgatcgctaaccaagccgttgtgctaatgggcctggataaaggatggcccattagcaagatggacctcggcgtcccacttctggcattggggtgctactctcaggtgaaccctctgaccctcacagccgctgtcctgcttttagtgacccattatgccatcataggacccggcctgcaggcaaaggctactagggaagcccagaaacggacggcggccggtattatgaagaatccgacagttgatgggatcatgaccatcgacctcgatccagtgatttacgactcaaaatttgagaagcaattgggacaggtaatgctgctagtgctgtgtgcagtccagctccttctgatgcgcacttcctgggctttctgcgaggccttgaccctggcaacaggccctatcactaccctctgggaaggtagtcccggcaaattttggaacacaacgatagctgttagcatggccaatattttcagagggtcgtatctggccggagcgggcttagctttttctatcatgaagtccgtggggaccggaaagaggggcactggtagccagggggagacacttggagaaaaatggaagaaaaagctgaaccaactctcacggaaagagttcgatctatacaagaaaagtggcattaccgaagtcgaccgaactgaggcaaaggagggtctgaagagaggcgaaatcacacaccatgccgtgtctcgcgggtccgctaaattgcagtggttcgtagagaggaatatggtgataccagaaggacgggttatcgatctgggctgtgggcgtggaggctggagctattactgcgccggtctcaagaaagtgaccgaggtcagagggtatacgaagggaggccccggccacgaagagcctgtgccgatgtcaacctacgggtggaacattgtcaaacttatgagtggaaaggacgtgttttacctgcccccagagaagtgtgatacattgctgtgcgacatcggtgaaagctccccttctcccactgttgaggaaagcaggaccattcgcgtactcaaaatggtggagccttggttaaagaataaccagttctgtatcaaagtcctgaatccatatatgcccacagtgattgagcatcttgaacggctgcagcgaaagcacggcgggatgctagttagaaaccctctctccaggaattcaactcacgagatgtactggatctctaacggaaccggcaatatagtgagttcggtcaacatggtgagccgcctgttgctgaatcggtttacaatgacctatagacgtccaactattgaaaaagacgtagatctcggtgcagggacgaggcatgtgaacgccgagcccgaaacaccgaacatggacgttatcggagagcggatccgccgaattaaggaggaacactcctctacctggcattacgatgacgagaatccttataagacttgggcttaccacggctcatatgaagtcaaagcgaccggcagcgcctccagtatgataaacggggtggtgaagcttctgacaaaaccatgggatgtcgttcccacggtgacccaaatggcaatgactgacacaacccctttcggacagcagagagtatttaaggagaaagtggatactaggacaccaaagcccatgccgggtacccggaaggtcatggaaatcacagctgagtggttatggcgcactctgggcagaaataaaaggcctcgattgtgcacccgggaggaattcacgaagaaagtgcgtaccaacgccgcaatgggggccgtttttacagaggaaaatcaatgggactctgctagagccgcggtggaggatgaagagttctggaagctcgtcgaccgcgagagggaactgcacaaactaggaaagtgtggcagctgcgtgtacaacatgatgggtaaacgggagaagaagcttggggaatttggaaaagcaaagggctcaagagccatttggtacatgtggctgggcgctcgctatctcgagttcgaggccctggggtttttgaatgaagatcattggttctccagggagaacagttacagcggagtagaaggtgagggcctgcacaaactcgggtatatccttcgagacatttctaagatccccggaggcgcaatgtacgctgacgatactgccggttgggacacccggataacagaagatgacctgcataatgaggagaaaatcactcagcagatggatccagaacacagacagttagctaacgccatttttaagctgacctatcaaaataaggttgtgaaagtccagaggcctacgcccaaggggacagtgatggacatcatttcccgcaaagatcagcgtggatcaggccaggtgggcacctacgggttgaacactttcacaaatatggaggcacaactcatccggcagatggaaggagagggtgtcctgagcaagaccgacctagaaaacccacatcttctggagaaaaagataactcagtggctcgagaccaagggcgttgaaagactgaaaaggatggcgatttcgggggatgactgcgtggtaaagcccatcgatgaccgcttcgccaatgctttgttagccctgaacgatatgggaaaagtgcgaaaggacatccctcagtggcaaccatctaaaggctggcacgactggcagcaggtcccgttttgtagtcaccatttccacgagctcattatgaaggatggtcggaagcttgtggttccctgcagacctcaggacgaactgatagggagggcacgcatctcccaaggagctggctggagcctaaaagagacagcctgtctgggcaaggcatatgcccagatgtgggcgctcatgtactttcatagacgggatttgaggctggcttcaaacgccatttgctccgcagtgccagtccactgggtgcccacgtctcgtaccacttggagcatccacgcccatcaccagtggatgacaaccgaagacatgcttactgtatggaatcgagtttggattgaggataacccttggatggaggacaaaacaccagtgaccacgtgggaagatgtcccctacctggggaagcgcgaggaccaatggtgtggaagtctcatcggtttaacatccagagctacctgggcccagaatatactgactgcaatccagcaggtgcggagcttgattggcaacgaagagttcctggattatatgccttctatgaaaaggtttcgcaaggaggaagagtcagaaggggctatctggtga

SEQ ID NO: 15624 - RNA, 9873 nt, synthetic construct
  misc_feature 1..9873: note = derived and/or modified CDS sequence (opt3) from DENV-3__KC762692__SS-prME
  source 1..9873: mol_type = other RNA
accagcctgtgcctcatgatgatgcttcccgccacactggctttccacttgacttccagagacggagagcctagaatgatcgtggggaagaacgaacggggaaaatctttactgtttaagacggcctcaggtattaatatgtgtaccctgatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagagcacaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtaaagcacataacgggcggttgatcaccgccaaccctgtggtaacaaagaaagaggaaccagtcaatatagaggctgaacccccgtttggcgagagcaacattatcatcggaattggcgataaggccctgaagatcaattggtacaaaaaggggagttctattggaaaaatgttcgaagcaactgcccgtggtgctcgcagaatggccatactcggcgacaccgcatgggattttgggtccgtgggaggcgttctgaacagccttggtaagatggtgcaccagatcttcgggtcggcgtatacagctctgttttctggcgtctcctggattatgaaaatcggaatcggcgtgttgctcacttggattgggctaaattcaaagaacaccagtatgagcttctcctgcatagtaatcggaattatcacgttatacctgggcgccgtggttcaggcagacatgggttgtgtcattaattggaaggggaaagagctaaagtgcggatctggcatctttgtgacaaacgaggtgcatacctggactgaacagtataaattccaagccgatagccctaagaggctcgctacagccatagtcggtgcatgggagaatggcgtttgtgggatccggtcaaccactcgaatggaaaacctgctttggaaacagattgctaatgagttgaactacatcctgtgggaaaataacattaagctcaccgtggtggtaggagacatcataggcgtcctggagcaggggaaacgcacattaacgccccagccaatggagctgaagtatagttggaagacctggggaaaagccaagattgtgactgcggaaatccaaaattccagctttattatcgatggccctaacacacccgagtgcccaaacgcctctagagcttggaatgtttgggaagtggaggactacggtttcggggtctttaccacaaacatatggcttaaattgagggaaatgtatactcagctctgtgaccaccggctgatgtcagcagccgtgaaggatgagcgcgctgttcacgccgacatgggatactggatcgagagtcagaaaaatggcagctggaagctagaaaaggcatccctgattgaggtgaaaacctgcacgtggcccaagtctcatacactctggtcgaacggtgtactggaaagcgatatgatcattcctaaatcccttgcgggcccaatctcacagcacaattacagaccggggtatcatacccaaactgccggaccctggcacttgggcaagctggagttagacttcaactactgcgaggggaccacagtcgtgataactgaaaattgtggaaccaggggccctagtctccgtacaacgaccgtgtctggtaaactgattcacgagtggtgctgtcggagctgcactcttccacccctgcgatatatgggggaagatggatgttggtacggcatggagatcagacctatcaacgaaaaggaggagaatatggtcaagtccttggtttcagctggtagcggcaaagtggacaactttacaatgggggtactctgcctggccattctattcgaagaggtgatgaggggaaagttcggcaaaaagcatatgatcgcaggggtcctgtttatgttcgtgctcctgctttctggacagattacctggcgcgatatggctcggactttgataatgatcggctccaatgccagtgacagaatgggtatgggggttacatatctggcattaattgccacctttaaaatccagccattcctcgctctgggatttttccttaggaagctgacgagccgcgaaaacctactcctgggcgtgggcttggcgatggccactaccctgcaattacccgaggatattgaacagatggcaaatgggatcgctctcggactgatggtccttaagctgataacacagtttgagacctaccagttgtggactgccctcgtgtctctgacatgttccaacaccatcttcacactaactgttgcctggcgaaccgctacgctgattcttgcaggtacatcactcctgccggtgtgccaaagtagctcgatgcggaaaaccgactggttgcctatgactgtcgccgcgatgggcgtaccacccctgcctttatttatcttctccctcaaggataccctgaaacgtagatcttggccccttaatgagggggtgatggctgttggactggtgagcattttggcctcaagtctcctgaggaacgacgtcccaatggcaggccctctagtggccggtgggctgcttatcgcttgttatgtaataacaggaacttccgcagatctcaccgtggaaaaggccgcggacgtcacgtgggaggaagaggctgaacagacaggcgtttctcacaacctgatgattaccgtggacgatgacggcactatgcgcatcaaagatgacgagacagagaatatcttgaccgtgttactgaagactgccctcctgattgtcagcgggatatttccctactccatcccagcaacacttctggtgtggcatacctggcagaaacagacgcaacggtcaggagttttgtgggatgtaccgagccctcccgaaactcagaaggccgagctagaagagggtgtgtacagaattaagcagcagggcatcttcgggaaaacccaagtcggagtgggcgttcagaaggagggtgtgtttcacacaatgtggcatgtcaccagaggggctgtgctgacatataacggaaaacgactcgaaccaaattgggccagtgtaaagaaagacctgatttcttacggcggcgggtggcgcctttccgcacagtggcaaaagggagaggaagtccaggtgatcgctgttgagcccggtaagaaccctaaaaatttccagactatgccaggcatattccagaccatcacgggggaaattggagccatcgcgttagattttaagcccggcacaagcggttcgcctattatcaaccgggaggggaaagtggtcggactgtatggcaatggcgtggttactaagaacgggggatacgtgtcaggtatagcccaaaccaatgcagagccggacggcccaacacccgaactcgaggaagagatgttcaaaaagagaaacttgaccattatggatctgcaccctgggtctggaaagactaggaaatatctcccaaccatcgtccgtgaagctatcaagcgccggctgagaacacttattctggcccccacgagggtggtagctgcagagatggaggaagccttgaaaggcctacctatccgataccagactaccgccacaaagagtgagcacaccggtaaagaaatagtggacctgatgtgccatgctacttttacaatgcggctcttatccccggttcgcgtccccaattataacctgattatcatggatgaggcgcacttcaccgacccagcaagcattgccgctagagggtacatctctacgagggtgggaatgggcgaagccgcagccatatttatgactgctacacctcccggcaccgcggatgccttcccacagagcaatgcacctattcaggacgaggagcgggacatccccgaacgatcctggaactcagggaatgattggatcaccgactttgctggaaagactgtgtggttcgtcccaagtattaaggccggtaacgatatcgcaaactgtcttaggaagaatggcaagaaagtaattcaactgagccgcaagacatttgacaccgagtaccagaaaacaaagctcaacgattgggacttcgtggttactacggatatatctgaaatgggggccaattttaaggctgacagggtgatcgatccgcgtcggtgcttgaaacctgtcattctgaccgacggacccgagagagtgatcctcgccggcccaatgcccgttacagtggcgtccgcagcccagaggcgcggtcgagtcgggagaaaccctcagaaggagaatgatcaatatatcttcactggccagccactgaacaatgacgaagaccatgctcactggaccgaggccaaaatgcttctagataacattaatacacccgaaggaataatccctgctctgttcgagccggaacgggagaagtcagcagccattgacggcgagtacaggttgaaaggggaaagtcgcaagacctttgtggagttaatgcgtagaggagatctgccagtatggctcgctcataaagtggccagcgaaggtatcaagtatactgaccggaagtggtgcttcgatggcgagaggaacaatcagattctggaagagaacatggacgttgagatctggacgaaagaaggggagaagaagaaacttcgcccccgatggctggatgcaagaacctactccgaccctctcgcgttgaaagaatttaaagatttcgccgctggacggaagtctatagccctggacctagtcacagagatcggcagggtgccctcgcacctggcacaccgcactagaaatgctctcgataaccttgtgatgctgcataccagcgaacacggtgggagggcctatcggcatgcagtcgaggagttaccagaaacaatggagaccttgctgctcctgggccttatgattctgctcactggaggcgccatgttgtttctgatctcagggaaaggagttggtaagacatccattggcttaatctgtgtggtagctagttctgggatgctatggatggcggacatacctctgcagtggattgccagcgcaatcgtgctcgagttctttatgatggtccttctgattcccgagccagagaaacaacgtacgcctcaggataatcagttggcttacgtggttatcggaatactgaccctcgccgccatcgtggcagctaacgaaatgggcctgcttgagactacaaagcgcgacctcggtatgtccaaagaaccgggggtcgtatcacccacctcttatctggacgtggatttgcacccagccagcgcgtggaccctgtacgctgttgccacaactgtgattacgcctatgttacgacacaccatcgagaatagtacagcaaacgtctccctagccgctattgcaaaccaagccgtggtcctgatgggcctcgacaagggatggcccatcagcaagatggatcttggcgtgccactgttggcgctggggtgctactctcaggttaatcctctcactctgaccgctgccgtgcttttactggtaacacattatgcaataattggacccggcctccaggccaaagctaccagagaagcccagaagaggactgcagctggtatcatgaaaaacccgacggtggacgggatcatgacaattgatttggacccagtcatctacgattcaaagttcgagaaacaactgggacaggttatgctactggtgctctgtgccgtccagcttctgttgatgcggacctcctgggcgttttgcgaggccctgactctcgcaaccggccctataacaactctgtgggaaggtagtcccggcaagttctggaataccacaattgctgtgagcatggccaacatctttcgcgggtcgtatttagcaggagctggccttgccttctctattatgaagtccgtagggacgggaaaaagaggcaccggtagccagggggagactctgggagaaaagtggaaaaagaaactcaatcaactatcaaggaaggagtttgacctgtacaaaaagagtggcatcacagaagtggatcggaccgaggccaaggagggtttgaaacgaggcgaaataactcaccatgcggtttctagagggtccgctaagctgcagtggttcgtggagcgcaacatggtcatcccagaaggaagggtgattgacctcggctgtgggcggggaggctggagctattactgcgcaggtcttaaaaaggtcacagaggtgcgtgggtataccaaaggaggccccggccacgaagaacctgttccgatgtcaacgtacgggtggaatatcgtaaagctgatgagtggaaaggatgtgttctacttgcccccagagaaatgtgacaccctgctctgcgatattggtgaaagctccccttctcccacagtcgaggaaagcagaactatcagggtgttaaagatggttgagccttggctgaaaaacaatcagttttgtattaaggtgcttaacccatatatgcccaccgtcatcgagcatctggaacgcctacagcggaaacacggcgggatgctcgtgcgaaatcctctgtccagaaactcaacacacgagatgtactggatatctaatggaactggcaacattgtaagttcggtgaatatggttagcaggttgctgctcaaccgcttcaccatgacatatcggagaccaaccatcgaaaaggacgtcgaccttggtgccgggactcgtcatgtgaacgctgagcccgaaacgccgaatatggatgtgatcggagagaggattcggcgcataaaggaggaacactcctctacatggcattacgacgatgagaacccttataaaacctgggcctaccacggctcatatgaagtcaaggcaactggcagcgcctccagtatgatcaatggggttgtgaaactgttaaccaagccatgggacgtagtgcccacagtcacgcaaatggctatgaccgatactacaccttttggacagcagcgagtgttcaaagagaaggttgacaccagaactccaaagcccatgccgggtacaaggaaaattatggaaatcaccgcgggctggctgtggcggacattggggcgcaacaagagacctaggctctgcactcgagaggagtttaccaaaaaggtgcggacgaatgccgcaatgggagctgtcttcaccgaagagaaccaatgggattctgcccgtgcagccgtggaagacgaggaattttggaaactggtagatagagagcgcgagctacacaagcagggcaaatgtggtagctgcgtttacaatatgatggggaagagggaaaagaaacttggagagttcggcaaggctaaaggctcacgggccatttggtacatgtggctgggggcgagatatctcgaatttgaggcactgggattcttgaacgaggaccattggttttcccgcgaaaatagttacagcggtgtggagggcgaagggctgcacaagctcggatatatccttagggatatatctaaaatccccggcggtgccatgtacgctgacgacacagccgggtgggatactcgaattaccgaggacgatctgcataacgaagagaagatcacacagcagatggacccagagcaccggcaattagcaaatgctattttcaagctgacttatcagaacaaagtcgtgaaggtgcagagacctacccccaaaggaacggtcatggatatcatatccaggaaggaccagcgcggctcaggccaagttgggacatacggattgaatacctttactaacatggaagcccagctcattcgtcagatggagggtgaaggcgtgctgagcaaaacagatctagagaatccacatcttctggaaaagaagatcacccagtggctcgagactaaaggggtagagcggctgaagagaatggctatctcgggagacgattgcgtggtcaaacccattgacgataggttcgccaacgcattgttagcgctgaacgacatgggcaaggtgcgcaaagatatacctcaatggcagccatctaagggttggcacgactggcagcaggttccgttctgtagtcaccattttcacgaactcatcatgaaggacgggcgaaatcttgtggtcccctgccggcctcaagatgagctgattggcagagccaggatctcccagggcgctggctggagcctaaaagaaaccgcctgtctggggaaggcatatgctcagatgtgggccctcatgtacttccatcgcagagacttgcggctggcatcaaacgccatttgctccgcggtgccagtacactgggttcccacatctaggacgacctggagcatccacgctcatcaccaatggatgactacagagaatatgcttaccgtgtggaaccgtgtctggatagaagataatccttggatggaggacaaaactccagtgacaacctgggaggatgttccctacctgggaaagcgagaagaccagtggtgtggtagtctcatcggcttaacgtcccgcgccacatgggcacagaacattctgaccgccatccagcaagtgaggagcttgattgggaatgaggaatttctggattatatgccttctatgaaacggttcaggaaggaggaggaatcagagggagctatctggtga

SEQ ID NO: 15625 - RNA, 9873 nt, synthetic construct
  misc_feature 1..9873: note = derived and/or modified CDS sequence (opt3) from DENV-3__JQ920481__SS-prME
  source 1..9873: mol_type = other RNA
accagcctgtgcctcatgatgatgcttcccgccacactggctttccacttgacttcccgagacggagaacctaggatgatcgtggggaaaaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgttgctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctcctgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacagtcgttgtgggagacgtgatcggcgtactggagcaggggaaacgcacgttaacaccccagccaatggagctgaagtatagttggaagacttggggaaaagcgaagatagtcacagccgaaacccaaaattccagctttattatcgatggccctaacacacccgagtgcccatctgcttcaagagcatggaacgtgtgggaagttgaggactacggtttcggggtgtttactaccaatatttggcttaaattgagggaaatgtatacgcagctctgtgaccaccggctgatgagtgccgctgtcaaggatgagcgcgccgtgcacgcagacatgggatactggatcgagagccagaaaaacggctcctggaagctagaaaaggcgtctctgatagaggttaaaacatgcacctggcccaagtcgcatactctctggagcaatggtgtgctggaatccgatatgatcattcctaaatcacttgccggcccaatcagtcagcacaactacagaccggggtatcatacccaaacagctggaccctggcacttgggcaagctggagttagacttcaattactgcgaggggactaccgtagtcattacagaaaactgtggaacgaggggcccttctctccgtaccactacagtgagcggtaaactgatccacgagtggtgctgtcggtcctgcacccttccacccctgcgatatatgggggaagatggatgttggtacggcatggagataagacctattaatgaaaaggaggagaacatggtgaagtcattggtcagcgccggttctggcaaagcagacaattttactatgggggttctctgcctggctatcctattcgaagaggtgatgaggggaaagttcggcaaaaagcatatgatcgccggggcactgtttacattcgtactcctgctttccggacagattacctggcgcgatatggcccacacgttgatcatgattggcagtaacgctagcgaccggatgggtatgggggtgacttatctggcgttaatagccacctttaaaatccagccattcctcgcactgggatttttccttagaaagctgacatctagggaaaatctactcctgggcgtcggcttggctatggccaccactctgcaattacccgaggatattgaacagatggccaacgggatcgctctcggactgatggcacttaagctgattacacagtttgagacctaccagttgtggacagccctcgtgtccctgatgtgttcaaatactatcttcaccctaacggttgcgtggcgcacagctaccctgatacttgccgtgatcagtctcctgccggtctgccaaagctcgtccatgcgaaaaactgactggttgcctatgaccgtggcagccatgggtgttccacccctgcctttatttattttctctctcaaggatacactgaaacggcgtagctggccccttaacgagggcgtgatggctgtcgggctggtatcaatcttggcaagttcctttctcagaaatgacgtgccaatggccggacctctggttgcgggcggtctactgattgcttgttatgtgatcactgggacctctgccgatcttacggtcgaaaaggcagccgacgtgacatgggaggaagaggctgaacagaccggagtaagccataacctcatgataactgtggacgatgacggcacaatgaggattaaagatgacgagaccgagaacatcctgactgtcttgttaaagacagccctgctcatcgtttccggcattttcccctactcaataccagcaaccctgcttgtgtggcacacgtggcagaaacagactcaacgcagcggggtgctgtgggatgtcccgagtcctcccgaaacccagaaggctgagttggaagagggagtgtaccggatcaagcagcagggtatttttggcaaaacacaagttggggtaggagtgcagaaggagggcgtcttccataccatgtggcacgtgacaagaggtgccgttctaactcacaatgggaaaaggctggaaccaaactgggcgaatgtgaagaaagacctcatctcttatggaggcggctggaagctgtccgcccagtggcaaaagggggaggaagtccaggtgattgcagtagagcccggcaagaaccctaagaatttccagaccatgccaggtatctttcagacgacaactggcgaaataggggctatcgcccttgatttcaaacccggaaccagcggctcgcctattatcaaccgagagggtaaggtcgtggggttatacggaaatggcgttgtgaccaagaacggcgggtatgtctcaggaattgctcaaaccaatgcagagccggacggtccaactcccgaactggaggaagagatgtttaagaagcgcaacctcaccatcatggatttgcatcctggctctgggaaaacacggaagtacctgccagccatagtgagagaagccattaaaaggcgtctccgcacgctgatccttgctcccactcgggttgtggcggcagagatggaggaagccctgaagggattgcctatcagatatcagaccacagctaccaaaagtgagcacactggcagggaaattgtcgacctaatgtgccatgccacattcaccatgcgactgctctccccggtgcgggtacccaattacaacttaatcgtgatggatgaggcacactttacggacccagccagcatagctgcgcgcggttatatttctactagagttgggatgggagaagccgcagctatcttcatgacagccacccctcccggcaccgcagatgcctttccacagagcaatgctcctattcaggacgaggagagggacatccccgaacggtcctggaactcaggcaatgagtggataactgatttcgccgggaagacagtctggtttgtgccaagtattaaggcgggaaacgacatcgcaaactgtctgagaaagaatggtaagaaagtgatccaacttagcagaaagaccttcgatacagaataccagaaaactaagctgaacgactgggattttgtcgtaacgaccgacatttctgagatgggcgccaatttcaaggctgatcgcgtgatcgacccgaggcgttgcctcaaacctgttattttgacagatgggcccgagcgggtgatactggccggaccaatgcccgtcactgtggcttccgcagcccagagaaggggccgcgttggtcgaaaccctcagaaggaaaatgaccaatacatcttcaccgggcagccactcaacaatgatgaggaccatgctcactggacagaagccaaaatgctgcttgacaacattaatacccccgagggcatcatccctgcactatttgaaccggagagagagaagtcagcggccattgatggagaatatcggctgaaaggcgagagtaggaagactttcgtggaattgatgcgccgtggggacttaccagtctggctggctcacaaagtggccagcgagggaataaagtacacggatagaaagtggtgctttgacggtgaacggaacaatcagatcctcgaggagaacatggatgtagaaatttggaccaaagagggcgaaaagaaaaagctgaggccccgctggcttgacgcacgaacatattccgatcctctggctctcaaagagttcaaggactttgccgcagggagaaagtctatcgccttggatctggtgactgaaattggacgggttccctcgcatctagctcacaggacccgcaatgcgctggacaacctcgtcatgcttcatacaagcgagcacggcggtagagcctacaggcacgcagtggaggaactgccagagaccatggaaactttattgctgctcgggctgatgatccttctgacaggcggagctatgctattcttgatatcaggcaaagggatcggaaagacgtccattggtctgatctgtgtggtcgccagttctggcatgttatggatggccgatgttcctctacagtggattgcaagcgctatcgtgctggagtttttcatgatggtactccttatacccgagccagaaaaacaacggacccctcaggacaatcagctggcctatgtggtcattgggatcttgactctggcggctattgtggccgcaaacgagatgggactcctggaaacaaccaagcgtgatcttggcatgtccaaagagccgggtgttgtgtcacccacctcttacctcgacgtcgacctgcatccagccagcgcttggacattgtatgcagtagccactacggtgatcacccctatgctgcgccacacaatagaaaatagtactgcgaacgtttccttagctgccatcgcaaaccaagccgtggtcctaatggggctggataagggctggcccattagcaagatggacctcggagtgccacttctggctttgggctgctactctcaggtcaatcctctgaccctcacagccgcagtgctgcttttagttacccattacgctatcattgggcccggactgcaggccaaagcgactcgagaggcccagaagagaacggcagctggcatcatgaaaaacccgacagtggatggtataatgaccattgacctcgatccagtaatctatgactcaaagtttgagaaacaattgggacaggtgatgctgctagtcctgtgtgccgttcagctccttctgatgaggacttcctgggcattctgcgaagctctaaccctggccacaggacctatcactaccctctgggagggcagtcccggtaagttttggaatacaacgattgccgtgagcatggcgaacatcttccggggctcgtacctggctggggcaggattagccttttctataatgaagtccgtcggcaccgggaaacgcggaactggcagccagggtgaaacacttggggagaagtggaaaaagaaactgaatcaactctcaagaaaggagttcgatctatataaaaagagtggaattaccgaggtggacaggactgaggctaaggaaggcctgaaacggggtgagatcacacaccatgccgtatctcgaggctccgcaaagttgcagtggttcgtggaaagaaacatggttattccagaggggcgcgtgatcgatctgggatgtggcagaggcgggtggagctactattgcgccgggctcaaaaaggtcaccgaagtgcggggttacacgaaagggggacccggccacgaggagcctgtcccgatgtcaacctatggctggaatatagtgaaacttatgagtgggaaggacgtattttacctgcccccagaaaaatgtgatacattgctgtgcgacatcggagagagctccccttctcccactgtagaagagagccgtaccattagagtgctcaagatggtcgagccttggttgaaaaacaatcagttctgtatcaaggtgctgaacccatacatgcccacagttattgaacaccttgagaggctgcagcgcaaacatggtggcatgctagtgcggaatcctctctcccgaaactcaactcacgaaatgtattggatctctaatgggaccggaaacattgtcagttcggtgaatatggtaagcagactgttgctgaacaggtttacaatgacccatcgccggccaactatcgagaaggatgtggacctcggcgctggtacgagacacgttaacgcggaacccgagacaccgaatatggacgtcataggggagcgtattaggcggatcaaggaagaacactcctctacctggcattacgatgacgaaaacccttataaaacttgggcctaccacggatcatatgaggtgaaggcaaccggcagcgcttccagtatgatcaatggcgtggtcaaacttctgacaaagccatgggatgttgtgcccatggtaacgcaaatggccatgaccgacactacacctttcgggcagcagcgcgtgtttaaagaaaaggtcgatacccgaactccaagacccatgccgggaacaaggaaggtgatggagattaccgcagagtggttatggcggacactgggtcgcaacaaaagacctaggttgtgcactcgagaagagttcataaagaaagttcggaccaatgccgctatgggcgccgtgtttacggaagagaaccaatgggactctgcgcgtgcagccgtcgaagatgaggagttctggaagctcgtggacagagaacgcgagctgcataaactagggaagtgtggaagctgcgtatacaatatgatgggcaaaagggaaaagaaacttggtgagtttgggaaagctaagggatcacgggccatctggtatatgtggctgggcgcaagatacctcgagttcgaagctctgggctttttgaacgaggatcactggttctcccgcgaaaatagttacagcggggttgagggagaaggtctgcataaactcggctatattcttagggacatctctaagattcccgggggagccatgtacgctgatgacaccgccggctgggacacacgaatcactgaggatgacctgcacaacgaggagaaaataacccagcagatggatccagagcaccggcagttagcaaatgcgatctttaagctgacatatcaaaacaaggtggtcaaagtgcagagacctactcccaagggtaccgtgatggacattatctccaggaaagatcagcgcgggtcaggacaggtcggcacgtacggcttgaatacattcaccaacatggaagcccaactcattcgtcagatggagggggaaggagttctgagcaaggctgacctagagaatccacatcttctggagaaaaaggtgactcagtggctcgaaacaaagggtgtagagcggctgaaaagaatggccatctcgggcgatgactgcgtggtcaagcccatagatgacaggttcgcaaacgctttgttagccctgaacgatatggggaaagtgcgcaaggacattcctcagtggcaaccatctaaaggatggcacgattggcagcaggttccgttttgtagtcatcacttccacgaactcatcatgaaggacggccgaaaacttgtggtcccctgccggcctcaggacgagctgatcggtagagcaaggatttcccaaggggccggatggagcctacgcgaaaccgcgtgtctgggcaaggcttatgcccagatgtgggcactcatgtactttcatagacgggatttgaggctggcctcaaatgctatatgctccgccgtgccagtacactgggttcccacttctcgtaccacatggagcatccatgcacaccatcagtggatgacgaccgaggacatgcttactgtgtggaaccgagtctggattgaggataatccttggatggaagacaagacaccagtgaccacttgggaggatgttccctatctgggcaaacgcgaagaccaatggtgtgggagtctcatcggattaacatccagagctacctgggcccagaacattctgacggcgatccaacaggtgcggagcttgataggtaatgaggagttcctggattacatgccttctatgaagaggtttcgcaaagaagaggaatcagagggcgctatctggtga

SEQ ID NO: 15626 - RNA, 9873 nt, synthetic construct
  misc_feature 1..9873: note = derived and/or modified CDS sequence (opt3) from DENV-3__JQ920483__SS-prME
  source 1..9873: mol_type = other RNA
accagcctgtgcctcatgatgatgcttcccgccaccctggctttccacttgacttccagagacggcgaacctaggatgatcgtggggaagaatgaacggggaaagtctttactgtttaagacggcatcaggtattaatatgtgtaccctcatagccatggatctcggcgagatgtgcgacgatacagtaacttacaagtgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccaggacgcagacttggatgtccgcagagggggcctggaggcaggtcgaaaaggtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacagaatcagaactatgtttgtaaacacacctacgtggaccgcggttgggggaatggatgcggcctctttggcaaggggagtctggtaacatgcgctaagttccaatgtttagagtccatcgagggaaaagccgtgcagcacgaaaacctgaagtatactgtcataattaccgtgcatacaggtgatcagcaccaggttggcaatgagacccaaggggtgactgcagaaatcacgccccaggcttctacagtcgaggccattctccctgaatacggaacccttggcctggagtgcagcccacgaactggtttggactttaacgagatgatcctactgaccatgaaaaataaggcgtggatggtgcatagacagtggttctttgacctcccgctgccctggacatccggggccaccactgaaacacctacgtggaacaaaaaggagcttctggtaaccttcaaaaatgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggataaactggagctaaagggcatgtcttatgccatgtgcctcaacgctttcgtgctgaaaaaggaggtctccgaaacccagcacgggacgatacttatcaaggtggagtacaaaggagaagacgcgccatgtaagattcccttctcaaccgaggatggccaaggtaaagcacataacgggcggttgatcacagccaatcctatagttactaagaaagaggaaccagtgaacattgaggctgaacccccgtttggcgagagcaatatcgtaatcggaattggcgacaaggccctgaagatcaactggtacaaaaaggggagttctattggaaaaatgttcgaagcaaccgcccgtggtgctcgcagaatggccatactcggcgatacagcatgggactttgggtccgtcggaggcgtgctgaatagccttggtaagatggttcaccagatcttcgggtcggcgtatactgctctgttttctggcgtgtcctggattatgaaaatcggaatcggcgtcttgctcacctggattgggctgaactcaaagaatacgagtatgagcttctcctgcatagtgatcggaattatcacattatacctgggcgccgtagtgcaggcagatatgggttgtgttattaactggaaggggaaagagctaaagtgcggatctggcatctttgtcaccaatgaggtgcatacttggacagaacagtataaattccaagccgacagccctaagaggctcgctaccgccatagccggtgcttgggagaacggcgtgtgtgggatccggtcaactacccgaatggaaaatctgctttggaaacagattgccaacgagttgaattacatcctgtgggaaaacaatattaagctcacaatcgtcgttggagatgtgataggcgtgctggagcaggggaaacgcacgttaacaccccagccaatggagctgaagtatagttggaagacttggggaaaagcgaagattgtaacagccgaaacccaaaactccagctttatcattgacggccctaacacacccgagtgcccatctgcttcaagagcatggaatgtctgggaagtggaggattacggtttcggggtttttactaccaacatctggcttaaattgagggaaaagtatacgcagctctgtgaccaccggctgatgagtgccgctgtgaaagacgagcgcgccgtccacgcagatatgggatactggatagagagccagaagaatggctcctggaagctagaaaaagcgtctctgatcgaggtgaagacatgcacctggcccaaatcgcatactctctggagcaacggtgttctggaatccgacatgattatccctaagtcacttgccggcccaattagtcagcacaattacagaccggggtatcatacccaaacagctggaccctggcacttgggcaaactggagttagatttcaactactgcgaggggactaccgtggtaatcacagaaaattgtggaataaggggcccttctctccgtacgaccactgtcagcggtaagctgattcacgagtggtgctgtcggtcctgcacacttccacccctgcgatatatgggggaagacggatgttggtacggcatggagatcagacctatcaacgaaaaggaggagaatatggtgaaatcattggtgagcgccggttctggcaagaccgataactttactatgggggtcctctgcctggcaattctattcgaagaggttatgaggggaaaattcggcaagaaacatatgatcgctggggccctgtttacattcgtgctcctgctttccggacagattacctggcgcgacatggcacacacgttgataatgatcggcagtaatgccagcgatcggatgggtatgggggtaacttatctggctttaattgcgacctttaagatccagccattcctcgccctgggatttttccttagaaagctgacatctagggaaaacctactcctgggcgtgggcttggcaatggctaccactctgcaattacccgaggacattgaacagatggccaatgggatcgccctcggactgatggctcttaaactgataacacagtttgagacctaccagttgtggacagcactcatctccctgatgtgttcaaacactattttcaccctaacggtcgcctggcgcacagcgaccctgatccttgctgtgattagtctcctgccggtttgccaaagctcgtccatgcgaaagactgattggttgcctatgaccgtggccgcaatgggtgtcccacccctgcctttatttatcttctctctcaaagacacactgaagcggcgtagctggccccttaatgagggcgtgatggccgttgggctggtgtcaatattggctagttcctttctcagaaacgatgtcccaatggcaggacctctggtagccggcggtctactgattgcgtgttatgtgatcactgggacctctgctgaccttacggttgaaaaagccgcagatgtgacatgggaggaagaggccgaacagaccggagtcagccataacctcatgatcactgtggacgacgatggcacaatgaggattaaggacgatgagaccgagaatatactgactgtattgttaaaaacagctctgctcatcgtgtccggcattttcccctactcaatcccagccaccctgcttgtctggcacacgtggcagaagcagactcaacgcagcggggttctgtgggacgtgccgagtcctcccgaaacccagaaggcagagttggaagagggagtgtaccggattaaacagcagggtatctttggcaagacacaagtcggggtgggagttcagaaagagggcgtattccataccatgtggcacgtgacaagaggtgctgtcctaactcacaacgggaagaggctggaaccaaattgggccaacgtgaaaaaggatctcatatcttatggaggcggctggaagctgtccgcgcagtggcaaaaaggggaggaagttcaggtgatcgccgtcgagcccggaaagaatcctaaaaacttccagaccatgccaggtatttttcagacgacaactggcgaaatcggggcaattgctcttgacttcaagcccggaaccagcggctcgcctatcataaatcgagagggtaaagtggtagggttatacggaaacggcgtcgtgacaaagaatggcgggtatgtttcaggaattgcccaaaccaacgctgagccggatggtccaactcccgaactggaggaagagatgtttaagaaacgcaatctcaccatcatggacttgcatcctggctctgggaagacacggaaatacctgccagcaatcgtgagagaagccattaagaggcgtctccgcacgctgatccttgcccccactcgggtcgtggctgcggagatggaggaagcactgaaaggattgcctataagatatcagaccacagccaccaagagtgagcacactggcagggaaattgttgatctaatgtgccatgctacattcaccatgcgactgctctccccggtgcgggtccccaactacaatttaatcgtgatggacgaggcccactttacggatccagcaagcattgccgctcgcggttatatctctactagagtagggatgggagaagcggccgcaatattcatgacagctacccctcccggcaccgccgacgcatttccacagagcaacgcccctattcaggatgaggagagggacatccccgaacggtcctggaactcaggcaacgagtggatcactgacttcgctgggaagacagtgtggtttgttccaagtattaaagccggaaacgatatcgcgaattgtctgcgaaagaacggtaaaaaggtcattcaacttagcagaaaaaccttcgacacagaataccagaagactaagctgaatgattgggactttgtggtgacgaccgatatatctgagatgggcgcaaacttcaaagccgaccgcgtcatcgatccgaggcgttgcctcaagcctgtaattttgacagacgggcccgagcgggtgatcctggctggaccaatgcccgttactgtggcctccgctgcacagagaaggggccgcgtcggtcgaaattcacagaaagaaaacgatcaatacatcttcaccgggcagcctctcaataacgacgaggatcatgcccactggacagaagctaagatgctgcttgacaatattaacaccccagagggcataatccccgccctatttgaacctgagagagagaaaagtgcagcgattgacggagaatatcggctgaagggcgagagcaggaaaactttcgtggaattgatgcgccgtggggatttaccggtttggctggcccacaaggtggcttccgagggaatcaagtacacggacagaaaatggtgctttgatggtgaacggaataaccagattctcgaggagaatatggacgtcgaaatctggaccaaggagggcgagaagaagaaactgaggccacgctggcttgatgcccgaacatattctgaccccctggcactcaaggagttcaaggattttgctgccgggagaaaatcgatagcattggacctggtgactgaaatcggacgggtacctagccatctagcccacaggacccgcaacgctctggataatctcgtgatgcttcatacatcagagcacggcggtagagcgtacaggcacgccgttgaggaactgcccgagaccatggaaactttattgctgctcgggctgatgattcttctgacaggcggagcaatgctattcttgatctccggcaaggggattggaaaaacgagtatcggtctgatatgtgtcgtggcttctagcggcatgttatggatggccgacgtgccactacagtggattgcctccgcaatcgtcctggagtttttcatgatggttctccttattcctgagcccgaaaagcaacggaccccacaggataaccagctggcttatgtggtaatcgggatattgactctggccgcgatcgtggctgccaatgagatgggactcctggaaacaaccaaacgtgaccttggcatgtcaaaggagcctggtgtcgtgtctccgaccagctacctcgatgttgacctgcatcccgcaagtgcctggacattgtatgctgtggcaactacggtcattaccccaatgctgcgccacacaatcgaaaactccactgccaacgtcagcttagcggctattgccaatcaagcagtggttctaatggggctggacaagggctggcctatctctaaaatggatctcggagtgccccttctggccttgggctgctactcacaggtcaacccactgaccctcacagctgccgtgctgcttttagtcacccattacgcaataattgggcctggactgcaggctaaggccactcgagaggcgcagaaaagaacggccgcaggcatcatgaagaatcccacagtggacggtatcatgaccattgatctcgacccggttatctatgattccaaatttgagaagcaattgggacaggtgatgctgctagtactgtgtgctgtgcagctccttctgatgaggaccagttgggccttctgcgaagcattgactctggctacaggaccaataactaccctctgggagggcagccctggtaagttttggaacacaacgattgccgtctcgatggccaatatcttccggggctcttacctggcgggggctggattagcattttccattatgaaaagcgttggcaccgggaagcgcggaactggctcacagggtgaaacacttggggagaaatggaagaaaaagctgaaccaactcagtagaaaagagttcgacctatataagaagtctggaatcaccgaggtggataggactgaggccaaagaaggcctgaagcggggtgagataacacaccatgctgtctcccgaggcagcgccaaattgcagtggttcgtggaaagaaatatggtaatccccgaggggcgcgtgattgacctgggatgtggcagaggcgggtggtcatactattgcgcagggctcaagaaagttaccgaagtgcggggttacacgaaagggggaccaggccacgaggagcccgtccctatgagtacctatggctggaacatcgtgaaacttatgagcgggaaagatgtcttttacctgccgcccgaaaagtgtgacacattgctgtgcgatattggagagtcctctccaagccctactgtggaagagtcccgtaccatcagagttctcaaaatggtagagccctggttaaagaataaccagttctgtattaaagtgctgaatccttacatgccaacagtcatcgaacaccttgagaggctgcagcgcaagcatggtggcatgctagtgcggaaccccctctcacgaaattctactcacgaaatgtattggataagtaacgggaccggaaatattgtttcgagcgtgaacatggtctccagactgttgctgaacaggtttacaatgacccatcgccggcctactatcgagaaggacgtggatctcggcgccggtacgagacacgtaaatgctgaaccagagacacccaacatggacgtgatcggggagcgtattaggcggataaaagaagaacactcttcaacctggcattacgacgatgaaaatccgtataagacttgggcgtaccacggaagctatgaggttaaagccaccggctccgcaagttctatgatcaacggcgtcgtgaaacttctgacaaaaccttgggacgtggtcccaatggttacgcaaatggctatgaccgatactacacccttcgggcagcagcgcgtgtttaaggaaaaggtagacacccgaactcctagaccaatgcccggaacaaggaaagtgatggagattaccgccgagtggttatggcggacactgggtcgcaataagagaccgaggttgtgcactcgagaagagttcatcaaaaaggtccggaccaacgcagccatgggcgctgtgtttacggaagagaatcaatgggatagcgcccgtgcggcagttgaagacgaggagttctggaaactcgtggatagagaacgcgagctgcataagctagggaaatgtggatcatgcgtctacaacatgatgggcaagagggaaaagaaacttggtgagtttgggaaggccaaaggatcccgggctatttggtatatgtggctgggcgccagatacctcgagttcgaagcactgggctttttgaatgaggaccactggttcagtcgcgaaaacagccattctggggtggagggagaaggtctgcacaagctcggctacatccttagggatatatccaaaatccctgggggagctatgtatgccgacgataccgctggctgggacacacgaattactgaggacgatctgcacaatgaggaaaagatcacccagcagatggaccccgagcatcggcagttagccaacgcaatttttaagctgacataccaaaataaagtagttaaggtgcagagaccaactcctaaaggtaccgtcatggatatcatatcaaggaaggaccagcgcgggagcggacaggtgggcacgtatggcttgaacacattcaccaatatggaagcgcaactcattcgtcagatggagggggaaggagtgctgtcgaaagccgatctagagaacccccaccttctggagcggaaggtcactcagtggctcgaaacaaagggtgttgagagactgaaaaggatggctatctctggcgacgattgcgtggtaaagccaatcgacgatcgcttcgccaacgcattgttagctctgaatgacatggggaaagtgcgaaaggatattccccagtggcaacctagtaaaggatggcatgactggcagcaggtcccattttgttcccaccacttccatgaactcataatgaaggatggccggaaacttgtggttccgtgcagaccccaggacgagctgatcggtagggcccgcattagccaaggggcaggatggtcactaagagaaaccgcctgtctgggcaaagcgtacgctcagatgtgggccctcatgtattttcaccggagggacttgcgtctggcatccaacgccatctgctctgctgtgcctgtccattgggtgccaactagccgaaccacatggagtattcacgcccatcaccagtggatgacgaccgaggatatgcttactgtatggaatcgcgtttggatcgaggacaacccctggatggaagataagacacctgtgaccacttgggaggacgtcccatacctgggcaaaagagaagatcaatggtgtgggtccctcataggattaacaagccgggcaacctgggctcagaatatcctgacggccattcaacaggtgaggtctttgatcggtaacgaggagttcctggactatatgccctcaatgaagcgctttagaaaagaagaggaaagtgagggcgcgatttggtga

SEQ ID NO: 15627 - RNA, 9873 nt, synthetic construct
  misc_feature 1..9873: note = derived and/or modified CDS sequence (opt3) from DENV-3__JQ920482__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaagtctttactgtttaagacggcatcaggtattaatatgtgtaccctgatagccatggatctcggcgagatgtgcgacgatacagtaacttacaagtgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccaggacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctcgacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgcttcaagagcatggaacgtctgggaagtggaggactacggtttcggggtttttactaccaatatctggcttaaattgagggaaaagtatacgcagctctgtgaccaccggctgatgagtgccgctgtgaaagatgagcgcgccgtccacgcagacatgggatactggatagagagccagaagaacggctcctggaagctagaaaaagcgtctctgatcgaggtgaagacatgcacctggcccaaatcgcatactctctggagcaatggtgttctggaatccgatatgattatccctaagtcacttgccggcccaattagtcagcacaactacagaccggggtatcatacccaaacagctggaccctggcacttgggcaaactggagttagacttcaattactgcgaggggactaccgtggtaatcacagaaaactgtggaataaggggcccttctctccgtacgaccactgtcagcggtaagctgattcacgagtggtgctgtcggtcctgcacacttccacccctgcgatatatgggggaagatggatgttggtacggcatggagatcagacctatcaatgaaaaggaggagaacatggtgaaatcattggtgagcgccggttctggcaagaccgacaattttactatgggggtcctctgcctggcaattctattcgaagaggttatgaggggaaaattcggcaagaaacatatgatcgctggggccctgtttacattcgtgctcctgctttccggacagattacctggcgcgatatggcacacacgttgataatgatcggcagtaacgccagcgaccggatgggtatgggggtaacttatctggctttaattgcgacctttaagatccagccattcctcgccctgggatttttccttagaaagctgacatctagggaaaatctactcctgggcgtgggcttggcaatggctaccactctgcaattacccgaggatattgaacagatggccaacgggatcgccctcggactgatggctcttaaactgataacacagtttgagacctaccagttgtggacagcactcatctccctgatgtgttcaaatactattttcaccctaacggtcgcctggcgcacagcgaccctgatccttgctgtgattagtctcctgccggtttgccaaagctcgtccatgcgaaagactgactggttgcctatgaccgtggccgcaatgggtgtcccacccctgcctttatttatcttctctctcaaagatacactgaagcggcgtagctggccccttaacgagggcgtgatggccgttgggctggtgtcaatattggctagttcctttctcagaaatgacgtcccaatggcaggacctctggtagccggcggtctactgattgcgtgttatgtgatcactgggacctctgctgatcttacggttgaaaaagccgcagacgtgacatgggaggaagaggccgaacagaccggagtcagccataacctcatgatcactgtggacgatgacggcacaatgaggattaaggatgacgagaccgagaacatactgactgtattgttaaaaacagctctgctcatcgtgtccggcattttcccctactcaatcccagccaccctgcttgtctggcacacgtggcagaagcagactcaacgcagcggggttctgtgggatgtgccgagtcctcccgaaacccagaaggcagagttggaagagggagtgtaccggattaaacagcagggtatctttggcaagacacaagtcggggtgggagttcagaaagagggcgtattccataccatgtggcacgtgacaagaggtgctgtcctaactcacaatgggaagaggctggaaccaaactgggccaatgtgaaaaaggacctcatatcttatggaggcggctggaagctgtccgcgcagtggcaaaaaggggaggaagttcaggtgatcgccgtcgagcccggaaagaaccctaaaaatttccagaccatgccaggtatttttcagacgacaactggcgaaatcggggcaattgctcttgatttcaagcccggaaccagcggctcgcctatcataaaccgagagggtaaagtggtagggttatacggaaatggcgtcgtgacaaagaacggcgggtatgtttcaggaattgcccaaaccaatgctgagccggacggtccaactcccgaactggaggaagagatgtttaagaaacgcaacctcaccatcatggatttgcatcctggctctgggaagacacggaaatacctgccagcaatcgtgagagaagccattaagaggcgtctccgcacgctgatccttgcccccactcgggtcgtggctgcggagatggaggaagcactgaaaggattgcctataagatatcagaccacagccaccaagagtgagcacactggcagggaaattgttgacctaatgtgccatgctacattcaccatgcgactgctctccccggtgcgggtccccaattacaacttaatcgtgatggatgaggcccactttacggacccagcaagcattgccgctcgcggttatatctctactagagtagggatgggagaagcggccgcaatattcatgacagctacccctcccggcaccgccgatgcatttccacagagcaatgcccctattcaggacgaggagagggacatccccgaacggtcctggaactcaggcaatgagtggatcactgatttcgctgggaagacagtgtggtttgttccaagtattaaagccggaaacgacatcgcgaactgtctgcgaaagaatggtaaaaaggtcattcaacttagcagaaaaaccttcgatacagaataccagaagactaagctgaacgactgggattttgtggtgacgaccgacatatctgagatgggcgcaaatttcaaagccgatcgcgtcatcgacccgaggcgttgcctcaagcctgtaattttgacagatgggcccgagcgggtgatcctggctggaccaatgcccgttactgtggcctccgctgcacagagaaggggccgcgtcggtcgaaactcacagaaagaaaatgaccaatacatcttcaccgggcagcctctcaacaatgatgaggaccatgcccactggacagaagctaagatgctgcttgacaacattaataccccagagggcataatccccgccctatttgaacctgagagagagaaaagtgcagcgattgatggagaatatcggctgaagggcgagagcaggaaaactttcgtggaattgatgcgccgtggggacttaccggtttggctggcccacaaggtggcttccgagggaatcaagtacacggatagaaaatggtgctttgacggtgaacggaacaatcagattctcgaggagaacatggatgtcgaaatctggaccaaggagggcgagaagaagaaactgaggccacgctggcttgacgcccgaacatattctgatcccctggcactcaaggagttcaaggactttgctgccgggagaaaatcgatagcattggatctggtgactgaaatcggacgggtacctagccatctagcccacaggacccgcaatgctctggacaacctcgtgatgcttcatacatcagagcacggcggtagagcgtacaggcacgccgttgaggaactgcccgagaccatggaaactttattgctgctcgggctgatgattcttctgacaggcggagcaatgctattcttgatctccggcaaggggattggaaaaacgagtatcggtctgatatgtgtcgtggcttctagcggcatgttatggatggccgatgtgccactacagtggattgcctccgcaatcgtcctggagtttttcatgatggttctccttattcctgagcccgaaaagcaacggaccccacaggacaatcagctggcttatgtggtaatcgggatattgactctggccgcgatcgtggctgccaacgagatgggactcctggaaacaaccaaacgtgatcttggcatgtcaaaggagcctggtgtcgtgtctccgaccagctacctcgacgttgacctgcatcccgcaagtgcctggacattgtatgctgtggcaactacggtcattaccccaatgctgcgccacacaatcgaaaattccactgccaacgtcagcttagcggctattgccaaccaagcagtggttctaatggggctggataagggctggcctatctctaaaatggacctcggagtgccccttctggccttgggctgctactcacaggtcaatccactgaccctcacagctgccgtgctgcttttagtcacccattacgcaataattgggcctggactgcaggctaaggccactcgagaggcgcagaaaagaacggccgcaggcatcatgaagaaccccacagtggatggtatcatgaccattgacctcgatccggttatctatgactccaaatttgagaagcaattgggacaggtgatgctgctagtactgtgtgctgtgcagctccttctgatgaggaccagttgggccttctgcgaagcattgactctggctacaggaccaataactaccctctgggagggcagccctggtaagttttggaatacaacgattgccgtctcgatggccaacatcttccggggctcttacctggcgggggctggattagcattttccattatgaaaagcgttggcaccgggaagcgcggaactggctcacagggtgaaacacttggggagaaatggaagaaaaagctgaatcaactcagtagaaaagagttcgatctatataagaagtctggaatcaccgaggtggacaggactgaggccaaagaaggcctgaagcggggtgagataacacaccatgctgtctcccgaggcagcgccaaattgcagtggttcgtggaaagaaacatggtaatccccgaggggcgcgtgattgatctgggatgtggcagaggcgggtggtcatactattgcgcagggctcaagaaagttaccgaagtgcggggttacacgaaagggggaccaggccacgaggagcccgtccctatgagtacctatggctggaatatcgtgaaacttatgagcgggaaagacgtcttttacctgccgcccgaaaagtgtgatacattgctgtgcgacattggagagtcctctccaagccctactgtggaagagtcccgtaccatcagagttctcaaaatggtagagccctggttaaagaacaatcagttctgtattaaagtgctgaacccttacatgccaacagtcatcgaacaccttgagaggctgcagcgcaagcatggtggcatgctagtgcggaatcccctctcacgaaactctactcacgaaatgtattggataagtaatgggaccggaaacattgtttcgagcgtgaatatggtctccagactgttgctgaacaggtttacaatgacccatcgccggcctactatcgagaaggatgtggacctcggcgccggtacgagacacgtaaacgctgaaccagagacacccaatatggacgtgatcggggagcgtattaggcggataaaagaagaacactcttcaacctggcattacgatgacgaaaacccgtataagacttgggcgtaccacggaagctatgaggttaaagccaccggctccgcaagttctatgatcaatggcgtcgtgaaacttctgacaaaaccttgggatgtggtcccaatggttacgcaaatggctatgaccgacactacacccttcgggcagcagcgcgtgtttaaggaaaaggtagatacccgaactcctagaccaatgcccggaacaaggaaagtgatggagattaccgccgagtggttatggcggacactgggtcgcaacaagagaccgaggttgtgcactcgagaagagttcatcaaaaaggtccggaccaatgcagccatgggcgctgtgtttacggaagagaaccaatgggacagcgcccgtgcggcagttgaagatgaggagttctggaaactcgtggacagagaacgcgagctgcataagctagggaaatgtggatcatgcgtctacaatatgatgggcaagagggaaaagaaacttggtgagtttgggaaggccaaaggatcccgggctatttggtatatgtggctgggcgccagatacctcgagttcgaagcactgggctttttgaacgaggatcactggttcagtcgcgaaaatagccattctggggtggagggagaaggtctgcacaagctcggctacatccttagggacatatccaaaatccctgggggagctatgtatgccgatgacaccgctggctgggacacacgaattactgaggatgacctgcacaacgaggaaaagatcacccagcagatggatcccgagcatcggcagttagccaatgcaatttttaagctgacataccaaaacaaagtagttaaggtgcagagaccaactcctaaaggtaccgtcatggacatcatatcaaggaaggatcagcgcgggagcggacaggtgggcacgtatggcttgaatacattcaccaacatggaagcgcaactcattcgtcagatggagggggaaggagtgctgtcgaaagccgacctagagaatccccaccttctggagaagaaggtcactcagtggctcgaaacaaaaggtgttgagcggctgaagagaatggctatctctggcgatgactgcgtggtaaaaccaatcgatgacaggttcgccaacgcattgttagctctgaacgatatggggaaggtgcgcaaagacattccccagtggcaacctagtaagggatggcatgattggcagcaggtcccattttgttcccaccacttccatgaactcataatgaaggacggccgaaaacttgtggttccgtgccggccccaggacgagctgatcggtagagccaggattagccaaggggcaggatggtcactacgcgaaaccgcctgtctgggcaaggcgtacgctcagatgtgggccctcatgtattttcacagacgggatttgaggctggcatccaatgccatctgctctgctgtgcctgtccattgggtgccaactagccgtaccacatggagtattcacgcccatcaccagtggatgacgaccgaggacatgcttactgtatggaaccgagtttggatcgaggataatccctggatggaagacaaaacacctgtgaccacttgggaggatgtcccatacctgggcaagcgcgaagaccaatggtgtgggtccctcataggattaacaagcagagcaacctgggctcagaacatcctgacggccattcaacaggtgcggtctttgatcggtaatgaggagttcctggattatatgccctcaatgaaaaggtttcgcaaggaagaggaaagtgagggcgcgatttggtga

SEQ ID NO: 15628 - RNA, 9873 nt, synthetic construct
  misc_feature 1..9873: note = derived and/or modified CDS sequence (opt3) from DENV-3__JQ920484__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaagtctttactgtttaagacggcatcaggtattaatatgtgtaccctgatagccatggatctcggcgagatgtgcgacgatacagtcacttacaagtgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccaggacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctcgacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgcgataggcgtgctggagcaggggaaacgcacgttaacaccccagccaatggagctgaagtatagttggaagacttggggaaaagccaagattgtgacagctgaaacccaaaattccagctttatcattgatggccctaacacacccgagtgcccatctgcatcaagagcctggaacgtatgggaagtcgaggactacggtttcggggtgtttactaccaatatctggcttaaattgagggaaaagtatacgcagctctgtgaccaccggctgatgagtgctgccgttaaagatgagcgcgcagtgcacgcggacatgggatactggatagagagccagaagaacggctcctggaagctagaaaaagcctctctgatcgaggtcaagacatgcacctggcccaaatcgcatactctctggagcaatggtgtgctggaatccgatatgattatccctaagtcacttgctggcccaattagtcagcacaactacagaccggggtatcatacccaaacagccggaccctggcacttgggcaaactggagttagacttcaattactgcgaggggactaccgttgtgatcacagaaaactgtggaataaggggcccttctctccgtacgaccactgtaagcggtaagctgattcacgagtggtgctgtcggtcctgcacacttccacccctgcgatatatgggggaagatggatgttggtacggcatggagatcagacctatcaatgaaaaggaggagaacatggtcaaatcattggtgagcgcaggttctggcaagaccgacaattttactatgggggtgctctgcctggctattctattcgaagaggtcatgaggggaaaattcggcaagaaacatatgatcgccggggcactgtttacattcgttctcctgctttccggacagattacctggcgcgatatggcccacacgttgataatgatcggcagtaacgctagcgaccggatgggtatgggggtgacttatctggcgttaattgccacctttaagatccagccattcctcgcactgggatttttccttagaaagctgacatctagggaaaatctactcctgggcgtaggcttggctatggccaccactctgcaattacccgaggatattgaacagatggccaacgggatcgctctcggactgatggcacttaaactgataacacagtttgagacctaccagttgtggacagccctcatctccctgatgtgttcaaatactattttcaccctaacggtggcgtggcgcacagctaccctgatccttgccgtcattagtctcctgccggtgtgccaaagctcgtccatgcgaaagactgactggttgcctatgaccgttgcagccatgggtgtgccacccctgcctttatttatcttctctctcaaagatacactgaagcggcgtagctggccccttaacgagggcgtcatggctgtggggctggtttcaatattggcaagttcctttctcagaaatgacgtgccaatggccggacctctggtcgcgggcggtctactgattgcttgttatgtaatcactgggacctctgccgatcttacggtggaaaaagcagccgacgttacatgggaggaagaggctgaacagaccggagtgagccataacctcatgatcactgtcgacgatgacggcacaatgaggattaaggatgacgagaccgagaacatactgactgtgttgttaaaaacagccctgctcatcgtatccggcattttcccctactcaatcccagcaaccctgcttgtgtggcacacgtggcagaagcagactcaacgcagcggggtcctgtgggatgttccgagtcctcccgaaacccagaaggctgagttggaagagggagtgtaccggattaaacagcagggtatctttggcaagacacaagtgggggtcggagtgcagaaagagggcgttttccataccatgtggcacgtaacaagaggtgccgtgctaacttataatgggaagaggctggaaccaaactgggcgaatgtcaaaaaggacctcatatcttacggaggcggctggaagctgtccgcccagtggcaaaaaggggaggaagtgcaggttatcgcagtggagcccggaaagaaccctaaaaatttccagaccatgccaggtatttttcagacgacaactggcgaaatcggggctattgcccttgatttcaagcccggaaccagcggctcgcctatcataaaccgagagggtaaagtcgtggggttatatggaaatggcgtagtcacaaagaacggcgggtacgtgtcaggaattgctcaaaccaatgcagagccggacggtccaactcccgaactggaggaagagatgtttaagaaacgcaacctcaccatcatggatttgcaccctggctctgggaagacacggaaatatctgccagccatcgttagagaagccattaagaggcgtctccgcacgctgatccttgctcccactcgggtggtcgcggcagagatggaggaagccctgaaaggattgcctataagataccagaccacagctaccaagagtgagcatactggcagggaaattgtggacctaatgtgccacgccacattcaccatgcgactgctctccccggttcgggtgcccaattataacttaatcgtcatggatgaggcacattttacggacccagccagcattgctgcgcgcggttacatctctactagagtggggatgggagaagccgcagctatattcatgacagccacccctcccggcaccgcagatgcctttccacagagcaatgctcctattcaggacgaggagagggacatccccgaacggtcctggaactcaggcaatgagtggatcactgatttcgccgggaagacagtatggtttgtgccaagtattaaagcgggaaacgacatcgcaaactgtctgcgaaagaatggtaaaaaggttattcaacttagcagaaaaaccttcgatacagaataccagaagactaagctgaacgactgggattttgtcgtgacgaccgacatatctgagatgggcgccaatttcaaagctgatcgcgtgatcgacccgaggcgttgcctcaagcctgtcattttgacagatgggcccgagcgggtaatcctggccggaccaatgcccgtgactgttgcttccgcagcccagagaaggggccgcgtgggtcgaaactcacagaaagaaaatgaccaatatatcttcaccgggcagcctctcaacaatgatgaggaccacgctcattggacagaagccaagatgctgcttgacaacattaataccccagagggcataatccccgcactatttgaacctgagagagagaaaagtgcggccattgatggagaataccggctgaagggcgagagcaggaaaactttcgtcgaattgatgcgccgtggggacttaccggtgtggctggctcacaaggttgcctccgagggaatcaagtatacggatagaaaatggtgctttgacggtgaacggaacaatcagattctcgaggagaacatggatgtggaaatctggaccaaggagggcgagaagaagaaactgaggccacgctggcttgacgcacgaacatactctgatcccctggctctcaaggagttcaaggactttgccgcagggagaaaatcgatagccttggatctggtcactgaaatcggacgggtgcctagccacctagctcataggacccgcaatgcgctggacaacctcgtaatgcttcacacatcagagcatggcggtagagcctataggcacgcagtggaggaactgcccgagaccatggaaactttattgctgctcgggctgatgattcttctgacaggcggagctatgctattcttgatctccggcaaggggattggaaaaacgagtatcggtctgatatgtgttgtcgcctctagcggcatgttatggatggccgatgtgccactacagtggattgcatccgctatcgtgctggagtttttcatgatggtcctccttattcctgagcccgaaaagcaacggaccccacaggacaatcagctggcctacgttgtgatcgggatattgactctggcggctatcgtagccgcaaacgagatgggactcctggaaacaaccaaacgtgatcttggcatgtcaaaggagcctggtgtggtctctccgaccagctatctcgacgtggacctgcaccccgccagtgcttggacattgtacgcagttgccactacggtgattaccccaatgctgcgccatacaatcgaaaattccactgcgaacgtcagcttagctgccattgcaaaccaagccgtagtgctaatggggctggataagggctggcctatctctaaaatggacctcggagttccccttctggctttgggctgctactcacaggtgaatccactgaccctcacagccgcagtcctgcttttagtgacccactatgctataattgggcctggactgcaggccaaggcgactcgagaggcccagaaaagaacggcagctggcatcatgaagaaccccacagtcgatggtatcatgaccattgacctcgatccggtgatctacgactccaaatttgagaagcaattggggcaggttatgctgctagtgctgtgtgccgtacagctccttctgatgaggaccagttgggcattctgcgaggctttgactctggccacaggaccaataactaccctctgggaaggcagccctggtaagttttggaatacaacgattgccgtgtcgatggcgaacatcttccggggctcttatctggctggggcaggattagccttttccattatgaaaagcgtcggcaccgggaagcgcggaactggctcacagggtgaaacacttggggagaaatggaagaaaaagctgaatcaactcagtagaaaagagttcgatctatacaagaagtctggaatcaccgaggttgacaggactgaggctaaagaaggcctgaagcggggtgagataacacatcacgccgtgtcccgaggcagcgcaaaattgcagtggttcgtcgaaagaaacatggtgatccccgaggggcgcgtaattgatctgggatgtggcagagggggatggtcatattactgcgccggcctcaagaaagtgaccgaagttcggggttatacgaaagggggaccaggccatgaggagcccgtgcctatgagtacctacggctggaatatcgtcaaacttatgagcgggaaagacgtgttttacctgccgcccgaaaagtgtgatacattgctgtgcgacattggagagtcctctccaagccctactgtcgaagagtcccgtaccatcagagtgctcaaaatggttgagccctggttaaagaacaatcagttctgtattaaagtactgaacccttatatgccaacagtgatcgaacaccttgagaggctgcagcgcaagcacggtggcatgctagtccggaatcccctctcacgaaactctactcatgaaatgtactggataagtaatgggaccggaaacattgtgtcgagcgttaatatggtgtccagactgttgctgaacaggtttacaatgacccaccgccggcctactatcgagaaggatgtcgacctcggcgctggtacgagacatgtgaacgcggaaccagagacacccaatatggacgtaatcggggagcgtattaggcggataaaagaagaacactcttcaacctggcactatgatgacgaaaacccgtacaagacttgggcctatcatggaagctacgaggtgaaagcaaccggctccgctagttctatgatcaatggcgttgtcaaacttctgacaaaaccttgggatgtggtgccaatggtcacgcaaatggccatgaccgacactacacccttcgggcagcagcgcgtttttaaggaaaaggtggatacccgaactcctagaccaatgcccggaacaaggaaagtaatggagattaccgcagagtggttatggcggacactgggtcgcaacaagagaccgaggttgtgcactcgagaagagttcatcaaaaaggtgcggaccaatgccgctatgggcgccgtctttacggaagagaaccaatgggacagcgcgcgtgcagccgtggaagatgaggagttctggaaactcgttgacagagaacgcgagctgcacaagctagggaaatgtggatcatgcgtgtataatatgatgggcaagagggaaaagaaacttggtgagtttgggaaggctaaaggatcccgggccatttggtacatgtggctgggcgcaagatacctcgagttcgaagctctgggctttttgaacgaggatcattggttcagtcgcgaaaatagccactctggggtcgagggagaaggtctgcataagctcggctatatccttagggacatatccaaaatccctgggggagccatgtacgctgatgacaccgccggctgggacacacgaattactgaggatgacctgcacaacgaggaaaagatcacccagcagatggatcccgagcaccggcagttagcaaatgcgatttttaagctgacatatcaaaacaaagtggtaaaggttcagagaccaactcctaaaggtaccgtgatggacatcatatcaaggaaggatcagcgcgggagcggacaggtcggcacgtacggcttgaatacattcaccaacatggaagcccaactcattcgtcagatggagggggaaggagtgctgtcgaaagctgacctagagaatccccatcttctggagaagaaggtgactcagtggctcgaaacaaaaggtgtcgagcggctgaagagaatggccatctctggcgatgactgcgttgtgaaaccaatcgatgacaggttcgcaaacgctttgttagccctgaacgatatggggaaggtacgcaaagacattccccagtggcaacctagtaagggatggcacgattggcaacaggtgccattttgttcccatcacttccacgaactcataatgaaggacggccgaaaacttgtcgtgccgtgccggccccaggacgagctgatcggtagagcaaggattagccaaggggccggatggtcactacgcgaaaccgcgtgtctgggcaaggcttatgcccagatgtgggcactcatgtactttcatagacgggatttgaggctggcctccaatgctatctgctctgccgttcctgtgcactgggtcccaactagccgtaccacatggagtattcatgcacaccatcagtggatgacgaccgaggacatgcttactgtgtggaaccgagtatggatcgaggataatccctggatggaagacaaaacacctgttaccacttgggaggatgtgccatatctgggcaagcgcgaagaccaatggtgtgggtccctcataggattaacaagcagagctacctgggcccagaacatcctgacggcgattcagcaggtccggtctttgatcggtaatgaggagttcctggattacatgccctcaatgaaaaggtttcgcaaggaagaggaaagtgagggcgctatttggtga

SEQ ID NO: 15629 - RNA, 9873 nt, synthetic construct
  misc_feature 1..9873: note = derived and/or modified CDS sequence (opt3) from DENV-3__JQ920486__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaagtctttactgtttaagacggcatcaggtattaatatgtgtaccctgatagccatggatctcggcgagatgtgcgacgatacagtaacttacaagtgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccaggacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctcgacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgcgataggcgtgctggagcaggggaaacgcacgttaacaccccagccaatggagctgaagtatagttggaagacttggggaaaagccaagattgtgacagctgaaacccaaaattccagctttatcattgatggccctaacacacccgagtgcccatctgcatcaagagcctggaacgtatgggaagtcgaggactacggtttcggggtgtttactaccaatatctggcttaaattgagggaaaagtatacgcagctctgtgaccaccggctgatgagtgctgccgttaaagatgagcgcgcagtgcacgtcgacatgggatactggatagagagccagaagaacggctcctggaagctagaaaaagcgtctctgatcgaggtgaagacatgcacctggcccaaatcgcatactctctggagcaatggtgttctggaatccgatatgattatccctaagtcacttgccggcccaattagtcagcacaactacagaccggggtatcatacccaaacagctggaccctggcacttgggcaaactggagttagacttcaattactgcgaggggactaccgtggtaatcacagaaaactgtggaataaggggcccttctctccgtacgaccactgtcagcggtaagctgattcacgagtggtgctgtcggtcctgcacacttccacccctgcgatatatgggggaagatggatgttggtacggcatggagatcagacctatcaatgaaaaggaggagaacatggtgaaatcattggtgagcgccggttctggcaagaccgacaattttactatgggggtcctctgcctggcaattctattcgaagaggttatgaggggaaaattcggcaagaaacatatgatcgctggggccctgtttacattcgtgctcctgctttccggacagattacctggcgcgatatggcacacacgttgataatgatcggcagtaacgccagcgaccggatgggtatgggggtaacttatctggctttaattgcgacctttaagatccagccattcctcgccctgggatttttccttagaaagctgacatctagggaaaatctactcctgggcgtgggcttggcaatggctaccactctgcaattacccgaggatattgaacagatggccaacgggatcgccctcggactgatggctcttaaactgataacacagtttgagacctaccagttgtggacagcactcatctccctgatgtgttcaaatactattttcaccctaacggtcgcctggcgcacagcgaccctgatccttgctgtgattagtctcctgccggtttgccaaagctcgtccatgcgaaagactgactggttgcctatgaccgtggccgcaatgggtgtcccacccctgcctttatttatcttctctctcaaagatacactgaagcggcgtagctggccccttaacgagggcgtgatggccgttgggctggtgtcaatattggctagttcctttctcagaaatgacgtcccaatggcaggacctctggtagccggcggtctactgattgcgtgttatgtgatcactgggacctctgctgatcttacggttgaaaaagccgcagacgtgacatgggaggaagaggccgaacagaccggagtcagccataacctcatgatcactgtggacgatgacggcacaatgaggattaaggatgacgagaccgagaacatactgactgtattgttaaaaacagctctgctcatcgtgtccggcattttcccctactcaatcccagccaccctgcttgtctggcacacgtggcagaagcagactcaacgcagcggggttctgtgggatgtgccgagtcctcccgaaacccagaaggcagagttggaagagggagtgtaccggattaaacagcagggtatctttggcaagacacaagtcggggtgggagttcagaaagagggcgtattccataccatgtggcacgtgacaagaggtgctgtcctaactcacaatgggaagaggctggaaccaaactgggccaatgtgaaaaaggacctcatatcttatggaggcggctggaagctgtccgcgcagtggcaaaaaggggaggaagttcaggtgatcgccgtcgagcccggaaagaaccctaaaaatttccagaccatgccaggtatttttcagacgacaactggcgaaatcggggcaattgctcttgatttcaagcccggaaccagcggctcgcctatcataaaccgagagggtaaagtggtagggttatacggaaatggcgtcgtgacaaagaacggcgggtatgtttcaggaattgcccaaaccaatgctgagccggacggtccaactcccgaactggaggaagagatgtttaagaaacgcaacctcaccatcatggatttgcatcctggctctgggaagacacggaaatacctgccagcaatcgtgagagaagccattaagaggcgtctccgcacgctgatccttgcccccactcgggtcgtggctgcggagatggaggaagcactgaaaggattgcctataagatatcagaccacagccaccaagagtgagcacactggcagggaaattgttgacctaatgtgccatgctacattcaccatgcgactgctctccccggtgcgggtccccaattacaacttaatcgtgatggatgaggcccactttacggacccagcaagcattgccgctcgcggttatatctctactagagtagggatgggagaagcggccgcaatattcatgacagctacccctcccggcaccgccgatgcatttccacagagcaatgcccctattcaggacgaggagagggacatccccgaacggtcctggaactcaggcaatgagtggatcactgatttcgctgggaagacagtgtggtttgttccaagtattaaagccggaaacgacatcgcgaactgtctgcgaaagaatggtaaaaaggtcattcaacttagcagaaaaaccttcgatacagaataccagaagactaagctgaacgactgggattttgtggtgacgaccgacatatctgagatgggcgcaaatttcaaagccgatcgcgtcatcgacccgaggcgttgcctcaagcctgtaattttgacagatgggcccgagcgggtgatcctggctggaccaatgcccgttactgtggcctccgctgcacagagaaggggccgcgtcggtcgaaactcacagaaagaaaatgaccaatacatcttcaccgggcagcctctcaacaatgatgaggaccatgcccactggacagaagctaagatgctgcttgacaacattaataccccagagggcataatccccgccctatttgaacctgagagagagaaaagtgcagcgattgatggagaatatcggctgaagggcgagagcaggaaaactttcgtggaattgatgcgccgtggggacttaccggtttggctggcccacaaggtggcttccgagggaatcaagtacacggatagaaaatggtgctttgacggtgaacggaacaatcagattctcgaggagaacatggatgtcgaaatctggaccaaggagggcgagaagaagaaactgaggccacgctggcttgacgcccgaacatattctgatcccctggcactcaaggagttcaaggactttgctgccgggagaaaatcgatagcattggatctggtgactgaaatcggacgggtacctagccatctagcccacaggacccgcaatgctctggacaacctcgtgatgcttcatacatcagagcacggcggtagagcgtacaggcacgccgttgaggaactgcccgagaccatggaaactttattgctgctcgggctgatgattcttctgacaggcggagcaatgctattcttgatctccggcaaggggattggaaaaacgagtatcggtctgatatgtgtcgtggcttctagcggcatgttatggatggccgatgtgccactacagtggattgcctccgcaatcgtcctggagtttttcatgatggttctccttattcctgagcccgaaaagcaacggaccccacaggacaatcagctggcttatgtggtaatcgggatattgactctggccgcgatcgtggctgccaacgagatgggactcctggaaacaaccaaacgtgatcttggcatgtcaaaggagcctggtgtcgtgtctccgaccagctacctcgacgttgacctgcatcccgcaagtgcctggacattgtatgctgtggcaactacggtcattaccccaatgctgcgccacacaatcgaaaattccactgccaacgtcagcttagcggctattgccaaccaagcagtggttctaatggggctggataagggctggcctatctctaaaatggacctcggagtgccccttctggccttgggctgctactcacaggtcaatccactgaccctcacagctgccgtgctgcttttagtcacccattacgcaataattgggcctggactgcaggctaaggccactcgagaggcgcagaaaagaacggccgcaggcatcatgaagaaccccacagtggatggtatcatgaccattgacctcgatccggttatctatgactccaaatttgagaagcaattgggacaggtgatgctgctagtactgtgtgctgtgcagctccttctgatgaggaccagttgggccttctgcgaagcattgactctggctacaggaccaataactaccctctgggagggcagccctggtaagttttggaatacaacgattgccgtctcgatggccaacatcttccggggctcttacctggcgggggctggattagcattttccattatgaaaagcgttggcaccgggaagcgcggaactggctcacagggtgaaacacttggggagaaatggaagaaaaagctgaatcaactcagtagaaaagagttcgatctatataagaagtctggaatcaccgaggtggacaggatagaggccaaagaaggcctgaagcggggtgagatcactcaccatgctgtctcccgaggcagcgccaaattgcagtggttcgtggaaagaaacatggtaattcccgaggggcgcgtgatcgatctgggatgtggcagaggcgggtggtcatactattgcgcagggctcaagaaagttacagaagtgcggggttacaccaaagggggaccaggccacgaggagcccgtccctatgagtacgtatggctggaatattgtgaaacttatgagcgggaaagacgtcttttacctgccgcccgaaaagtgtgataccttgctgtgcgacatcggagagtcctctccaagccctacagtggaagagtcccgtactattagagttctcaaaatggtagagccctggttaaagaacaatcagttctgtatcaaagtgctgaacccttacatgccaaccgtcatagaacaccttgagaggctgcagcgcaagcatggtggcatgctagtgcggaatcccctctcacgaaactctacacacgaaatgtattggattagtaatgggactggaaacatcgtttcgagcgtgaatatggtctccagactgttgctgaacaggtttaccatgacacatcgccggcctaccatcgagaaggatgtggacctcggcgccggtactagacacgtaaacgctgaaccagagacgcccaatatggacgtgattggggagcgtataaggcggatcaaagaagaacactcttcaacatggcattacgatgacgaaaacccgtataagacctgggcgtaccacggaagctatgaggttaaagccactggctccgcaagttctatgattaatggcgtcgtgaaacttctgaccaaaccttgggatgtggtcccaatggttacacaaatggctatgacggacaccactcccttcgggcagcagcgcgtgtttaaggaaaaggtagatacacgaacccctagaccaatgcccggaactaggaaagtgatggagatcacagccgagtggttatggcggaccctgggtcgcaacaagagaccgaggttgtgcacacgagaagagttcattaaaaaggtccggactaatgcagccatgggcgctgtgtttaccgaagagaaccaatgggacagcgcccgtgcggcagttgaagatgaggagttctggaaactcgtggacagagaacgcgagctgcataagctagggaaatgtggatcatgcgtctacaatatgatgggcaagagggaaaagaaacttggtgagtttgggaaggccaaaggatcccgggctatctggtatatgtggctgggcgccagatacctcgagttcgaagcactgggctttttgaacgaggatcactggttcagtcgcgaaaatagccattctggggtggagggagaaggtctgcacaagctcggctacatacttagggacatctccaaaattcctgggggagctatgtatgccgatgacacggctggctgggacacccgaatcacagaggatgacctgcacaacgaggaaaagattactcagcagatggatcccgagcatcggcagttagccaatgcaatctttaagctgacctaccaaaacaaagtagttaaggtgcagagaccaacacctaaaggtactgtcatggacataatttcaaggaaggatcagcgcgggagcggacaggtgggcacctatggcttgaatacgttcacaaacatggaagcgcaactcatccgtcagatggagggggaaggagtgctgtcgaaagccgacctagagaatccccaccttctggagaagaaggtcacccagtggctcgaaactaaaggtgttgagcggctgaagagaatggctatctctggcgatgactgcgtggtaaaaccaattgatgacaggttcgccaacgcattgttagctctgaacgatatggggaaggtgcgcaaagacataccccagtggcaacctagtaagggatggcatgattggcagcaggtcccattttgttcccaccacttccatgaactcatcatgaaggacggccgaaaacttgtggttccgtgccggccccaggacgagctgattggtagagccaggatcagccaaggggcaggatggtcactacgcgaaacagcctgtctgggcaaggcgtacgctcagatgtgggccctcatgtattttcacagacgggatttgaggctggcatccaatgccatttgctctgctgtgcctgtccattgggtgccaaccagccgtactacctggagtatccacgcccatcaccagtggatgacaacggaggacatgcttaccgtatggaaccgagtttggatagaggataatccctggatggaagacaaaactcctgtgacaacctgggaggatgtcccatacctgggcaagcgcgaagaccaatggtgtgggtccctcatcggattaactagcagagcaacatgggctcagaacattctgaccgccatccaacaggtgcggtctttgattggtaatgaggagttcctggattatatgccctcaatgaaaaggtttcgcaaggaagaggaaagtgagggcgcgatctggtga

SEQ ID NO: 15630 - RNA, 9873 nt, synthetic construct
  misc_feature 1..9873: note = derived and/or modified CDS sequence (opt3) from DENV-3__JQ920485__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacattaccacagatagccggtgccctactcagggcgaagccatcttgccagaggaacaggaccagaattatgtctgtaaacacacctacgttgatcgcggttgggggaacggatgcggcctctttggcaaggggagtctggtgacatgcgctaagttccaatgtttagagtccatagagggaaaagccgtacagcacgaaaatctgaagtatactgtgattatcaccgtccatacaggtgaccagcaccaggtgggcaacgagacccaaggggttactgcagaaattacgccccaggcttctacagtggaggccatcctccctgaatacggaacccttggcctggagtgcagcccacgaactggtttggactttaatgagatgatcctactgaccatgaaaaacaaggcgtggatggtccatagacagtggttctttgatctcccgctgccctggacatccggggccaccactgaaacacctacgtggaataaaaaggagcttctggtgaccttcaaaaacgcacacgctaagaagcaagaagtagttgtgttgggctcacaggagggagccatgcacactgctctcacaggcgccaccgaaattcagacaagtgggggaactagcatatttgcaggtcatctgaaatgtaggttaaagatggacaaactggagctaaagggcatgtcttatgccatgtgcctcaatgctttcgtcctgaaaaaggaggtgtccgaaacccagcacgggacgatccttattaaggtcgagtacaaaggagaagatgcgccatgtaagatccccttctcaaccgaggacggccaaggtaaagcacataacgggcggttgataacagccaaccctattgtgactaagaaagaggaaccagttaatatcgaggctgaacccccgtttggcgagagcaacatcgtgattggaatcggcgataaggccctgaagattaattggtacaaaaaggggagttctataggaaaaatgttcgaagcaaccgcccgtggtgctcgcagaatggccatcctcggcgacacagcatgggattttgggtccgtaggaggcgtcctgaacagccttggtaagatggtgcaccagattttcgggtcggcgtatactgctctgttttctggcgtttcctggatcatgaaaatcggaattggcgtgttgctcacctggatagggctgaattcaaagaacacgagtatgagcttctcctgcatcgtcattggaatcattacattatacctgggcgccgtggtacaggcagacatgggttgtgtgatcaattggaaggggaaagagctaaagtgcggatctggcatatttgttaccaacgaggtccatacttggacagaacagtataaattccaagccgatagccctaagaggctcgctaccgccatcgcaggtgcttgggagaatggcgtgtgtgggattcggtcaactacccgaatggaaaacctgctttggaaacagatcgccaatgagttgaactacattctgtgggaaaataacatcaagctcacaatagtggtcggagacgttattggcgtgctggagcaggggaaacgcacgttaaccccccagccaatggagctgaagtatagttggaagacttggggaaaagcgaagatcgtgacagccgaaacccaaaattccagctttattatcgatggccctaacacacccgagtgcccatctgcttcaagagcatggaacgtatgggaagtcgaggactacggtttcggggtgtttactaccaatatatggcttaaattgagggaaaagcacacgcagctctgtgaccaccggctgatgagtgccgctgttaaagatgagcgcgccgtgcatgcagacatgggatattggatcgagagccagaagaacggctcctggaagctagaaaaagcgtctctgattgaggtcaagacatgcacctggcccaaatcgcacactctctggagcaatggtgtgctggaatccgatatgatcattcctaagtcacttgccggcccaatcagtcagcataactacagaccggggtaccacacccaaacagctggaccctggcacttgggcaaactggagttagacttcaattattgcgaggggactaccgttgtgataacagaaaactgtggaattaggggcccttctctccgtacgaccactgtaagcggtaagctgatccatgagtggtgctgtcggtcctgcacacttccacccctgcgatacatgggggaagatggatgttggtatggcatggagatcagacctattaatgaaaaggaggagaacatggtcaaatcattggtgagcgccggttctggcaagaccgacaattttactatgggggtgctctgcctggcaatcctattcgaagaggtcatgaggggaaaattcggcaagaaacacatgattgctggggccctgtttacattcgttctcctgctttccggacagataacctggcgcgatatggcacatacgttgatcatgattggcagtaacgccagcgaccggatgggtatgggggtgacttacctggctttaatcgcgacctttaagattcagccattcctcgccctgggatttttccttagaaagctgacatctagggaaaatctactcctgggcgtaggcttggcaatggctaccactctgcaattacccgaggatatcgaacagatggccaacgggatagccctcggactgatggctcttaaactgatcacacagtttgagacctatcagttgtggacagcactcatttccctgatgtgttcaaatactatcttcaccctaacggtggcctggcgcacagcgaccctgattcttgctgtcatcagtctcctgccggtgtgccaaagctcgtccatgcgaaagactgactggttgcctatgaccgttgccgcaatgggtgtgccacccctgcctttatttatattctctctcaaagatacactgaagcggcgtagctggccccttaacgagggcgtcatggccgtggggctggtttcaattttggctagttcctttctcagaaatgacgtgccaatggcaggacctctggtcgccggcggtctactgatcgcgtgttacgtaatcactgggacctctgctgatcttacggtggaaaaagccgcagacgttacatgggaggaagaggccgaacagaccggagtgagccacaacctcatgattactgtcgacgatgacggcacaatgaggataaaggatgacgagaccgagaacatcctgactgtgttgttaaaaacagctctgctcattgtatccggcatcttcccctattcaattccagccaccctgcttgtgtggcatacgtggcagaagcagactcaacgcagcggggtcctgtgggatgttccgagtcctcccgaaacccagaaggcagagttggaagagggagtgtaccggatcaaacagcagggtatatttggcaagacacaagtgggggtcggagtgcagaaagagggcgttttccacaccatgtggcacgtaacaagaggtgctgtgctaactcataatgggaagaggctggaaccaaactgggccaatgtcaaaaaggacctcatctcttacggaggcggctggaagctgtccgcgcagtggcaaaaaggggaggaagtgcaggttattgccgtggagcccggaaagaaccctaaaaatttccagaccatgccaggtatctttcagacgacaactggcgaaattggggcaatcgctcttgatttcaagcccggaaccagcggctcgcctataattaaccgagagggtaaagtcgtggggttatatggaaatggcgtagtcacaaagaacggcgggtacgtgtcaggaatcgcccaaaccaatgctgagccggacggtccaatccccgaactggaggaagagatgtttaagaaacgcaacctcactattatggatttgcaccctggctctgggaagacccggaaatatctgccagcaatcgttagagaagccataaagaggcgtctccgcacactgattcttgcccccacgcgggtggtcgctgcggagatggaggaagcactgaaaggattgcctatcagataccagactaccgccacaaagagtgagcataccggcagggaaattgtggacctaatgtgccacgctactttcacaatgcgactgctctccccggttcgggtgcccaattataacttaatcgtcatggatgaggcccattttaccgacccagcaagcatagccgctcgcggttacatttctacgagagtggggatgggagaagcggccgcaatcttcatgactgctacacctcccggcaccgccgatgcatttccacagagcaatgcccctatccaggacgaggagagggacattcccgaacggtcctggaactcaggcaatgagtggatcaccgatttcgctgggaagactgtatggtttgtgccaagtattaaagccggaaacgacatagcgaactgtctgcgaaagaatggtaaaaaggttatccaacttagcagaaaaacattcgataccgaatatcagaagacaaagctgaacgactgggattttgtcgtgactacggacatttctgagatgggcgcaaatttcaaagccgatcgcgtgatcgacccgaggcgttgcctcaagcctgtcatcttgaccgatgggcccgagcgggtaattctggctggaccaatgcccgtgacagttgcctccgctgcacagagaaggggccgcgtgggtcgaaactcacagaaagaaaatgaccaatacatattcactgggcagcctctcaacaatgatgaggaccacgcccactggaccgaagctaagatgctgcttgacaacatcaatacaccagagggcattatccccgccctatttgaacctgagagagagaaaagtgcagcgattgatggagaataccggctgaagggcgagagcaggaaaaccttcgtcgaattgatgcgccgtggggacttaccggtgtggctggcccataaggttgcttccgagggaatcaagtatactgatagaaaatggtgctttgacggtgaacggaacaatcagatactcgaggagaacatggatgtggaaatctggacgaaggagggcgaaaaaaagaaactgaggccacgctggcttgacgcccgaacctactctgatcccctggcactcaaggagttcaaggactttgctgccgggagaaaatcgattgcattggatctggtcacagaaatcggacgggtgcctagccacctagcccataggactcgcaatgctctggacaacctcgtaatgcttcacacctcagagcacggcggtagagcgtataggcatgccgtggaggaactgcccgagacaatggaaaccttattgctgctcgggctgatgattcttctgactggcggagcaatgctcttcttgatctccggcaaggggataggaaaaacaagtattggtctgatctgtgttgtcgcttctagcggcatgttatggatggccgatgtgccactacagtggattgcctccgcaatcgtgctggagtttttcatgatggtcctccttatacctgagcccgaaaagcaacggacgccacaggacaatcagctggcttacgttgtgatcgggattttgaccctggccgcgatcgtagctgccaacgagatgggactcctggaaactacaaaacgtgatcttggcatgtcaaaggagcctggtgtggtctctccgaccagctatctcgacgtggacctgcaccccgcaagtgcctggaccttgtacgctgttgcaacaactgtgattacgccaatgctgcgccataccatcgaaaattccacagccaacgtcagcttagcggctatagccaaccaagcagtagtgctaatggggctggataagggctggcctatttctaaaatggacctcggagttccccttctggccttgggctgctattcacaggtgaatccactgactctcaccgctgccgtcctgcttttagtgacacactacgcaatcatcgggcctggactgcaggctaaggccacccgagaggcgcagaaaagaactgccgcaggcattatgaagaaccccacggtcgatggtatcatgacaatagacctcgatccggtgatttacgactccaaatttgagaagcaattggggcaggttatgctgctagtgctgtgtgctgtacagctccttctgatgaggaccagttgggccttctgcgaagcattgactctggctaccggaccaatcacaactctctgggagggcagccctggtaagttttggaataccacaattgccgtgtcgatggccaacatcttccggggctcttatctggcgggggctggattagcattttccataatgaaaagcgtcggcacggggaagcgcggaaccggctcacagggtgaaactcttggggagaaatggaagaaaaagctgaatcaactcagtagaaaagaattcgatctatacaagaagtctggaatcacagaggttgacaggattgaggccaaagaaggcctgaagcggggtgagatcacccatcacgctgtgtcccgaggcagcgccaaattgcagtggttcgtcgaaagaaacatggtgattcccgaggggcgcgtaatcgatctgggatgtggcagggggggatggtcatattactgcgcaggcctcaagaaagtgactgaagttcggggttatacaaaggggggaccaggccacgaggagcccgtgcctatgagtacctacggctggaatattgtcaagcttatgagcgggaaagacgtgttttatctgccgcccgaaaagtgtgatacgttgctgtgcgacatcggagagtcctctccaagccctaccgtcgaagagtcccgtacaataagagtgctcaaaatggttgagccctggttaaagaacaatcagttctgtattaaagtactgaacccttacatgccaactgtgatcgaacatcttgagaggctgcagcgcaagcacggtggcatgctagtccggaatcccctctcacgaaactctacccatgaaatgtactggatcagtaatgggacaggaaacattgtgtcgagcgttaatatggtgtccagactgttgctgaacaggtttactatgacccaccgccggcctacaatagagaaggatgtcgacctcggcgccggtaccagacacgtgaacgctgaaccagagactcccaatatgaacgtaatcggggagcgtattaggcggatcaaagaagagcattcttcaacgtggcactatgacgatgaaaatccgtacaagacatgggcgtatcatggaagctacgaggtgaaagccaccggctccgcaagttctatgattaacggcgttgtcaagcttctgactaaaccttgggacgtggtgccaatggtcacccaaatggctatgacagatacgacccccttcgggcagcagcgcgtttttaaggaaaaggtggacactcgaacacctagaccaatgcccggaaccaggaaagtaatggagatcactgccgagtggttatggcggacactgggtcgcaataagagaccgaggttgtgcacccgagaagagttcataaaaaaggtgcggacaaacgcagccatgggcgctgtctttactgaagagaatcaatgggatagcgcccgtgcggcagtggaagacgaggagttctggaaactcgttgatagagaacgcgagctgcacaagctagggaaatgtggatcatgcgtgtataacatgatgggcaagagggaaaagaaacttggtgagtttgggaaggccaaaggatcccgggctatctggtacatgtggctgggcgccagatatctcgagttcgaagcactgggctttttgaatgaggaccattggttcagtcgcgaaaacagccactctggggtcgagggagaaggtctgcacaagctcggctacattcttagggatatctccaaaattcctgggggagctatgtacgccgacgataccgctggctgggacacgcgaatcaccgaggacgatctgcataatgaggaaaagataacacagcagatggaccccgagcaccggcagttagccaacgcaatttttaagctgacttatcaaaataaagtggtaaaggttcagagaccaacccctaaaggtacagtgatggatatcatctcaaggaaggaccagcgcgggagcggacaggtcggcacttacggcttgaacaccttcacgaatatggaagcgcaactcattcgtcagatggagggggaaggagtgctgtcgaaagccgatctagagaacccccatcttctggagaagaaggtgacacagtggctcgaaaccaaaggtgtcgagcggctgaagagaatggctatatctggcgacgattgcgttgtgaaaccaatcgacgataggttcgccaacgcattgttagctctgaatgacatggggaaggtacgcaaagatattccccagtggcaacctagtaagggatggcacgactggcagcaggtgccattttgttcccaccatttccacgaactcatcatgaaggatggccgaaaacttgtcgtgccgtgccggccccaggacgagctgattggtagagccaggatcagccaaggggcaggatggtcactacgcgaaactgcctgtctgggcaaggcgtatgctcagatgtgggccctcatgtactttcatagacgggacttgaggctggcatccaacgccatatgctctgctgttcctgtgcactgggtcccaacaagccgtaccacttggagtatccatgcccaccaccagtggatgaccacagaggatatgcttacggtgtggaatcgagtatggattgaggacaacccctggatggaagataaaacccctgttactacatgggaggacgtgccatatctgggcaagcgcgaagatcaatggtgtgggtccctcatcggattaaccagcagagcaacttgggctcagaatattctgacagccatccagcaggtccggtctttgattggtaacgaggagttcctggactacatgccctcaatgaaaaggtttcgcaaggaagaggaacctgagggcgcgatatggtga

SEQ ID NO: 15631 - RNA, 9873 nt, synthetic construct
  misc_feature 1..9873: note = derived and/or modified CDS sequence (opt3) from DENV-3__FJ644564__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgccatcgcaggtgcttgggagaatggcgtctgtgggatacgaagcaccacacgcatggaaaacctcctgtggaaacagatcgccaatgagcttaactatattttgtgggaaaataacatcaagctgacggttgtggtgggagacaccattggcgtactcgagcaggggaaaagaactctgacaccacagcctatggagttaaagtactcatggaaaacctggggaaaggcgaagatcgtcacagccgaaactcaaaacagttccttcataattgatggccccaataccccagagtgccccagcgcttctagggcatggaacgtgtgggaagttgaggactatggttttggggtgttcacgacaaatatctggctgaaacttcgggaagtctacacccagatgtgtgaccaccgcttgatgtcagccgctgtgaaggatgagagagccgttcacgcagacatgggatactggattgagagtcagaaaaacggcagctggaagctcgaaaaagcgtccctgatcgaggtgaagacttgcacctggcctaagtctcatacactatggtcgaatggtgtactggaaagcgatatgataatcccaaaatccctcgccggcccgatttcacagcacaaccataggcccgggtatcacactcaaaccgctggaccttggcacctggagaatcttgagttggactttacatactgcgaaggcacgaccgtcgtgatcactgagaactgtgggacacgtggaccaagtctgcggaccactacagtgtctggcaagttaattcatgaatggtgctgtcgaagctgcaccctcccccctctgagatatatgggtgaggatgggtgttggtacggaatggaaatcaggccaatatccgagaaagaggaaaatatggtcaagtcacttgttagcgccggctctggtaaagtggacaacttcacgatgggcattctgtgcttggcaatcctctttgaggaagtaatgcgcgggaagttcggaaagaaacacatgatcgctggcgtgttctttactttcgtcctgctactgtccgggcagattacctggcgggatatggcccatacactcatcatgattggaagtaatgcaagcgacagaatgggcatgggtgtgacctatctggcccttatagctacttttaagatccagcccttcttggcgctggggtttttcttaaggaaactcacatctcgcgagaacctgcttctgggagttggcctagccatggcaaccacactccaactgccggaagatattgagcagatggctaatggcatcgccttggggctgatggccttaaagctcattactcagtttgagacctaccagctgtggacggctcttatctccctgacatgttcaaacaccatattcactttgaccgtggcatggcgaacagccactctcatcctggcgggagtcagtctactgcctgtgtgccaaagctcgtccatgcggaaaaccgactggcttccaatgacggttgctgccatgggtgtgccccctctccccctgtttattttctctttgaaggatacactgaagcgtagaagctggccattaaatgaaggcgtcatggcagtagggctcgtgtcaatcctggccagttcccttctgaggaacgacgttcctatggctggacccttggtggcaggcggtctcctgattgcctgttatgtcatcaccgggacttctgcggatctaacagtggagaaagctgccgacgtaacctgggaagaggaagcagagcagactggagtgagccacaacctgatgataacagtcgacgatgacggcaccatgcgcattaaggatgacgagacggaaaatatccttactgttctcctgaaaaccgccttgttaatcgtgtccggcatttttccatactcaataccggctacactgctcgtgtggcatacctggcagaagcagacacaacggagcggggtcctgtgggatgtgcctagtcccccagagactcagaaagccgaacttgaggagggagtttacagaatcaagcagcagggtattctgggcaaaacccaagtaggggtgggagtccagaaggaaggcgtgttccacacgatgtggcacgttacaaggggtgcagtgttgactcataacgggaagcgactagagcccaattgggcttctgtcaaaaaggacctgatctcctatggaggcggctggcgcctcagcgcccagtggcaaaaaggggaagaggtgcaggtaattgcggtcgaacctggaaagaacccaaaaaattttcagaccatgcccggtacattccagaccactaccggcgagatcggggccatagcactggatttcaagcctggaacatcgggctcaccgatcattaaccgggagggtaaggtggttgggctttacggaaatggcgtggtcacgaaaaacggcgggtatgtgtctggaatcgctcaaactaatgccgaaccagacggtcccacccctgagttagaagaggaaatgtttaagaaaagaaacctgacaattatggatctccacccaggcagtgggaagaccaggaaatacttgcccgctatcgttcgtgaggcaataaagcgccggctgagaactctcattctggcccctacaagggtggtcgccgctgagatggaagaggcgcttaagggactgccgatccgatatcagaccacggcaactaaatccgaacatacaggccgggagatcgtggacttgatgtgccacgccaccttcaccatgcgcctactgagccccgtaagagtgccaaattacaacctcattatcatggatgaagctcattttactgaccctgcctctatagcagccaggggttatattagcacacgggttgggatgggagaggctgcggccatcttcatgtccgcaacccccccaggcacagctgatgcctttcctcagtcaaatgcacccattcaggacgaggaacgagacatcccagagagaagttggaacagcggcaatgaatggataactgatttcgccgggaagacggtctggtttgtgccgtctattaaagctggaaacgacatcgccaactgtttacgcaagaatggtaaaaaggtgatccaactgtccaggaagaccttcgatacagagtaccagaaaactaagcttaacgactgggattttgtcgtaaccacagacatttcagagatgggcgcgaatttcaaagcagatcgtgtgatcgaccctcggagatgcctgaagcccgttattctcaccgatgggccagaaagggtgatattggccggacccatgcctgtcactgctgccagtgctgcacagcgccgaggcagagtgggtcggaacccacagaaagagaatgaccaatacatctttacggggcagcccctgaacaatgatgaagaccacgcccactggaccgaggctaagatgctcctggacaacattaatacacctgaaggcatcatcccggcccttttcgagccagagagggaaaagagcgcagcgattgatggagagtatcgcctaaaaggcgaatcccgtaagactttcgttgagctgatgagacggggggacttgcccgtgtggttagcccataaagtcgcttctgaaggaataaagtacaccgataggaaatggtgctttgacggtcagcgcaacaatcagatcctggaggagaacatggatgtggaaatttggacaaaggagggcgaaaaaaagaagctccgacctagatggctggacgcccggacctattcggatccccttgcactgaaagagttcaaggactttgctgccgggaggaaaagcatcgcactcgatttggtaactgaaattggacgcgtgccatcacacctggcccatagaacaaggaatgctctagacaacctggttatgctccacacgtccgagcacggcggtcgggcgtaccgtcatgccgtcgaggaacttcctgagaccatggaaactctgttattgctggggctcatgatcctgcttacaggcggagcaatgctgttcctcataagtggcaaggggatcggaaaaacctctattggtttgatctgtgtgattgctagctccggcatgctgtggatggccgagatccccttacaatggatagcctcagcaattgtgctagagtttttcatgatggtcctgctcatcccagaacctgagaagcagcgcaccccgcaggataatcaacttgcttatgttgtgattgggatcctgacattggccgcgataatcgctgccaacgaaatgggactgctcgagactacgaagcgagacctgggcatgtctaaagaacccggtgtagtgagcccaaccagttaccttgatgtcgacctccaccctgcatccgcctggacactgtatgctgtggcaactaccgttattacacccatgttgagacataccatcgagaatagcactgccaacgtgtctctggcggctattgccaaccaggcagtcgtattaatggggctagacaagggctggccaatctcaaaaatggatctgggagtgcctctccttgccctgggctgctactcccaggttaatcccttgacgctgacagctgccgtgctcctgcttataacccactacgcaattatcgggccgggattacaggctaaggccactagggaggcgcaaaaacggaccgccgcaggcatcatgaagaacccaacagtcgacggtattatcactatagatctggaccctgtgatttatgatagtaagtttgaaaaacagctcgggcaggtcatgttgctggtgctatgtgctgttcagctgctccttatgcgcaccagctgggccctgtgcgaggcattgacactggctacgggacccatcaccactctctgggaaggctcgccaggtaagttctggaatacaaccattgccgtgtctatggccaacatctttagaggctcctacctggcgggggctggattagcattcagcataatgaaatcagtaggcactgggaagaggggaacaggcagtcaaggtgagacccttggggaaaaatggaagaagaaactgaatcagctctctcggaaggagtttgacctatataaaaagtccggaatcacggaggtggatcgaaccgaagccaaagagggcctgaagagaggtgaaacaactcatcacgctgtcagccgcggctcagccaaattgcagtggctggttgagaggaacatggtgattcccgaagggcgggtcatcgacctcggatgtggccgtgggggatggagttactattgcgcaggccttaagaaggtgaccgaggtaagaggttacacaaaagggggacctggccacgaggaaccggtgcccatgagcacttatggctggaatattgttaagctgatgtccgggaaagatgtgttctacttgccacctgagaagtgtgacaccctgctctgcgatatcggagaatctagcccctcccctacagtcgaggagtcaaggaccattcgcgtgttaaaaatggtcgaaccatggctgaagaacaatcagttttgtatcaaggtgcttaacccctacatgcctgccgttatagagcatctggaacggctacaacgaaaacacggtggcatgctcgtaagaaatccactgtctaggaacagtactcatgagatgtattggatttcgaatgggacgggaaacatcgtgagctccgtcaatatggtgtctcgcttgctgctcaaccggttcacaatgacccacagacgtcccactatcgaaaaggacgttgatcttggcgctggtaccaggcacgtgaacgcggagccggagacacctaatatggacgtcattggggaacggataaaacgcatcaaggaggaacataactcaacgtggcactacgacgatgagaatccatataaaacctgggcctaccatggaagctatgaagtgaaggcaactggctccgctagttctatgattaacggcgtagtgaagctgttaacaaaaccctgggacgttgtccctatggtgacccagatggccatgactgatacaaccccattcgggcagcaacgagtgtttaaggagaaagtcgacacaagaactcccaggccgatgcctggaacccggaaggttatggagatcacggcagaatggctgtggcgcaccttgggtagaaataaaaggccccgactctgcacacgggaggaattcactaagaaggtgcgtaccaacgccgctatgggcgccgtatttacagaggaaaatcagtgggatagcgcgaaagcagccgtggaggacgaggaattctggaagctggtcgatagagagcgcgaactacacaaacttgggaagtgtggatcatgcgtgtacaacatgatgggcaaaagggagaagaaactgggtgagtttgggaaggctaagggatcccgggccatttggtatatgtggctcggcagtagatacctggaattcgaggcattgggctttctgaatgaagaccattggttcagccgcgagaactcttactccggggttgaaggagagggtctccacaaacttggctatatcctgagggatatatcaaagatcccagggggagctatgtacgccgacgatactgctggctgggacacccgaattacggaggacgatttacacaatgaagagaaaatcacacagcagatggaccctgaacatcggctgttggccaacgcaatttttaagctcacctatcaaaataaagtggtcaaggtgcagagacccactccaacaggtaccgtaatggatatcataagcaggaaggaccagcgcgggtcgggacaggttggcacttacggcctgaacaccttcacaaatatggaggcgcaactagtgcgtcagatggaaggggagggagtcctttctaaagccgatctggagaacccccacctccctgaaaagaaaattacgcagtggctggagaccaagggtgtggaacggttgaaaagaatggctatcagtggcgacgattgcgtggtcaagccaatcgacgataggtttgccaacgcattactggctctcaatgacatggggaaggttcgcaaagatattccgcagtggcaaccctccaagggatggcatgactggcagcaggtgcctttctgtagccaccactttcatgagcttataatgaaagatggccgaaagctggtagtgccatgccggccccaggacgaactaatcggtagagccaggatttcacaaggggcaggatggtccctgcgcgagactgcctgtctcggcaaagcgtatgctcagatgtggtctttgatgtacttccacagacgggacctgaggcttgccagcaacgcaatctgcagtgccgtccctgtgcattgggttccaacatcccgtaccacttggagcattcacgctcatcaccagtggatgacaaccgaggatatgctgacggtgtggaatcgagtctggatcgaagacaacccctggatggaggataagacacctgtgaccacttgggaaaatgtaccgtatctcggcaagcgcgaggaccaatggtgtgggtctttaataggactgacctcaagagccacatgggcacagaacatcccaactgctattcagcaggttcggagtttgatcggtaatgaggaattcctggattacatgccctccatgaaaaggtttcgcaaggaggaagagagcgaaggcgccatttggtga

SEQ ID NO: 15632 - RNA, 9873 nt, synthetic construct
  misc_feature 1..9873: note = derived and/or modified CDS sequence (opt3) from DENV-3__HQ235027__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccattgaaatacagaattcagggggaaccagtatcttcgcaggtcatctgaagtgtcggttaaaaatggacaagctggagctaaaaggcatgagctacgccatgtgcacaaagacttttgtgctcaaaaaggaggtctctgaaacccagcacgggacgattctgatcaaggtggagtacaaaggagaagatgctccctgtaagatacctttctccaccgaggacggccaaggtaaagcgtataacgggcgtcttattacagcaaacccagttgtgactaagaaagatgagcccgtaaatatcgaagccgagccgcctttcggcgaatcaaacatcgtcattggaatcggcgacaatgctttgaagattaactggtacaagaaagggagcagtataggaaagatgtttgaggccaccgcacgcggtgccagaaggatggctatcctgggcgatacagcctgggacttcgggtctgtgggaggcgttctcaattccctgggtaaaatggtgcatcagatttttgggagcgcatatactgcgcttttctcgggcgtctcttgggtgatgaagatcggaatcggcgtactgttgacctggattgggctcaactccaaaaatatatcaatgagttttagctgcatcgctattggaatcattacgctgtacttaggcgccgtggttcaggcagatatgggttgtgtcatcaactggaaggggaaggaactgaaatgcggatccggcatattcgtgacaaatgaggtgcacacctggactgagcagtataagtttcaagccgactctcccaaacggctagctacagccatcgcaggtgcttgggaaaacggcgtctgtgggattcgaagcaccactcgcatggagaatctcctgtggaagcagatcgccaacgaacttaattacattttgtgggagaacaatatcaaactgaccgttgtggtgggagatacaataggcgtactcgaacaggggaagagaacgctgaccccacagcctatggagttaaaatattcatggaagacttggggaaaggcgaaaattgtcacagccgagacccaaaacagttccttcatcattgacggccccaacacaccagaatgccccagcgcttctagggcatggaatgtgtgggaggttgaagactacggttttggggtgttcactaccaacatctggctgaagcttcgggaggtctacacgcagttgtgtgatcatcgcctcatgtcagccgctgtgaaagacgaaagagccgttcacgcagatatgggatattggatagagagtcagaagaatggcagctggaaactggagaaggcgtccctaatcgaagtgaagacatgcacctggcctaaatctcacactctgtggtcgaacggtgtactcgagagcgacatgattatcccaaagtccctggccggcccgatttcacagcataatcacaggcccgggtaccatacccaaacagctggaccttggcaccttggcaaattggaactggattttaactattgcgaggggactaccgtcgtgatcacagagaattgtggaacgcgtggcccaagtttacggaccactacagtgtctggtaagctcatacacgaatggtgctgtcgaagctgcaccctgccccctcttagatacatgggggaggacggatgttggtatggcatggaaattaggccaatctccgagaaagaagagaacatggtcaagtcactggttagcgccggttctggcaaggtggataatttcactatgggggtattgtgcctcgcaatcctgtttgaggaagtgatgcgcggaaaattcggcaagaaacatatgattgctggggtcttctttacattcgtgctactgctctccggacagatcacctggcgggacatggcccacacgctgattatgataggcagtaacgcaagcgatagaatgggtatgggggttacttaccttgccttgatcgctacctttaagattcagcccttcctggcgttaggatttttcctcaggaaactgacatctcgcgagaatcttctgctaggcgtgggcctcgccatggcaaccactctgcaattgccggaagacatcgagcagatggctaacgggattgccctgggattaatggccctcaagctgatcacacagtttgaaacctatcagctttggacagctctgatatccttgacttgttcaaataccatgttcacgctcacagtcgcatggcgaaccgccactctgatcctagcgggtgtgagtctgcttcctgtttgccaaagctcgtccatgcggaagaccgattggctcccaatggctgtggccgcaatgggcgtcccccctctgcccttgtttattttctctctgaaagacacattaaagcgtagaagctggccactcaacgagggggtaatggccgtgggactggtttcaatccttgctagttccctgttgaggaatgatgtgcctatggcaggccccctcgtcgccggtgggctgctaattgcgtgttacgtgatcactggaacctctgctgacctgacggtagagaaagccgcagacataacatgggaagaggaagccgagcagaccggcgtgagccataaccttatgattactgtcgatgacgatggcacaatgcgcatcaaggacgatgaaaccgagaacatcctcactgttctgttgaaaacagctttactggtggtgtccggggtctttccatactcaattccggccaccctcctggtgtggcacacgtggcagaagcagactcaacggagcggagttctttgggacgtacctagtcccccagagacccagaaagcagaactggaggaaggtgtgtatagaataaagcagcagggcatcttcgggaagacacaagtcggagtgggcgttcagaaagagggtgtgtttcataccatgtggcacgtcacaaggggggctgtgttgacttacaatggaaagcgactagagcccaactgggcctctgtaaaaaaggatctgatttcctatggcggcgggtggcgcctcagcgcgcagtggcaaaaaggagaagaggtccaggtgatcgccgttgaacctggtaagaatccaaagaacttccagaccatgcccggcacgttccagacaactaccggggagattggagcaatcgctctggactttaaacctggcacatcgggttcaccgataatcaatcgggaagggaaggtggtcggactttacggcaacggcgtggttaccaaaaatgggggatatgtgtctggtattgcccaaactaacgctgagccagatggccccacccctgagttagaagaggaaatgttcaagaaaagaaatctgacaatcatggacctccacccagggagtggaaagacgaggaagtacttgcccgcaattgtccgtgaggccatcaaacgccggctgagaactctcatactggcccctaccagggtggtagctgcggaaatggaggaggcacttaagggcctgccgattcgatatcagacaaccgccactaaatccgaacatacaggtcgggagatcgtggatttgatgtgccacgctacctttacgatgcgcctactgagccccgttagagtcccaaactacaatctcatcattatggacgaagcccatttcactgatcctgcatctatcgccgctagggggtacataagcacacgggtgggaatgggcgaggcggccgcaatttttatgaccgctacccccccaggcactgccgacgcattccctcagtccaacgcccccatccaggacgaagagcgagatattccagagagatcatggaatagtgggaacgaatggatcacagactttgctggaaagaccgtgtggttcgtcccgagcataaaagccggtaatgatattgcgaactgtttacgcaagaacggcaagaaagtaatccaactgtctaggaagacatttgacactgagtatcagaaaacgaagcttaatgattgggacttcgtggttaccacagatatctccgaaatgggggcaaactttaaagccgaccgtgtgattgatcctcggagatgcctgaagcccgtcatcctcactgacggaccagagagggtgattttggctggccccatgcctgttaccgccgcttcagcagcccagcgccgaggtagagtggggcggaatccacagaaggagaacgatcaatacatattcacaggccagcccctgaataacgacgaagaccacgctcattggaccgaggccaaaatgctcctggataatatcaacactcctgaaggaattatcccggcacttttcgagccagaaagggagaagagtgcggccatcgacggcgagtatcgcctaaaaggggaaagccgtaagacgtttgtcgagctgatgagacggggagatttgcccgtgtggttagctcacaaagtagcctccgaaggtattaagtacaccgacaggaaatggtgcttcgatggccagcgcaataaccagatactggaggaaaatatggacgtggagatctggacaaaggagggggaaaagaaaaagctccgacctagatggctggatgcacggacttattctgacccccttgctctgaaagagtttaaggatttcgccgcaggaaggaaatcgattgccctcgacttggttaccgaaatcggccgcgtcccaagccacctggctcatagaacaaggaacgcgctagataatctggtgatgctccacacctcagagcatggtgggcgggcctaccgtcacgcagtggaagagcttcctgagactatggaaacactgttattgctgggcctcatgattctgcttacgggaggcgctatgctgtttctcatctccgggaagggaataggtaagaccagtatcggcttgatttgtgtcatcgcctctagcgggatgctgtggatggccgagattcccttacaatggatcgcatccgctatagttctagaattctttatgatggtgctgctcattccagagcctgagaaacagcgcactccgcaggacaaccaacttgcctatgtagtgatcggaattctgacattggcggctatcatagccgcaaatgaaatgggcctgctcgagaccaccaagcgagatctgggtatgtcaaaagaacccggggtcgtgtctccaacaagctaccttgacgttgacctccaccctgccagtgcttggactctgtacgcagtggccacgaccgtcatcacacccatgttgagacatactattgagaactccaccgcgaatgtaagcctggctgccatcgcaaaccaggccgtggttttaatgggcctagataagggatggccaatttctaaaatggacctgggcgtgcctctccttgctctggggtgctattcacaggtcaaccccttgacactgaccgccgcagtgctcctgcttatcactcactacgctataattggaccgggcttacaggccaaggcgacgagggaagcccaaaagcggacagcagctggtatcatgaaaaatccaaccgtcgatgggatcatgactattgacctggatcctgtgatctatgactccaagttcgagaaacagctcggacaggttatgttgctggtgctatgtgccgtacagctgctccttatgcgcaccagttgggcactgtgcgaggctttgacactggccactggccccataaccacactctgggaaggtagcccaggcaagttttggaacacgaccattgccgtgtcgatggcgaatatcttcagagggtcttacctggctggagcaggcttagccttttccattatgaaaagcgtcgggactggaaagaggggcacaggttcacaaggggagacccttggagaaaagtggaaaaagaaactgaaccagctcagtcggaaggagttcgatcgatataaaaagtctggcatcactgaagttgacagaacagaggctaaagagggtctaaagcgcggcgaaaccacgcatcacgccgtgtccagggggagcgcaaagctgcagtggtttgtcgagcggaatatggtgatacccgaaggacgtgtaatcgatttgggctgtgggagaggaggctggtcatactattgcgccggtctgaaaaaggtgaccgaggttagggggtacacaaaaggaggccctggccatgaagagccggtgcccatgagtacttacgggtggaacattgtcaagctcatgagcggaaaagacgtgttctatcttccacctgagaagtgtgataccctgttgtgcgacatcggtgaatcctctcccagccctacagtcgaggaatcccgcactattcgggtgctgaagatggttgagccatggctcaaaaataaccagttctgtatcaagattttaaatccctacatgcctaccgtaatcgagcacctggaacgacttcaaagaaaacacggcgggatgctggtgaggaacccactatcacgcaattctacacatgagatgtattggataagtaacggaaccggcaatattgtcgcttcggtgaacatggttagccggctcctgttgaatagatttactatgacgcaccgtaggcccacaatcgaaaaggatgtggacctgggtgcggggacccggcatgtcaacgccgagccggaaactcctaacatggacgtgatcggagagcgcattaaacgaataaaggaggaacacaattccacctggcactacgatgacgagaacccatataagacatgggcataccatggctcttatgaagtaaaagctacgggctcagccagctccatgatcaatggggtggttaagctccttaccaaaccctgggatgtcgtgcctatggtgactcagatggcaatgacagacaccactccattcggacagcaaagagtctttaaggagaaagttgatacaaggaccccccggagtatgccgggtacacgcagagtgatgggcattactgccgaatggctgtggaggaccttagggcgaaacaagaagcctcggctgtgcacgcgtgaggagttcaccaaaaaggtaagaacaaatgctgccatgggagcggtgtttactgaagagaaccagtgggactctgcaaaagccgctgtcgaagatgaggacttctggaagttggtggatcgcgaaagggagctccacaaactgggcaagtgtggtagctgcgtttacaatatgatggggaaacgggagaagaagctaggagaatttggcaaagccaagggctcaagagcaatctggtacatgtggcttggggctcgctatctggagttcgaagccctcggatttctgaacgaggaccattggttctccagggagaatagttacagcggtgtggaaggcgaggggttgcacaaactgggatatattctccgagatatctctaagatacccggcggtgctatgtacgccgacgacaccgcagggtgggatacacggatcactgaagacgatcttcataacgaggaaaaaattacccagcagatggacccagagcacagacaactggcgaatgccatctttaagttaacgtatcagaacaaggtcgtgaaagtacagaggcctacacccaccggaactgttatggatattatctcccgcaaggaccagcgtggctcaggccaagtggggacatacggactgaataccttcactaacatggaggctcagttgatacggcagatggaaggtgagggcgtcctcagcaaagccgatctggaaaatccacacctacccgagaagaaaattacccagtggcttgaaacaaagggggtggagagactgaagaggatggcaatctcgggagacgattgcgtggtcaaacctatcgacgatcgctttgctaacgccctcctggcattgaacgacatgggcaaggttcgaaaagatattccacaatggcagccgtctaagggttggcatgactggcagcaggtgcccttctgtagtcaccatttccacgagttaataatgaaagacgggcggaagctggtagtgccttgcagaccacaagatgaactcatcggaagggcccgcatttcccagggcgcgggctggagccttagagagacggcttgtctggggaaggcctatgcacagatgtggtcactaatgtactttcaccggagggacctgcgtctcgcctccaatgctatctgctctgccgtccccgtgcattgggttcctaccagccgaactacatggagtattcacgcacatcaccaatggatgaccactgaagatatgttgacagtgtggaaccgcgtctggatcgaggacaatccatggatggaagataaaacccccgtgacgacatgggaggacgtaccttacctgggaaagagagaggatcagtggtgtggttcccttataggcctgaccagccgggctacttgggcccagaacatcccgaccgcgattcagcaagttaggtctctcatcgggaatgaagagttcttagactatatgccatcaatgaaacgctttagaaaggaagaggagagtgaaggagctatttggtga

SEQ ID NO: 15633 - RNA, 9873 nt, synthetic construct
  misc_feature 1..9873: note = derived and/or modified CDS sequence (opt3) from DENV-3__JQ920476__SS-prME
  source 1..9873: mol_type = other RNA
accagcctgtgcctcatgatgatgcttcccgccacactggctttccacttgacttcccgagacggagaacctaggatgatcgtggggaaaaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctcctgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccaaacgcttctagagcatggaatgtctgggaagtggaggactacggtttcggggtttttactaccaacatctggcttaaattgagggaaatgtatacgcagctctgtgaccaccggctgatgtcagccgctgtgaaggatgagcgcgccgtccacgcagacatgggatactggatagagagtcagaaaaatggcagctggaagctagaaaaggcgtccctgatcgaggtgaaaacatgcacctggcccaagtctcatactctctggtcgaacggtgttctggaaagcgatatgattatccctaaatcccttgccggcccaatttcacagcacaattacagaccggggtatcatacccaaacagctggaccctggcacttgggcaagctggagttagacttcaactactgcgaggggactaccgtggtaatcacagaaaattgtggaacgaggggccctagtctccgtaccactacagtctctggtaaactgatacacgagtggtgctgtcggagctgcacccttccacccctgcgatatatgggggaagatggatgttggtacggcatggagattagacctatcaacgaaaaggaggagaatatggtgaagtccttggtgtcagccggtagcggcaaagcagacaactttactatgggggtcctctgcctggctatcctattcgaagaggttatgaggggaaagttcggcaaaaagcatatgattgccggggcactgtttacattcgtgctcctgctttctggacagatcacctggcgcgatatggcccacacgttgattatgataggctccaatgctagtgaccggatgggtatgggggtaacttatctggcgttaatcgccacctttaaaattcagccattcctcgcactgggatttttccttagaaagctgacaagcagggaaaacctactcctgggcgtgggcttggctatggccaccactctgcaattacccgaggatatcgaacagatggccaatgggattgctctcggactgatggcacttaagctgatcacacagtttgagacctaccagttgtggacagccctcgtctctctgatgtgttccaacactatattcaccctaacggtggcgtggcgcacagctaccctgatccttgccgttatttcactcctgccggtgtgccaaagtagctcgatgcgaaaaactgactggttgcctatgaccgtcgcagccatgggtgtgccacccctgcctttatttatcttctccctcaaggatacactgaaacggcgttcttggccccttaatgagggcgttatggctgtggggctggtcagcattttggcatcaagttttctcagaaacgacgtaccaatggccggacctctggtggcgggcggtctactgatcgcttgttatgttataactgggacctccgccgatcttacggtggaaaaggcagccgacgtcacatgggaggaagaggctgaacagaccggagtgtctcataacctcatgattactgtagacgatgacggcacaatgaggatcaaagatgacgagaccgagaatatcctgactgtgttgttaaagacagccctgctcattgtcagcggcatattcccctactccatcccagcaaccctgcttgtttggcacacgtggcagaaacagactcaacgctcaggggtgctgtgggatgtgccgagccctcccgaaacccagaaggctgagttggaagagggagtctaccggattaagcagcagggtatctttggcaaaacacaagtgggggttggagtacagaaggagggcgtgttccataccatgtggcacgtcacaagaggtgccgtgctaactcacaacgggaaaaggctggaaccaaattgggcgaacgttaagaaagacctcattagttatggaggcggctggaagctgtctgcccagtggcaaaagggggaggaagtgcaggtcatcgcagtggagcccggcaagaatcctaagaacttccagaccatgccaggtatatttcagacgacaactggcgaaatcggggctattgcccttgatttcaaacccggaacctccggcagccctatcattaatcgagagggtaaggtagtcgggttatacggaaacggcgtggttaccaagaatggcgggtatgtgtcgggaatcgctcaaaccaacgcagagccggacggtccaactcccgaactggaggaagagatgtttaagaagcgcaatctcaccataatggatttgcatcctggctcagggaaaacacggaagtacctgccagccattgtcagagaagccatcaaaaggcgtctccgcacgctgatccttgctcccactcgggtggttgcggcagagatggaggaagccctgaagggattgcctattagatatcagaccacagctaccaaatctgagcacactggcagggaaatcgtggacctaatgtgccatgccacattcaccatgcgactgctcagtccggtccgggtgcccaactacaatttaatagtaatggatgaggcacactttacggacccagcctccattgctgcgcgcggttatatcagcactagagtggggatgggagaagccgcagctattttcatgacagccacccctcccggcaccgcagatgcctttccacagtctaacgctcctatccaggacgaggagagggacatacccgaacggagctggaactccggcaacgagtggattactgatttcgccgggaagacagtttggtttgtcccatcaatcaaggcgggaaacgacatcgcaaattgtctgagaaagaatggtaagaaagtgattcaacttagtagaaagaccttcgatacagaataccagaaaactaagctgaatgactgggattttgtggtcacgaccgacatcagcgagatgggcgccaacttcaaggctgatcgcgtaattgacccgaggcgttgcctcaaacctgtgatattgacagatgggcccgagcgggttatcctggccggaccaatgcccgtgactgtcgcttctgcagcccagagaaggggccgcgtgggtcgaaatcctcagaaggaaaacgaccaatacattttcaccgggcagccactcaataacgatgaggaccatgctcactggacagaagccaaaatgctgcttgacaatatcaacacccccgagggcatcattcctgcactatttgaaccggagagagagaagtccgcggccatagatggagaatatcggctgaaaggcgagtcaaggaagactttcgttgaattgatgcgccgtggggacttaccagtgtggctggctcacaaagtcgccagtgagggaatcaagtacacggatagaaagtggtgctttgacggtgaacggaataaccagattctcgaggagaatatggatgtggaaatctggaccaaagagggcgaaaagaaaaagctgaggccccgctggcttgacgcacgaacatatagcgatcctctggctctcaaagagttcaaggactttgccgcagggagaaagtccattgccttggatctggtaactgaaatcggacgggtgccctctcatctagctcacaggacccgcaacgcgctggacaatctcgttatgcttcatacatcggagcacggcggtagagcctacaggcacgcagtcgaggaactgccagagaccatggaaactttattgctgctcgggctgatgatacttctgacaggcggagctatgctattcttgatcagcggcaaagggattggaaagacgtcaatcggtctgatttgtgtggtggcctccagtggcatgttatggatggccgatgtccctctacagtggatcgcatctgctatagttctggagtttttcatgatggtgctccttattcccgagccagaaaaacaacggacccctcaggacaaccagctggcctatgtagtgatcgggattttgactctggcggctatcgtcgccgcaaatgagatgggactcctggaaacaaccaagcgtgatcttggcatgagcaaagagtccggtgtggtttcaccgacctcttacctcgacgtggacctgcatcccgccagcgcttggacattgtatgcagtcgccactacggtaataaccccaatgctgcgccacacaatcgaaaacagtactgcgaacgtgtccttagctgccattgcaaatcaagccgttgtgctaatggggctggataagggctggcctatcagcaagatggacctcggagtcccccttctggctttgggctgctactctcaggtgaacccactgaccctcacagccgcagtcctgcttttagtgacccattacgctattatcgggcctggactgcaggccaaagcgactcgagaggcccagaagagaacggcagctggcataatgaaaaatcccacagttgatggtattatgaccatcgacctcgatccggtgatctatgactcaaagtttgagaaacaattggggcaggtaatgctgctagtgctgtgtgccgtccagctccttctgatgaggacttcctgggcattctgcgaagctctaaccctggccacaggaccaattactaccctctgggagggcagtcctggtaagttttggaacacaacgatcgccgttagcatggcgaatatattccggggctcgtacctggctggggcaggattagccttttctattatgaagtccgtgggcaccgggaaacgcggaactggcagccagggtgaaacacttggggagaagtggaaaaagaaactgaaccaactctcaagaaaggagttcgatctatataaaaagagtggaatcaccgaggtcgacaggactgaggctaaggaaggcctgaaacggggtgagattacacaccatgccgtgtctcgaggctccgcaaagttgcagtggttcgtagaaagaaatatggtgatccccgaggggcgcgttatagatctgggatgtggcagagggggatggagctactattgcgccggcctcaaaaaggtgaccgaagtccggggttacacgaaagggggaccaggccacgaggagcccgtgcctatgtcaacctatggctggaacatcgtcaaacttatgagtgggaaggacgtgttttacctgccgcccgaaaaatgtgatacattgctgtgcgacattggagagagctccccatctcctactgttgaagagagccgtaccatcagagtactcaagatggtggagccctggttgaaaaataaccagttctgtattaaggtcctgaatccttacatgccaacagtgatcgaacaccttgagaggctgcagcgcaaacatggtggcatgctagttcggaaccccctctcccgaaattcaactcacgaaatgtattggatttctaacgggaccggaaatatcgtgagttcggtcaacatggtgagcagactgttgctgaacaggtttacaatgacccatcgccggcctactatagagaaggatgtagacctcggcgctggtacgagacacgtgaatgcggaaccagagacacccaacatggacgttattggggagcgtatcaggcggatcaaggaagaacactcctctacctggcattacgatgacgaaaatccgtataaaacttgggcctaccacggatcatatgaggtcaaggcaaccggcagcgcttccagtatgattaacggcgtggtgaaacttctgacaaagccttgggatgtcgttccaatggtgacgcaaatggccatgaccgacactacacccttcgggcagcagcgcgtatttaaagaaaaggtggatacccgaactcctagaccaatgcccggaacaaggaaggtcatggagataaccgcagagtggttatggcggacactgggtcgcaataaaagaccgaggttgtgcactcgagaagagttcatcaagaaagtgcggaccaacgccgctatgggcgccgtttttacggaagagaatcaatgggactctgcgcgtgcagccgtggaagatgaggagttctggaagctcgtcgacagagaacgcgagctgcataaactagggaagtgtggaagctgcgtgtacaacatgatgggcaaaagggaaaagaaacttggtgagtttgggaaagctaagggatcacgggccatttggtatatgtggctgggcgcaagatacctcgagttcgaagctctgggctttttgaatgaggatcactggttctcccgcgaaaacagtcatagcggggtagagggagaaggtctgcacaaactcggctacatccttagggacatttctaagatccctgggggagccatgtatgctgatgacaccgccggctgggacacacgaataactgaggatgacctgcacaatgaggagaaaatcacccagcagatggatcccgagcatcggcagttagcaaacgcgatttttaagctgacataccaaaataaggttgtgaaagtccagagaccaactcctaagggtaccgtgatggacatcatttccaggaaagatcagcgcgggtcaggacaggtgggcacgtatggcttgaacacattcaccaatatggaagcccaactcatccgtcagatggagggggaaggagtcctgagcaaggctgacctagagaacccccaccttctggagaaaaaggttactcagtggctcgaaacaaagggtgtggagcggctgaaaagaatggccatatcgggcgatgactgcgtagtgaagccaattgatgacaggttcgcaaacgctttgttagccctgaatgatatggggaaagtccgcaaggacatcccccagtggcaaccttctaaaggatggcatgattggcaacaggtgccattttgtagtcaccacttccatgaactcatcatgaaggacggccgaaaacttgttgtgccgtgccggccccaggacgagctgattggtagagcaaggatatcccaaggggccggatggagcctacgcgaaaccgcgtgtctgggcaaggcttacgcccagatgtgggcactcatgtattttcacagacgggatttgaggctggcctcaaacgctatctgctccgccgtccctgtgcattgggtaccaacttctcgtaccacatggagcattcacgcacatcaccagtggatgacgaccgaggacatgcttactgtttggaatcgagtgtggatcgaggataacccctggatggaagacaagacacctgtcaccacttgggaggatgtgccatacctgggcaaacgcgaagaccaatggtgtgggagtctcattggattaacatccagagctacctgggcccagaatatcctgacggcgatacagcaggttcggagcttgatcggtaacgaggagttcctggattatatgccctctatgaagaggtttcgcaaagaagaggaatcagagggcgctatttggtga

SEQ ID NO: 15634 - RNA, 9873 nt, synthetic construct
  misc_feature 1..9873: note = derived and/or modified CDS sequence (opt3) from DENV-3__JQ920477__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaagtctttactgtttaagacggcatcaggtattaatatgtgtaccctgatagccatggatctcggcgagatgtgcgacgatacagtcacttacaagtgtccactgatcaccgaagttgagccggaagacattgattgctggtgtaaccttacaagtacctgggtgacttatgggacatgcaatcaggcgggagagcaccgccgagacaagcgtagcgtagctctggcaccccacgtgggcatgggtttggataccaggacgcagacttggatgtccgcagagggggcctggaggcaggtcgaaaaggtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataagcccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgctcttagagcatggaacgtctgggaagtggaggactacggtttcggggtttttactaccaatatctggttgaaactcagggaaaagtatacgcagctgtgtgaccaccggctaatgtcagccgctgtgaaagatgagcgcgccgtccacgcagacatgggatactggatagagagtcagaagaacggcagctggaagctggaaaaagcgtccctcatcgaggtgaagacatgcacctggcccaaatctcatactctgtggtcgaatggtgttcttgaaagcgatatgattatccctaagtccttggccggcccaatttcacagcacaactacagaccggggtatcatacccaaacagctggaccctggcacctgggcaaattagagctcgacttcaattactgcgaggggactaccgtggtaatcacagaaaactgtggaacgaggggccctagtctgcgtaccactacagtctctggtaaacttatacacgagtggtgctgtcggagctgcaccctgccacccttgcgatatatgggggaagatggatgttggtacggcatggagattagacctatcaatgaaaaggaggagaacatggtgaaatccctcgtgtcagccggtagcggcaagactgacaattttacaatgggggtcctgtgcctagcaatcctgttcgaagaggttatgaggggaaaattcggcaagaaacatatgattgctggggccctctttaccttcgtgctgcttttgtctggacagatcacgtggcgcgatatggcacacactctgattatgataggctccaacgccagtgaccggatgggtatgggggtaacctatttagctctcatcgcgacatttaagattcagccattcctggcccttggatttttcctgagaaagctaaccagcagggaaaatctcctgttgggcgtgggcctggcaatggctactacattacaactccccgaggatatcgaacagatggccaacgggattgccctgggacttatggctctgaaattgatcacccagtttgagacataccagctctggactgcactggtctctctaatgtgttccaataccatattcacgctgacagtggcctggcgcaccgcgactcttatcctcgctgttatttcactgttgccggtgtgccaaagtagctcgatgcgaaagaccgactggctgcctatgacagtcgccgcaatgggtgtgccacccttacctctctttatcttctccctgaaagatactcttaagcggcgttcttggcccctgaacgagggcgttatggccgtggggttggtcagcattctcgcttcaagttttctgagaaatgacgtaccaatggcaggacctctagtggccggcggtctgcttatcgcgtgttatgttataaccgggacgtccgctgatctcacagtggaaaaagccgcagacgtcacctgggaggaagaggccgaacagactggagtgtctcataacctgatgattacagtagacgatgacggcaccatgaggatcaaggatgacgagactgagaacatcttgacagtgttactgaaaaccgctctcctgattgtcagcggcatattcccctactccatcccagccacgcttctggtttggcacacttggcagaagcagacccaacgctcaggggtgttgtgggatgtgccgagccctcccgaaacacagaaggcagagctagaagagggagtctaccggattaaacagcagggtatctttggcaagacccaagtgggggttggagtacagaaagagggcgtgttccatacaatgtggcacgtcactagaggtgctgtgctgacccacaatgggaagaggctcgaaccaaactgggccaatgttaaaaaggacctgattagttatggaggcggctggaaactttctgcgcagtggcaaaaaggggaggaagtgcaggtcatcgccgtggagcccggaaagaaccctaaaaatttccagacgatgccaggtatatttcagacaactaccggcgaaatcggggcaattgctttagatttcaagcccggaacatccggcagccctatcattaaccgagagggtaaagtagtcgggctgtacggaaatggcgtggttaccaagaacggcgggtatgtgtcgggaatcgcccaaactaatgctgagccggacggtccaacccccgaactcgaggaagagatgtttaagaaacgcaacttgacaataatggatctgcatcctggctcagggaagacgcggaaatacctcccagcaattgtcagagaagccatcaagaggcgtctgcgcactcttatcctggcccccacccgggtggttgctgcggagatggaggaagcattgaaaggactacctattagatatcagacaaccgccactaagtctgagcacacaggcagggaaatcgtggacctgatgtgccatgctaccttcacgatgcgactcttaagtccggtccgggtgcccaattacaacctgatagtaatggatgaggcccactttactgacccagcatccattgccgctcgcggttatatcagcacaagagtggggatgggagaagcggccgcaatttctatgaccgctacccctcccggcactgccgatgcattcccacagagcaatgcccctatccaggacgaggagagggacatacccgaacggtcctggaactcaggcaatgagtggattacagattttgctgggaagaccgtttggttcgtcccaagtatcaaagccggaaacgacatcgcgaactgtcttcgaaagaatggtaaaaaggtgattcaactgagcagaaaaacatttgatactgaataccagaagacgaagctcaacgactgggatttcgtggtcaccacagacatctctgagatgggcgcaaattttaaagccgatcgcgtaattgacccgaggcgttgcttgaagcctgtgatactgactgatgggcccgagcgggttatcctcgctggaccaatgcccgtgaccgtcgcctccgctgcacagagaaggggccgcgtgggtcgaaactcacagaaagaaaatgaccaatacattttcacagggcagcctctgaacaatgatgaggaccatgcccactggaccgaagctaagatgcttctagacaacatcaatactccagagggcatcattcccgccctgttcgaacctgagagagagaaaagtgcagcgatagatggagaatatcggttgaagggcgagagcaggaaaacgtttgttgaattaatgcgccgtggggacctgccggtgtggctcgcccacaaggtcgcttccgagggaatcaagtacaccgatagaaaatggtgcttcgacggtgaacggaacaatcagattctggaggagaacatggatgtggaaatctggacaaaggagggcgagaagaagaaacttaggccacgctggctggacgcccgaacttattctgatcccctcgcattgaaggagtttaaggacttcgctgccgggagaaaatcgattgcactggatctagtaaccgaaatcggacgggtgcctagccatctggcccacaggacacgcaatgctctcgacaaccttgttatgctgcatacctcagagcacggcggtagagcgtacaggcacgccgtcgaggaattacccgagactatggaaacattgctgctcctggggcttatgatactgctcacgggcggagcaatgttgtttctgatctccggcaaggggattggaaaaaccagtatcggtttaatttgtgtggtggcttctagcggcatgctatggatggccgatgtcccactgcagtggatcgcctccgcaatagttctcgagttctttatgatggtgcttctgattcctgagcccgaaaagcaacggactccacaggacaatcagttggcttatgtagtgatcgggattctgacactcgccgcgatcgtcgctgccaacgagatgggactgcttgaaaccaccaaacgtgatctcggcatgtcaaaggagcctggtgtggtttctccgacaagctacctggacgtggacttgcatcccgcaagtgcctggactctgtatgctgtcgcaacgaccgtaataacaccaatgttacgccacactatcgaaaattccaccgccaacgtgagcctagcggctattgccaaccaagcagttgtgctgatggggctcgataagggctggcctatctctaaaatggaccttggagtccccctgttggccctgggctgctactcacaggtgaatccactcacactgaccgctgccgtccttttactggtgactcattacgcaattatcgggcctggactccaggctaaggccacgcgagaggcgcagaaaagaacagccgcaggcataatgaagaaccccaccgttgatggtattatgactatcgacttggatccggtgatctatgactccaaattcgagaagcaactggggcaggtaatgctactggtgctctgtgctgtccagcttctgttgatgaggaccagttgggccttttgcgaagcactgacactcgctactggaccaattaccacactgtgggagggcagccctggtaagttctggaatacgaccatcgccgtttcgatggccaacatatttcggggctcttacttagcgggggctggacttgcattctccattatgaaaagcgtgggcactgggaagcgcggaacaggctcacagggtgaaaccctgggggagaaatggaagaaaaagctcaatcaactaagtagaaaagaatttgatctgtataagaagtctggaatcactgaggtcgacaggacagaggccaaagaaggcttgaagcggggtgagattacccaccatgctgtgtcccgaggcagcgccaaactgcagtggttcgtagaaagaaacatggtgatccccgaggggcgcgttatagatctcggatgtggcagagggggatggtcatactattgcgcaggccttaagaaagtgacggaagtccggggttacaccaaagggggaccaggccacgaggagcccgtgcctatgagtacatatggctggaatatcgtcaagctgatgagcgggaaagacgtgttctacttgccgcccgaaaagtgtgatactctgctctgcgacattggagagtcctctccaagccctaccgttgaagagtcccgtacaatcagagtattaaaaatggtggagccctggctgaagaacaatcagttttgtattaaagtccttaacccttacatgccaactgtgatcgaacacctggagaggctacagcgcaagcatggtggcatgctcgttcggaatcccctgtcacgaaactctacccacgaaatgtattggattagtaatgggacaggaaacatcgtgtcgagcgtcaatatggtgtccagattgctgctcaacaggttcaccatgactcatcgccggcctacgatagagaaggatgtagaccttggcgccggtacaagacacgtgaacgctgaaccagagacccccaatatggacgttattggggagcgtatcaggcggatcaaagaggaacactcttcaacttggcattacgatgacgaaaacccgtataagacctgggcgtaccacggaagctatgaggtcaaagccacaggctccgcaagttctatgattaatggcgtggtgaagctgttaacgaaaccttgggatgtcgttccaatggtgacccaaatggctatgactgacacaaccccctttgggcagcagcgcgtattcaaggaaaaggtggatactcgaacacctagaccaatgcccggaaccaggaaagtcatggagataacagccgagtggctgtggcggactttgggtcgcaacaagagaccgaggctctgcacccgagaagagtttatcaaaaaggtgcggacgaatgcagccatgggcgctgttttcaccgaagagaaccaatgggacagcgcccgtgcggcagtggaagatgaggagttttggaaactggtcgacagagaacgcgagctacataaacttgggaaatgtggatcatgcgtgtacaatatgatgggcaagagggaaaagaaactgggtgagttcgggaaggccaaaggatcccgggctatttggtatatgtggctcggcgccagatacctggagtttgaagcattgggcttcctgaacgaggatcactggtttagtcgcgaaaatagccattctggggtagagggagaaggtctccacaaacttggctacatcctgagggacatttccaaaatccctgggggagctatgtatgccgatgacacagctggctgggacactcgaataaccgaggatgacttacacaacgaggaaaagatcacacagcagatggatcccgagcatcggcagctggccaatgcaattttcaagttgacttaccaaaacaaagttgtgaaggtccagagaccaacccctaaaggtacggtgatggacatcatttcaaggaaggatcagcgcgggagcggacaggtgggcacatatggcctcaatacctttactaacatggaagcgcaactgatccgtcagatggagggggaaggagtcctatcgaaagccgaccttgagaatccccatctgctcgagaagaaggttacacagtggctggaaaccaaaggtgtggagcggttgaagagaatggctatatctggcgatgactgcgtagtgaaaccaattgatgacaggttcgccaacgcattactggctctcaacgatatggggaaggtccgcaaagacatcccccagtggcaacctagtaagggatggcatgattggcaacaggtgccattctgttcccaccactttcatgaacttatcatgaaggacggccgaaaactggttgtgccgtgccggccccaggacgagctaattggtagagccaggataagccaaggggcaggatggtcactgcgcgaaactgcctgtctcggcaaggcgtacgctcagatgtgggccttgatgtatttccacagacgggatctgaggcttgcatccaatgccatctgctctgctgtccctgtgcattgggtaccaaccagccgtacaacgtggagtattcacgcccatcaccagtggatgaccactgaggacatgctgacagtttggaaccgagtgtggatcgaggataatccctggatggaagacaaaacccctgtcactacatgggaggatgtgccatacctcggcaagcgcgaagaccaatggtgtgggtccttaattggactgaccagcagagcaacgtgggctcagaacatcttgacagccatacagcaggttcggtctctgatcggtaatgaggagtttctcgattatatgccctcaatgaaaaggttccgcaaggaagaggaaagtgagggcgcgatttggtga

SEQ ID NO: 15635 - RNA, 9873 nt, synthetic construct
  misc_feature 1..9873: note = derived and/or modified CDS sequence (opt3) from DENV-3__JQ920478__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaaatctttactgtttaagacggcctcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtagggggactagcatttttgcaggacatctgaaatgtcggttaaagatggacaaactggagctaaagggtatgtcttatgccatgtgcctcaatgctttcgtgctgaaaaaggaggtctccgaaacccagcacggcacgatacttatcaaggtggagtacaaaggggaagatgcgccatgtaagattcccttctcaaccgaggacggacaaggcaaagcacataacggtcgtttgatcacagccaaccctatagttactaagaaagaggaaccagtgaatattgaggctgaacccccgtttggggagagcaacatcgtaatcggcattggagataaggccctgaagatcaattggtacaaaaagggcagttctattgggaaaatgttcgaagcaaccgcccgcggagctagaaggatggccatactcggtgacacagcatgggattttggctccgtcgggggagtgctgaacagccttggcaagatggttcaccagatcttcggttcggcgtatactgctctgttttctggggtgtcctggattatgaaaatcggcatcggagtcttgctcacctggattggcctaaattcaaagaacacgagtatgagcttctcctgcatagtgatcgggattatcacattatacctgggagccgtagtgcaggcagacatgggctgtgttattaattggaagggtaaagagctaaagtgcgggtctggaatctttgtcaccaacgaggtgcatacttggacagaacagtataaattccaagccgatagccctaagcggctcgctaccgccatagcaggcgcttgggagaatggtgtgtgtggcatccgatcaactacccgcatggaaaacctgctttggaaacagattgccaatgagttgaactacatcctgtgggaaaataacattaagctcacaatcgtcgttggggacgtgataggagtgctggagcagggcaaaagaacgttaacaccccagccaatggagctgaagtatagttggaagacttgggggaaagcgaagattgtaacagccgaaacccaaaattccagctttatcattgatggacctaacacacccgagtgcccatctgctcttagggcatggaacgtctgggaagtggaggactacggcttcggtgtttttactaccaatatctggttgaaactccgggaaaagtatacgcagctgtgtgaccaccgcctaatgtcagccgctgtgaaagatgagagagccgtccacgcagacatggggtactggatagagagtcagaagaacggaagctggaagctggaaaaagcgtccctcatcgaggtgaagacatgcacctggcccaaatctcatactctgtggtcgaatggcgttcttgaaagcgatatgattatccctaagtccttggccggtccaatttcacagcacaactacaggccgggctatcatacccaaacagctgggccctggcacctgggaaaattagagctcgacttcaattactgcgagggcactaccgtggtaatcacagaaaactgtgggacgcgtggacctagtctgcggaccactacagtctctggcaaacttatacacgagtggtgctgtcgaagctgcaccctgccacccttgagatatatgggtgaagatgggtgttggtacggaatggagattaggcctatcaatgaaaaggaggagaacatggtgaaatccctcgtgtcagccggcagcggtaagactgacaattttacaatgggcgtcctgtgcctagcaatcctgttcgaagaggttatgcgcgggaaattcggaaagaaacatatgattgctggcgccctctttaccttcgtgctgcttttgtctgggcagatcacgtggcgggatatggcacacactctgattatgataggatccaacgccagtgacagaatgggcatgggtgtaacctatttagctctcatcgcgacatttaagattcagccattcctggcccttgggtttttcctgaggaagctaaccagccgcgaaaatctcctgttgggagtgggcctggcaatggctactacattacaactccccgaggatatcgaacagatggccaacggcattgccctggggcttatggctctgaaattgatcacccagtttgagacataccagctctggactgcactgatatctctaatgtgttccaataccatcttcacgctgacagtcgcctggcgaaccgcgactcttattctcgctgtgatctcactgttgccggtttgccaaagtagctcgatgcggaagaccgactggctgcctatgacagtggccgcaatgggagtcccacccttacctctctttattttctccctgaaagatactcttaagcgtagatcttggcccctgaacgagggtgtgatggccgttggcttggtgagcatcctcgcttcaagttttctgaggaatgacgtcccaatggcagggcctctagtagccggaggcctgcttatagcgtgttatgtgattaccggtacgtccgctgatctcacagttgaaaaagccgcagacgtgacctgggaggaagaggccgaacagactggggtctctcataacctgatgatcacagtggacgatgacggaaccatgcgcatcaaggatgacgagactgagaacattttgacagtattactgaaaaccgctctcctgatagtgagcggcatcttcccctactccattccagccacgcttctggtctggcacacttggcagaagcagacccaacggtcaggcgttttgtgggatgtgccgagccctcccgaaacacagaaggcagagctagaagagggggtgtacagaatcaaacagcagggaatttttggtaagacccaagtcggcgtgggggttcagaaagagggagtattccatacaatgtggcacgtgactaggggcgctgtcctgacccacaatggtaagcgactcgaaccaaactgggccaatgtgaaaaaggacctgatcagttatgggggaggctggaaactttctgcgcagtggcaaaaaggcgaggaagttcaggtgatagccgtcgagcccgggaagaaccctaaaaatttccagacgatgccaggaatctttcagacaactaccggtgaaattggcgcaatcgctttagatttcaagcccgggacatccggaagccctattatcaaccgcgagggcaaagtggtaggtctgtacgggaatggagtcgtgaccaagaacggcggctatgtttcggggatagcccaaactaatgctgagccggacggaccaacccccgaactcgaggaagagatgtttaagaaacggaacttgacaattatggatctgcatcctggttcaggcaagacgagaaaatacctcccagcaatcgtgagggaagccatcaagcgtcgcctgcggactcttattctggcccccaccagagtcgtggctgcggagatggaggaagcattgaaagggctacctatcaggtatcagacaaccgccactaagtctgagcacacaggacgagaaatagttgacctgatgtgccatgctaccttcacgatgcggctcttaagtccggtgcgcgtccccaattacaacctgattgtgatggatgaggcccactttactgacccagcatccatcgccgctagaggctatattagcacaagggtaggtatgggggaagcggccgcaatcttcatgaccgctacccctcccggaactgccgatgcatttccacagtctaatgcccctatacaggacgaggagcgggacattcccgaacgaagctggaactccggcaatgagtggatcacagatttcgctggcaagaccgtgtggtttgttccatcaatcaaagccgggaacgacattgcgaactgtcttagaaagaatggcaaaaaggtcatccaactgagtcgcaaaacattcgatactgaataccagaagacgaagctcaacgactgggattttgtggtgaccacagacattagcgagatgggtgcaaatttcaaagccgatagggtcatagacccgcgtcggtgcttgaagcctgtaatcctgactgatggccccgagagagtgattctcgctgggccaatgcccgttaccgtggcctctgctgcacagaggcgcggacgagtcggcagaaactcccagaaagaaaatgaccaatacatcttcacaggtcagcctctgaacaatgatgaggaccatgcccactggaccgaagctaagatgcttctagacaacatcaatactccagaggggattatacccgccctgtttgaacctgagcgggagaaatcagcagcgatcgatggcgaatataggttgaagggagagagtcgcaaaacgttcgtggaattaatgcgtagaggcgacctgccggtttggctcgcccacaaggtggctagcgaggggattaagtacaccgatcggaaatggtgctttgacggagaaaggaacaatcagatcctggaggagaacatggatgtcgaaatttggacaaaggagggtgagaaaaagaaacttcgcccacgatggctggacgccagaacttattccgatcccctcgcattgaaggagttcaaggactttgctgccggccggaaatctatcgcactggatctagtgaccgaaatagggagggtaccttcgcatctggcccaccgcacaagaaatgctctcgacaaccttgtgatgctgcataccagcgagcacggaggcagggcgtaccggcacgccgttgaggaattacccgagactatggaaacattgctgctcctgggtcttatgatcctgctcaccgggggagcaatgttgttcctgatttcaggaaagggcatcgggaaaacgtccattggattaatctgtgtcgtggctagttctggtatgctatggatggccgatgtgccactgcagtggatagccagcgcaattgtcctcgagtttttcatgatggttcttctgatccctgagcccgaaaagcaacgtactccacaggacaatcagttggcttatgtggtaattggcatcctgacactcgccgcgatagtggctgccaacgagatggggctgcttgaaaccaccaaacgcgatctcggaatgtccaaggagcctggcgtcgtgtcaccgacatcttacctggacgttgacttgcatcccgcaagcgcctggactctgtatgctgtggcaacgaccgtcatcacaccaatgttacgacacactattgaaaatagtaccgccaacgtatccctagcggctatcgccaaccaagcagtggttctgatgggtctcgataaggggtggcctattagcaaaatggaccttggcgtgcccctgttggccctgggatgctactctcaggtcaatccactcacactgaccgctgccgtgcttttactggtcactcattacgcaatcataggccctgggctccaggctaaggccacgagagaggcgcagaaaaggacagccgcaggaattatgaagaaccccaccgtggatggcatcatgactatcgacttggatccggttatttatgactcaaaatttgagaagcaactgggtcaggtgatgctactggtactctgtgctgtgcagcttctgttgatgcggacctcctgggccttctgcgaagcactgacactcgctactgggccaatcaccacactgtgggagggaagtcctggcaagttttggaatacgaccatagccgtcagcatggccaacattttccgcggttcgtacttagcgggcgctgggcttgcattttctatcatgaaatccgttggaactggcaagagagggacaggaagccagggcgaaaccctgggtgagaaatggaagaaaaagctcaatcaactatcaaggaaagagttcgatctgtataagaagagtgggattactgaggtggaccggacagaggccaaagaaggattgaagcgaggcgagatcacccaccatgctgtctctagaggttccgccaaactgcagtggttcgtggaacgcaacatggtaatacccgagggcagggtgatcgatctcgggtgtggacggggcgggtggagctactattgcgcaggacttaagaaagttacggaagtgcgtggctacaccaagggtgggccaggacacgaggagcccgtccctatgtcaacatatggctggaatattgtgaagctgatgagtggcaaagacgtcttttacttgccgcccgaaaagtgtgatactctgctctgcgacatcggggagagctccccatctcctaccgtggaagagagcagaacaattagggttttaaaaatggtagagccctggctgaagaacaatcagttctgtatcaaagtgcttaacccttacatgccaactgtcattgaacacctggagcgcctacagcggaagcatggaggtatgctcgtgcgaaatcccctgtccagaaactcaacccacgaaatgtattggatctctaatggcacagggaacatagttagttcggtgaatatggtcagcaggttgctgctcaaccgctttaccatgactcatcggagacctacgattgagaaggatgtggaccttggagccggcacacgtcacgtaaacgctgaaccagagacccccaatatggacgtgatcggtgagaggatccggcgcattaaagaagaacactcctctacttggcattacgatgacgaaaacccgtataagacctgggcgtaccacgggtcatatgaggttaaagccacaggaagcgcatccagtatgataaatggcgtcgtgaagctgttaacgaaaccttgggatctggtgccaatggtcacccaaatggctatgactgacacaacccccttcggccagcagcgagtttttaaggaaaaggtggatactagaacacctaggccaatgcccgggacccggaaagtaatggagatcacagccgagtggttgtggcgcactctcggaagaaacaagaggccgcgactgtgcacccgggaagagttcattaaaaaggtgcgtacgaatgcagccatgggtgctgtctttaccgaagagaaccaatgggactctgccagagcggcagtggaagatgaggagttctggaagctggttgaccgcgaaagggagcttcataagctgggcaaatgtgggagctgcgtgtacaatatgatgggaaagcgggaaaagaaactcggcgagtttggtaaggccaaagggtcaagagctatctggtatatgtggctgggagcccgctacttggagttcgaagcactgggctttctcaacgaggatcactggttctccagggaaaatagtcatagcggcgtcgagggggaaggacttcacaagctgggttacattttacgagacatctctaaaatacctggcggggctatgtatgccgatgacacagctggatgggacactcggatcaccgaggatgacctgcacaacgaggaaaagattacacagcagatggatcccgagcatagacagttggccaatgcaatctttaagctcacttaccaaaacaaagtggtaaaggttcagaggccaacccctaaaggcacggtgatggacattatctcccgcaaggatcagcgtggttcagggcaggtcggaacatatggcctgaataccttcactaacatggaagcgcaactaatacggcagatggagggcgaaggggtgcttagcaaagccgacctggagaatccccacctcctggagaagaaggtgacacagtggttggaaaccaaaggagtcgagagattaaagaggatggctatttcgggtgatgactgcgttgtgaaaccaatcgatgaccgcttcgccaacgcactgctcgctcttaacgatatgggcaaggtacgaaaagacatcccccagtggcaaccttctaaggggtggcatgattggcaacaggtgccattttgtagtcaccacttccatgaactgattatgaaggacggacggaagctagtcgtgccgtgcagaccccaggacgagctgataggcagggcccgcatctcccaaggtgcagggtggagcctcagagaaactgcctgtttgggaaaggcgtacgctcagatgtgggccctgatgtattttcaccggagggatcttcgtctggcatcaaatgccatttgctccgctgttcctgtgcattgggtcccaacctctcgaacaacgtggagcatccacgcccatcaccagtggatgaccactgaggacatgctcacagtgtggaaccgcgtatggattgaggataatccctggatggaagacaaaacccctgttactacatgggaggatgtgccatacttaggcaagagagaagaccaatggtgtggcagtctgatcgggttgacctcccgggcaacgtgggctcagaacatactgacagccatccagcaggtcaggagcctcattggaaatgaggagttccttgattatatgccctctatgaaacgctttagaaaggaagaggaatcagagggtgcgatctggtga

SEQ ID NO: 15636 - RNA, 9873 nt, synthetic construct
  misc_feature 1..9873: note = derived and/or modified CDS sequence (opt3) from DENV-3__JQ920480__SS-prME
  source 1..9873: mol_type = other RNA
accagcctgtgcctcatgatgatgcttcccgccaccctggctttccacttgacttccagagacggcgagcctaggatgatcgtggggaagaacgaacggggaaaatctttactgtttaagacggcatcaggtattaatatgtgtaccctaattgccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgactacggaacccttggcctggaatgcagcccacgaactggtttggattttaatgagatgatcctactgaccatgaaaaacaaggcgtggatggtgcatagacagtggttcctcgacctgccgcttccctggacatccggggccaccactgagacacctacgtggaataaaaaggaactgttggtaacctttaaaaacgcacacgctaagaagcaagaggttgtggtcctcggctcacaggaaggagccatgcacactgctctgacaggcgccaccgagatccagacaagtgggggaactagcattttcgcaggtcatttaaaatgtaggctgaagatggataaactagaactcaagggcatgtcttatgccatgtgcctgaatgcttttgtgcttaaaaaggaggtctccgagacccagcacgggacgatattgatcaaggtggaatacaaaggagaggacgcgccatgtaagattcccttctcaaccgaagatggccaaggtaaagcacataacgggcggctgatcacagccaaccctatagttactaagaaagaggagccagtgaatattgaagctgagcccccgttcggcgaaagcaacatcgtaatcggaattggcgacaaggccctcaagatcaattggtacaaaaaggggagttctattggaaaaatgtttgaggcaaccgcccgtggtgctcgcagaatggccatactgggcgatacagcatgggacttcgggtccgtcggaggcgtgcttaacagcctgggtaagatggttcaccagatctttgggtcggcgtatactgctttgttctctggcgtgtcctggattatgaaaatcggaatcggcgtcctcctgacctggattgggttaaattcaaagaacacgagtatgagcttttcctgcatagtgatcggaattatcacactgtacctaggcgccgtagtgcaggcagatatgggttgtgttattaattggaaggggaaagaactcaagtgcggatctggcatcttcgtcaccaacgaggtgcatacttggacagagcagtataaatttcaagccgacagccctaagaggctggctaccgccatagccggtgcttgggaaaatggcgtgtgtgggatccggtcaactacccgaatggagaaccttttgtggaaacagattgccaatgaactgaactacatcctctgggagaataacattaagctgacaatcgtcgttggagatgtgataggcgtgttagaacaggggaaacgcacgctgacaccccagccaatggagcttaagtatagttggaagacttggggaaaagcgaagattgtaacagccgagacccaaaattccagcttcatcattgacggccctaacacacccgaatgcccatctgctttgagagcatggaacgtctgggaggtggaagactacggttttggggttttcactaccaatatctggctcaaactgagggagaagtatacgcagctatgtgatcaccggctgatgtcagccgctgtgaaagacgaacgcgccgtccacgcagatatgggatactggatagagagtcagaagaacgagagctggaagctcgaaaaagcgtccctgatcgaggtgaagacatgcacctggcccaaatctcatactctttggtcgaatggcgttttggaaagcgacatgattatccctaagtccctggccggtccaatttcacagcacaactacagaccgggctatcatacccaaacagctgggccctggcacttaggaaaactcgagctggattttaattactgcgagggcactaccgtggtaatcacagaaaactgtgggacgaggggacctagtcttcgtaccactacagtctctggcaagctgatacacgagtggtgctgtcggagctgcaccttgccacccctccgatatatgggtgaagacgggtgttggtacggaatggagattagacctatcaatgaaaaggaggagaacatggtgaaatccctggtgtcagccggcagcggtaagactgataatttcacaatgggcgtcctatgcctggcaatcctctttgaagaggttatgagggggaaattcggaaagaaacatatgattgctggcgccctgttcatgtttgtgcttttgctgtctgggcagatcacctggcgcgacatggtacacacgttaattatgataggatccaacgcaagtgatcggatgggcatgggtgtgacttatctcgccctgatcgctaccttcaagattcagccatttcttgcgctggggttctttctaagaaagctcacaagcagggaaaatctgttgctgggagtcggcttagccatggcaaccactctccaactgcccgaggacatcgaacagatggctaacggcattgcccttgggctgatggccttgaaactcatcacacagttcgagacctaccagctgtggacagctctaatatctctgatgtgttccaatactatctttacccttacggtggcatggcgcacagccaccctcattctggcggttatctcattgctgccggtgtgccaaagtagctcgatgcgaaagactgattggttacctatgaccgtcgctgccatgggagtgccacccctccctctgttcatattttcccttaaagacacactgaagcggcgttcttggcccttgaacgagggtgttatggcagtgggcctcgtcagcatcctggcctcaagtttcctaagaaatgatgtaccaatggctgggcctctggtggcaggaggccttctcatagcctgttatgttattactggtacctccgcggacctgacggtggaaaaagctgccgacgtcacatgggaggaagaggcagaacagaccggggtgtctcataacttgatgatcactgtagatgacgatggaacaatgaggatcaaggacgatgagaccgagaacattttaactgtgctgctcaaaacagccctgcttatagtcagcggcatctttccctactccattccagctaccctgttggtttggcacacgtggcagaagcagactcaacgctcaggcgtgctatgggacgtgccgagccctcccgaaacccagaaggccgagctggaagagggggtctaccggatcaaacagcagggaattttcggtaagacacaagtgggcgttggggtacagaaagagggagtgtttcataccatgtggcacgtcacaagaggcgcagtgctcactcacaatggtaagaggctggaaccaaactgggctaatgttaaaaaggatcttatcagttatgggggaggctggaagttatctgcccagtggcaaaaaggcgaggaagtgcaggtcatagcggtggagcccgggaagaaccctaaaaatttccagaccatgccaggaatcttccagacgacaactggtgaaattggcgccatcgcactggactttaagcccgggacctccggaagccctattatcaaccgagagggcaaagtagtcggtctctacgggaatggagtggttacaaagaacggcggctatgtgtcggggatagctcaaaccaatgccgagccggatggaccaactcccgaattggaggaagagatgttcaagaaacgcaacctgaccattatggacctccatcctggttcaggcaagacacggaaatacctgccagctatcgtcagagaagcaatcaagaggcgtcttcgcacgctgattttggcccccactcgggtggttgccgctgagatggaggaagcgctaaaagggctgcctatcagatatcagaccacagcaaccaagtctgagcacactggaagggaaatagtggatctcatgtgccatgccacatttaccatgcgattactgagtccggtccgggtgcccaattacaaccttattgtaatggacgaggctcacttcacggatccagcctccatcgcagcccgcggctatattagcactagagtgggtatgggggaagctgcggccatctttatgacagcaacccctcccggaaccgctgacgccttcccacagtctaatgcacctatacaggacgaggagagggatattcccgaacggagctggaactccggcaatgagtggatcactgactttgccggcaagacagtttggttcgtcccatcaatcaaagctgggaacgatattgccaactgtctgcgaaagaatgggaagaaagtgatccaactcagtagaaaaacctttgacacagaataccagaaaactaagttgaacgattgggacttcgtggtcacgaccgatattagcgagatgggtgcgaattttaaagcagaccgcgtaatagatccgaggcgttgcctgaagcctgtgatcctcacagacggccccgagcgggttattctggccgggccaatgcccgtgactgtcgcttctgccgctcagagaaggggacgcgtgggccgaaactcccagaaagaaaatgatcaatacatcttcaccggtcagcctcttaacaatgacgaggaccatgcacactggacagaagccaagatgctactggataacatcaataccccagaggggattatacccgctttgttcgaacctgagagagagaaatcagccgcaatcgacggcgaatatcggttaaagggagagagtaggaaaacttttgttgaactgatgcgccgtggcgatctcccggtgtggctggcgcacaaggtcgccagcgaggggattaagtacacggacagaaaatggtgcttcgatggagaacggaacaatcagatccttgaggagaacatggacgtggaaatttggaccaaggagggtgagaaaaagaaactgaggccacgctggctcgatgctcgaacatattccgaccccttggccctgaaagagtttaaggatttcgcagctggcagaaaatctatcgccctagacctggtaactgaaatagggcgggtgccttcgcatctcgcacacaggacccgcaatgcccttgataacctggttatgttacatacaagcgagcacggaggcagagcttacaggcacgcggtcgaggaattgcccgagaccatggaaactctgctcctgcttggtctgatgatcctcttgacagggggcgccatgctgtttttaatttcaggaaagggcatcgggaaaacgtccattggactaatctgtgtggtggcaagttctggtatgctgtggatggctgacgtcccactccagtggatagccagcgccattgttcttgagttctttatgatggtgctgttgatccctgagcccgaaaagcaacggaccccacaggataatcagctggcatatgtagtgattggcatcctcactctggctgccatagtcgcggctaacgagatggggcttctcgaaacaaccaaacgtgacctgggaatgtccaaggagcctggcgtggtttcaccgacctcttacttggacgtggatctgcatcccgccagcgcatggacattatatgccgtcgctactacggtaatcaccccaatgctacgccacacaattgaaaatagtactgcaaacgtgtccctggccgcgatcgctaaccaagccgttgtgctcatgggtcttgacaaggggtggcctattagcaaaatggatctgggcgtccccttgctggcactcggatgctactctcaggtgaatccactgacccttacagccgctgtcttactgctcgtgacccattacgccatcataggccctgggttgcaggcaaaggctactcgagaggcccagaaaagaacggcggccggaattatgaagaaccccacagttgacggcatcatgaccatcgatctggacccggtgatttatgattcaaaattcgagaagcaactaggtcaggtaatgctgctcgtgctttgtgcagtccagctgttgctgatgaggacttcctgggctttttgcgaagccctcaccctggcaacagggccaatcactaccttatgggagggaagtcctggcaagttctggaatacaacgatagctgttagcatggccaacatttttcggggttcgtaccttgccggcgcggggctggctttctctatcatgaaatccgtgggaaccggcaagcgcgggactggaagccagggcgaaacactcggtgagaaatggaagaaaaagctaaatcaactgtcaagaaaagaatttgacttgtataagaagagtgggattaccgaggtcgataggactgaggcaaaagaaggactgaagcggggcgagatcacacaccatgccgtgtctcgaggttccgctaaactccagtggttcgtagaaagaaacatggtgatacccgagggccgcgttatcgaccttgggtgtggaaggggcgggtggagctactattgcgccggactgaagaaagtgaccgaagtccggggctacacgaagggtgggccaggacacgaggagcccgtgcctatgtcaacctatggctggaatattgtcaagttgatgagtggcaaagatgtgttctacctgccgcccgaaaagtgtgacacactcttatgcgatatcggggagagctccccatctcctactgttgaagagagccgtaccattagagtactgaaaatggtggagccctggcttaagaacaatcagttttgtatcaaagtcctgaacccttacatgccaacagtgattgaacacctagagaggctccagcgcaagcatggaggtatgctggttcggaatcccttgtcccgaaactcaactcacgaaatgtattggatctctaatggcaccgggaacatagtgagttcggtcaatatggtgagcagactgctccttaacaggttcacaatgacccatcgccggcctactattgagaaggacgtagacctgggagcaggcacgagacacgtgaacgccgaaccagagacacccaatatggatgttatcggtgagcgtatcaggcggattaaagaagaacactcctctacctggcattacgacgatgaaaacccgtataagacttgggcttaccacgggtcatatgaggtcaaagcgaccggaagcgcctccagtatgataaatggcgtggtgaagttactgacaaaaccttgggacgtcgttccaatggtgacgcaaatggcaatgaccgatactacaccctttggccagcagcgcgtattcaaggaaaaggtggacacccgaactcctagaccaatgcccgggacaaggaaagtcatggagatcaccgctgagtggttgtggcggacactcggacgcaacaagagaccgaggctgtgcactcgagaagagtttattaaaaaggtgcggaccaatgccgcaatgggtgccgttttcacggaagagaaccaatgggattctgctcgtgccgcggtggaagacgaggagttttggaagctagtcgatagagaacgcgagcttcataagctgggcaaatgtgggagctgcgtgtacaatatgatgggaaagagggaaaagaaactcggcgagttcggtaaggcaaaagggtcacgggccatctggtatatgtggctgggagctagatacttggagtttgaagccctgggcttcctcaacgaggaccactggttttcccgcgaaaatagtcatagcggcgtagagggggaaggacttcacaagctgggttacattttaagggatatctctaaaatacctggcggggcaatgtatgctgacgacaccgccggatgggatacacgaatcactgaggacgatctgcacaacgaggaaaagattacccagcagatggaccccgagcatcggcagttggctaatgccatcttcaagctcacataccaaaacaaagttgtgaaggtccagagaccaactcctaaaggcaccgtgatggatattatctccaggaaggaccagcgcggttcaggacaggtgggaacgtatggcctgaatacatttaccaacatggaagcacaactaatacgtcagatggagggcgaaggggtccttagcaaagcggatctggagaatccccacctcctggagaagaaggttactcagtggttggaaacaaaaggagtggagcggttaaagagaatggccatttcgggtgacgattgcgtagtgaaaccaatcgacgataggttcgctaacgccctgctcgcacttaacgacatgggcaaggtccgcaaagatatcccccagtggcaaccttctaaggggtggcatgactggcaacaggtgccattctgtagtcaccactttcatgaactgattatgaaggacggacgaaagctagttgtgccgtgccggccccaggatgagctgataggcagagctaggatctcccaaggtgccgggtggagcctccgcgaaaccgcatgtttgggaaaggcctacgcgcagatgtgggctctgatgtatttccacagacgggaccttaggctggcctcaaatgcaatttgctccgccgtccctgtgcattgggtaccaacttctcgtaccacatggagcatccacgctcatcaccagtggatgacgaccgaggatatgctcactgtttggaaccgagtgtggattgaggacaatccctggatggaagataaaacacctgtcaccacttgggaggacgtgccatacttaggcaagcgcgaagatcaatggtgtggcagtctgatcgggttgacatccagagccacctgggcacagaacatactgacggctatccagcaggttcggagcctcattggaaatgaggagtttcttgactatatgccctctatgaaaaggttccgcaaggaagaggaatcagagggtgccatctggtga

SEQ ID NO: 15637 - RNA, 9873 nt, synthetic construct
  misc_feature 1..9873: note = derived and/or modified CDS sequence (opt3) from DENV-3__JQ920479__SS-prME
  source 1..9873: mol_type = other RNA
accagcctgtgcctcatgatgatgcttcccgccaccctggctttccacttgacttccagagacggcgagcctaggatgatcgtggggaaaaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttcctcgatctgccgcttccctggacatccggggccaccactgaaacacctacgtggaataaaaaggagctgttggtaacctttaaaaacgcacacgctaagaagcaagaagttgtggtcctcggctcacaggagggagccatgcacactgctctgacaggcgccaccgaaatccagacaagtgggggaactagcattttcgcaggtcatttaaaatgtaggctgaagatggacaaactagagctcaagggcatgtcttatgccatgtgcctgaatgcttttgtgcttaaaaaggaggtctccgaaacccagcacgggacgatattgatcaaggtggagtacaaaggagaagatgcgccatgtaagattcccttctcaaccgaggacggccaaggtaaagcacataacgggcggctgatcacagccaaccctatagttactaagaaagaggaaccagtgaatattgaggctgaacccccgttcggcgagagcaacatcgtaatcggaattggcgataaggccctcaagatcaattggtacaaaaaggggagttctattggaaaaatgtttgaagcaaccgcccgtggtgctcgcagaatggccatactgggcgacacagcatgggatttcgggtccgtcggaggcgtgcttaacagcctgggtaagatggttcaccagatctttgggtcggcgtatactgctttgttctctggcgtgtcctggattatgaaaatcggaatcggcgtcctcctgacctggattgggttaaattcaaagaacacgagtatgagcttttcctgcatagtgatcggaattatcacactgtacctaggcgccgtagtgcaggcagacatgggttgtgttattaattggaaggggaaagagctcaagtgcggatctggcatcttcgtcaccaacgaggtgcatacttggacagaacagtataaatttcaagccgatagccctaagaggctggctaccgccatagccggtgcttgggagaatggcgtgtgtgggatccggtcaactacccgaatggaaaaccttttgtggaaacagattgccaatgagctgaactacatcctctgggaaaataacattaagctgacaatcgtcgttggagacgtgataggcgtgttagagcaggggaaacgcacgctgacaccccagccaatggagcttaagtatagttggaagacttggggaaaagcgaagattgtaacagccgaaacccaaaattccagcttcatcattgatggccctaacacacccgagtgcccatctgctttgagagcatggaacgtctgggaagtggaggactacggttttggggttttcactaccaatatctggctcaaactgagggaaaagtatacgcagctatgtgaccaccggctgatgtcagccgctgtgaaagatgagcgcgccgtccacgcagacatgggatactggatagagagtcagaagaacgaaagctggaagctcgagaaagcgtccctgatcgaagtgaagacatgcacctggcccaaatctcatactctttggtcgaatggcgttttggagagcgatatgattatccctaagtccctggccggtccaatttcacagcacaactacagaccgggctatcatacccaaacagctgggccctggcacttaggaaaactcgagctggactttaattactgcgaaggcactaccgtggtaatcacagagaactgtgggataaggggacctagtcttcgtacgaccactgtctctggcaagctgattcacgaatggtgctgtcggagctgcacattgccacccctccgatatatgggtgaggatgggtgttggtacggaatggaaatcagacctatcaatgagaaggaggaaaacatggtgaaatccctggtgtcagccggcagcggtaagaccgacaatttcactatgggcgtcctatgcctggcaattctctttgaggaagttatgagggggaaattcggaaagaaacatatgatcgctggcgccctgttcatgtttgtgcttttgctgtctgggcagattacatggcgcgatatggtacacaccttaataatgatcggatccaacgcaagtgaccggatgggcatgggtgtgacgtatctcgccctgattgctactttcaagatccagccatttcttgcgctggggttctttctaagaaagctcaccagcagggagaatctgttgctgggagtcggcttagccatggcaacaaccctccaactgcccgaagatattgagcagatggctaacggcatcgcccttgggctgatggccttgaaactcataactcagttcgagacataccagctgtggaccgctctaatctctctgatgtgttccaatacaatttttactcttaccgtggcatggcgcacggccacactcatcctggcggttatttcattgctgccggtgtgccaaagtagctcgatgcgaaagaccgactggttacctatgactgtcgctgccatgggagtgccacccctccctctgttcatcttttcccttaaagataccctgaagcggcgttcttggcccttgaacgaaggtgttatggcagtgggcctcgtcagcatactggcctcaagtttcctaagaaatgacgtaccaatggctgggcctctggtggcaggaggccttctcattgcctgttatgttatcacaggtacttccgcggatctgaccgtggagaaagctgccgacgtcacgtgggaagaggaagcagagcagacaggggtgtctcataacttgatgatcaccgtagacgatgacggaactatgaggattaaggatgacgagacagaaaacatattaaccgtgctgctcaaaactgccctgcttatcgtcagcggcatttttccctactccatcccagctacactgttggtttggcacacctggcagaagcagacgcaacgctcaggcgtgctatgggatgtgccgagccctcccgagactcagaaggccgaactggaggagggggtctaccggattaaacagcagggaatcttcggtaagacccaagtgggcgttggggtacagaaagaaggagtgtttcatacaatgtggcacgtcaccagaggcgcagtgctcacacacaatggtaagaggctggagccaaactgggctaatgttaaaaaggaccttataagttatgggggaggctggaagttatctgcccagtggcaaaaaggcgaagaggtgcaggtcatcgcggtggaacccgggaagaaccctaaaaatttccagactatgccaggaattttccagaccacgacaggtgagatcggcgccattgcactggattttaagcccgggacttccggaagccctatcataaaccgagagggcaaagtagtcggtctctacgggaatggagtggttaccaagaacggcggctatgtgtcggggattgctcaaacaaatgccgaaccggacggaccaacccccgagttggaagaggaaatgttcaagaaacgcaacctgactatcatggatctccatcctggttcaggcaagacccggaaatacctgccagctatcgtcagagaggcaattaagaggcgtcttcgcacactgatcttggcccccacgcgggtggttgccgctgagatggaagaggcgctaaaagggctgcctataagatatcagactaccgcaacaaagtctgaacacaccggaagggagattgtggacctcatgtgccatgccacttttacaatgcgattactgagtccggtccgggtgcccaattacaaccttatcgtaatggatgaagctcacttcaccgacccagcctccattgcagcccgcggctatatcagcacgagagtgggtatgggggaggctgcggccatatttatgactgcaacacctcccggaaccgctgatgccttcccacagtctaatgcacctattcaggacgaggaaagggacatccccgagcggagctggaactccggcaatgaatggatcaccgattttgccggcaagactgtttggttcgtcccatcaattaaagctgggaacgacatcgccaactgtctgcgaaagaatgggaagaaagtgattcaactcagtagaaaaacatttgataccgagtaccagaaaacaaagttgaacgactgggatttcgtggtcactacggacataagcgagatgggtgcgaattttaaagcagatcgcgtaatcgacccgaggcgttgcctgaagcctgtgattctcaccgatggccccgaacgggttatcctggccgggccaatgcccgtgacagtcgcttctgccgctcagagaaggggacgcgtgggccgaaactcccagaaagagaatgaccaatacatcttcactggtcagcctcttaacaatgatgaagaccatgcacactggaccgaggccaagatgctactggacaacattaatacaccagaagggataatccccgctttgttcgagcctgagagagaaaaatcagccgcaattgatggcgagtatcggttaaagggagaaagtaggaaaacctttgttgagctgatgcgccgtggcgacctcccggtgtggctggcgcacaaggtcgccagcgaagggatcaagtacactgatagaaaatggtgcttcgacggagagcggaacaatcagattcttgaggaaaacatggatgtggagatctggacgaaggaaggtgagaaaaagaaactgaggccacgctggctcgacgctcgaacctattccgatcccttggccctgaaggaatttaaggacttcgcagctggcagaaaatctatagccctagatctggtaacagagatcgggcgggtgccttcgcatctcgcacacaggactcgcaatgcccttgacaacctggttatgttacataccagcgagcacggaggcagagcttacaggcacgcggtcgaagagttgcccgaaacaatggagaccctgctcctgcttggtctgatgattctcttgactgggggcgccatgctgtttttaatctcaggaaagggcattgggaaaacatccatcggactaatatgtgtggtggcaagttctggtatgctgtggatggctgatgtcccactccagtggattgccagcgccatcgttcttgagttctttatgatggtgctgttgattcctgaacccgagaagcaacggacgccacaggacaatcagctggcatatgtagtgatcggcatactcaccctggctgccatcgtcgcggctaacgaaatggggcttctcgagactacaaaacgtgatctgggaatgtccaaggaacctggcgtggtttcaccgacctcttacttggacgtggacctgcatcccgccagcgcatggaccttatatgccgtcgctacaactgtaattacgccaatgctacgccacaccatcgagaatagtacagcaaacgtgtccctggccgcgattgctaaccaagccgttgtgctcatgggtcttgataaggggtggcctatcagcaaaatggacctgggcgtccccttgctggcactcggatgctactctcaggtgaatccactgactcttaccgccgctgtcttactgctcgtgacacattacgccataattggccctgggttgcaggcaaaggctacccgagaggcccagaaaagaactgcggccggaatcatgaagaaccccacggttgatggcatcatgacaattgacctggatccggtgatctatgactcaaaattcgaaaagcaactaggtcaggtaatgctgctcgtgctttgtgcagtccagctgttgctgatgaggacctcctgggctttttgcgaggccctcactctggcaaccgggccaataacaactttatgggaaggaagtcctggcaagttctggaataccacaattgctgttagcatggccaacatctttcggggttcgtaccttgccggcgcggggctggctttctctattatgaaatccgtgggaacgggcaagcgcgggaccggaagccagggcgagactctcggtgaaaaatggaagaaaaagctaaatcaactgtcaagaaaagagtttgatttgtataagaagagtgggatcacagaggtcgacaggaccgaagcaaaagagggactgaagcggggcgaaataactcaccatgccgtgtctcgaggttccgctaaactccagtggttcgtagagagaaacatggtgatccccgaaggccgcgttattgatcttgggtgtggaaggggcgggtggagctactattcagccggactgaagaaagtgacagaggtccggggctacaccaagggtgggccaggacacgaggaacccgtgcctatgagtacgtatggctggaatatcgtcaagttgatgagcggcaaagacgtgttctacctgccgcccgagaagtgcgataccctcttatgtgacattggggaatcctctccaagccctacagttgaggagtcccgtactatcagagtactgaaaatggtggaaccctggcttaagaacaatcagttttgcattaaagtcctgaacccttacatgccaaccgtgatcgagcacctagaaaggctccagcgcaagcatggaggtatgctggttcggaatcccttgtcacgaaactctacacacgagatgtattggataagtaatggcactgggaacattgtgtcgagcgtcaatatggtgtccagactgctccttaacaggttcaccatgacacatcgccggcctaccatcgaaaaggatgtagacctgggagcaggcactagacacgtgaacgccgagccagagacgcccaatatggacgttatcggtgaacgtattaggcggataaaagaggaacactcttcaacatggcattacgatgacgagaacccgtataagacctgggcttaccacgggagctatgaagtcaaagcgactggatccgccagttctatgatcaatggcgtggtgaagttactgaccaaaccttgggatgtcgttccaatggtgacacaaatggcaatgacggacaccactccctttggccagcagcgcgtattcaaggagaaggtggatacacgaacccctagaccaatgcccgggactaggaaagtcatggagattacagctgaatggttgtggcggaccctcggacgcaacaagagaccgaggctgtgtacacgagaggaatttatcaaaaaggtgcggactaatgccgcaatgggtgccgttttcaccgaggaaaaccaatgggacagcgctcgtgccgcggtggaggatgaggaattttggaagctagtcgacagagagcgcgaacttcataagctgggcaaatgcgggtcatgtgtgtacaatatgatgggaaagagggagaagaaactcggcgagttcggtaaggcaaaagggtcccgggccatttggtatatgtggctgggagctagatacttggaatttgaggccctgggcttcctcaacgaagatcactggtttagtcgcgagaatagccattctggcgtagaaggggagggacttcacaagctgggttacatcttaagggacatatccaaaatccctggcggggcaatgtatgctgatgacacggccggatgggacacccgaattacagaggatgacctgcacaacgaagagaagatcactcagcagatggatcccgaacatcggcagttggctaatgccattttcaagctcacctaccaaaacaaagttgtgaaggtccagagaccaacacctaaaggcactgtgatggacatcatatcaaggaaggatcagcgcggtagcggacaggtgggaacctatggcctgaatacgtttacaaacatggaggcacaactaattcgtcagatggaaggcgagggggtcctttcgaaagcggacctggagaatccccacctcctggaaaagaaggttacccagtggttggagactaaaggagtggaacggttaaagagaatggccatctctggtgatgactgcgtagtgaaaccaatcgatgacaggttcgctaacgccctgctcgcacttaacgatatgggcaaggtccgcaaagacattccccagtggcaacctagtaaggggtggcatgattggcaacaggtgccattctgctcccaccactttcatgagctgataatgaaggacggacgaaagctagttgtgccgtgtcggccccaggacgaactgatcggcagagctaggattagccaaggtgccgggtggtcactccgcgagacagcatgcttgggaaaggcctacgcgcagatgtgggctctgatgtatttccacagacgggatcttaggctggcctccaatgcaatctgttctgccgtccctgtgcattgggtaccaaccagccgtactacctggagtattcacgctcatcaccagtggatgacaacggaggacatgctcaccgtttggaaccgagtgtggatcgaagataatccctggatggaggacaaaactcctgtcacaacctgggaagatgtgccatacttaggcaagcgcgaggaccaatggtgcggctccctgatagggttgactagcagagccacatgggcacagaacatcctgaccgctattcagcaggttcggtctctcatcggaaatgaggaatttcttgattatatgccctcaatgaaaaggttccgcaaggaggaagagagtgaaggtgccatttggtga

SEQ ID NO: 15638 - RNA, 9873 nt, synthetic construct
  misc_feature 1..9873: note = derived and/or modified CDS sequence (opt3) from DENV-3__KU216208__SS-prME
  source 1..9873: mol_type = other RNA
accagcctgtgcctcatgatgatccttcccgccgctctggcattccacttgacttccagggacggagagcctaggatgattgtggggaagaacgaacggggaaagtctttactgtttaagactgcctcaggtataaatatgtgtacgctcatcgcgatggatctcggcgaaatgtgcgacgataccgtcacatacaaatgtccacacattactgaagttgagccggaagacatcgattgctggtgtaacctgaccagtacatgggtgacctatgggacttgcaatcaggctggagagcaccgccgagacaagcgtagcgtcgcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctggattgatgtggtcctggagcacggcgggtgcgtgacgactatggcgaagaataaacccacactagacatcgagctccagaagaccgaagcaactcagctggccacacttaggaaactgtgtattgagggaaagatcaccaacataacgaccgatagccggtgccctacacagggcgaagctgtgttgccagaggaacaggaccagaattatgtctgtaaacacgcctacgttgatcgcggttgggggaacggatgcggcctcttcggcaaggggagtctggtgacttgcgcaaagtttcaatgtttagagcccattgagggaaaagtagtgcagtatgaaaatctgaagtacaccgtcatcattacagtgcatactggtgaccagcaccaggttggcaacgagacccaaggggtgacagctgaaatcacccctcaggcctccactacggaggcgatcctcccagaatatggaacacttggcctggagtgctctccgcgaaccggtttggacttcaatgagatgattctactgactatgaaaaacaaggcctggatggtccatagacagtggtttttcgatctccccctgccttggaccagcggggcaacaaccgaaactccaacatggaataggaaagagcttctggtgacgtttaagaacgctcacgccaaaaagcaagaagtagttgtgttgggctcccaggagggagctatgcacaccgccctcactggcgcaacagaaatacaaaattcagggggaaccagtatcttcgccggtcatctgaagtgtcggttaaaaatggacaagctggagctaaaaggcatgagctacgctatgtgcacaaacacttttgtcctcaagaaagaggtgtctgaaacccagcacgggacgattctgatcaaggtcgagtacaagggagaagatgcgccctgtaaaatacctttctccaccgaggacggccaaggtaaggcacataacgggcgtcttattacagccaatccagtggttactaaaaaggaggaacccgtgaacatcgaggctgaaccgcctttcggcgagtcaaatatcgtaattggaatcggcgataacgccttgaaaattaattggtataagaaggggagcagtataggaaaaatgtttgaagcaaccgcccgcggtgctagaaggatggccatcctgggcgacacagcatgggatttcgggtctgtcggaggcgtgctcaactccctgggtaagatggttcaccagatttttgggagcgcgtacactgctcttttctcgggcgtgtcttgggtcatgaaaatcggaatcggcgtgctgttgacctggattgggctcaattccaagaacacgtcaatgagttttagctgcatagccatcggaattatcacactgtatttaggcgcagtagtgcaggccgacatgggttgtgttgtcaattggaaagggaaggagctgaagtgcggatccggcattttcgtgaccaacgaggtgcatacttggacagaacagtacaaatttcaagctgattctcccaagcggctagccaccgcaatcgctggtgcctgggagaatggcgtctgtgggatacgaagcactacccgcatggaaaacctcctgtggaaacagatcgcgaatgagcttaactatattttgtgggaaaataacatcaagctgacagttgtggtgggagacacgattggcgtactcgagcaggggaaaagaaccctgactccacagcctatggagttaaagtactcatggaaaacatggggaaaggccaagatcgtcaccgctgaaacacaaaacagttccttcataattgatggccccaatactccagagtgccccagcgcatctagggcctggaacgtgtgggaagttgaggactatggttttggggtgttcaccacgaatatctggctgaaacttcgggaagtctacacacagatgtgtgaccaccgcttgatgtcagctgccgtgaaggatgagagagcagttcacgcggacatgggatactggattgagagtcagaaaaacggcagctggaagctcgaaaaagcctccctgatcgaggtgaagacctgcacttggcctaagtctcataccctatggtcgaatggtgtactggaaagcgatatgataatcccaaaatccctcgctggcccgatttcacagcacaactataggcccgggtaccatacacaaactgccggaccttggcacctgggcaaacttgagttggactttaattattgcgaggggaccacagtcgtgatcacggaaaactgtggaacccgtggcccaagtctgcggactacaaccgtgtctggtaaattaattcacgagtggtgctgtcgaagctgcactctaccccctctgagatacatgggggaagatggatgttggtatggcatggagatcaggccaatatccgaaaaggaggagaatatggtcaaatcacttgttagcgcaggttctggcaaggtggacaacttcacaatgggggtactgtgcttggctattctctttgaagaggtgatgcgcggaaagttcggcaaaaagcatatgatcgccggggtcttctttaccttcgtgctgctactgtccggacagatcacgtggcgggatatggcacacactctcattatgatcggcagtaatgccagcgacagaatgggtatgggggttacctacctggctcttattgcgacatttaaaatacagcccttcttggccctgggatttttcttaaggaagctcacctctcgcgaaaacctgcttctgggcgtgggcctagcaatggctactacactccaactgccggaggatatcgaacagatggccaatgggattgccttgggactgatggctttaaaactcatcacccagtttgagacatatcagctgtggactgcacttatttccctgacctgttcaaacacgatcttcacattgaccgtcgcctggcgaactgcgaccctcatactggctggtgtgagtctactgcctgtttgccaaagctcgtccatgcggaagacagactggcttccaatgactgtggccgcaatgggcgtaccccctctccccctgtttatcttctctttgaaggataccctgaaacgtagaagctggccattaaatgagggggtaatggccgtgggactcgtttcaattctggctagttcccttctgaggaacgacgtgcctatggcaggccccttggtcgccggtgggctcctgatcgcgtgttacgtgattacgggaacatctgctgatctaaccgtagaaaaggccgcagacgtgacttgggaggaagaggccgaacagacaggcgtcagccataacctgatgatcaccgttgacgatgacggcactatgcgcataaaagatgacgagacagagaatattcttaccgtgctcctgaagacggctttgttaatcgtgtccgggatctttccatactcaattccggccactctgctcgtctggcacacctggcagaaacagacacaacggagcggagtgctgtgggatgttcctagtcccccagaaacccagaaggcagagcttgaagagggtgtatatagaataaaacagcagggcatcctggggaagacacaagtgggagtcggcgtgcagaaggagggtgttttccatactatgtggcacgtgaccagaggggctgtcttgacgcacaacggaaaacgactagaacccaattgggcctctgtgaagaaagacctgatttcctacggcggcgggtggcgcctcagcgcgcagtggcaaaagggagaggaagtacaggtcatcgccgtggagcctggtaaaaacccaaagaattttcagacaatgcccggcactttccagaccacaaccggggaaattggagcaatcgctctggatttcaagcctggcacttcgggttcaccgataatcaaccgggaggggaaagttgtgggactttatggcaatggcgtcgtgaccaagaacgggggatacgtttctggtattgcccaaacaaatgctgagccagacggccccacgcctgaattagaggaagagatgtttaaaaagagaaacctgactatcatggatctccatccagggagtggaaaaaccaggaagtatttgcccgcaattgtgcgtgaagccatcaagcgccggctgagaacactcatactggcccctaccagggtcgtggctgcggagatggaggaagcacttaaaggcctgccgattcgataccagactacagccaccaagtccgagcacacgggtcgggaaatcgtagacttgatgtgccatgctactttcacaatgcgcctactgagccccgtgagagttccaaattataacctcatcattatggatgaggcccactttaccgaccctgcatctatcgccgctagggggtacataagcacccgggtcggaatgggcgaagcggccgcaattttcatgactgctacacccccaggcaccgccgatgcatttcctcagtccaatgcccccatccaggacgaggagcgagacattccagaaagatcatggaacagtgggaatgagtggatcacagatttcgctggaaaaactgtgtggtttgtgccgagcataaaggccggtaacgacattgcgaactgtttacgcaaaaatggcaagaaggtcatccaactgtctaggaaaacgttcgaaaccgagtaccagaagacaaaacttaacgattgggactttgtagtgactaccgatatctccgagatgggggcaaatttcaaggccgaccgtgttattgatcctcggagatgcctgaaacccgtgatcctcacagacggaccagaaagggtcattttggctggccccatgcctgtgaccgccgcttcagcagcccagcgccgaggtagagttgggcggaacccacagaaggagaatgatcaatatatatttactggccagcccctgaacaatgacgaagatcatgctcactggacggaggccaagatgctcctggacaacatcaatacccctgaaggaattatcccggcacttttcgagccagagagggagaagagtgcggccatcgacggcgagtaccgcctaaagggggaaagccgtaaaacattcgtggagctgatgagacggggagatttgcccgtctggttagcttataaggtggcctccgaaggtattaaatacactgacaggaagtggtgctttgatggccagcgcaacaatcagatactggaggagaacatggacgtagaaatctggaccaaagagggggaaaagaagaaactccgacctagatggctggatgcacggacatattctgacccccttgctctgaaggagttcaaagattttgccgcaggaaggaagtcgattgccctcgacttggtgaccgaaatcggccgcgttccaagccacctggctcatagaactaggaatgcgctagataacctggtcatgctccacacatcagagcatggtgggcgggcctaccgtcacgcagtggaggaacttcctgagacgatggaaaccctgttattgctgggcctcatgattctgcttactggaggcgctatgctgttcctcatctccgggaaaggaataggtaagacaagtatcggcttgatttgtgtgatcgcctctagcgggatgctgtggatggccgagattcccttacaatggatcgcatccgctatagtcctagagtttttcatgatggttctgctcattccagaacctgagaagcagcgcaccccgcaggacaatcaacttgcctatgtggtaatcggcattctgaccttggcggctatcatagccgcaaacgaaatgggcctgctcgagacaactaaacgagatctgggtatgtcaaaggaacccggggtggtctctccaacgagctaccttgacgtggatctccaccctgccagtgcttggaccctgtacgcagttgccacaactgtgatcacccccatgttgagacatacaattgaaaattccaccgcgaacgtcagcctggctgccatcgcaaaccaggccgtagtgttaatgggcctagacaaaggatggccaatttctaagatggacctgggcgttcctctccttgctctggggtgctattcacaggtgaatcccttgactctgacggccgcagtcctcctgcttatcacacactacgctataattggaccgggcttacaggccaaagcgaccagggaggcccaaaagcggactgcagctggtatcatgaagaacccaaccgtggatgggatcattacaatcgacctggatcctgtcatatatgactccaaatttgaaaagcagctcggacaggtgatgttgctggttctatgtgccgtgcagctgctccttatgcgcacaagttgggcactgtgcgaggctttgaccctggccacaggccccattacgaccctctgggaaggtagcccaggcaaattctggaatactacaatcgccgtatcgatggcgaacatttttagagggtcttacctggctggagcaggcttagccttctccatcatgaaaagcgtggggaccggaaaaaggggcactggttcacaaggggagacacttggagaaaagtggaagaaaaagctgaatcagctcagtcggaaagagtttgatctatataagaaatctggcataaccgaggtcgaccgaacggaagctaaggagggtctgaaaagaggcgaaaccacacatcacgccgtttcccgcgggagcgcaaagttgcagtggttcgtggagaggaacatggtcatccccgaaggacgggtgattgatctgggctgtgggcgtggaggctggtcatactattgcgccggtctcaagaaagtaactgaggtgagagggtacaccaagggaggccctggccatgaggaaccggttcccatggctacatacgggtggaatatcgtgaaacttatgagtggaaaggacgtcttttatctgccacctgagaaatgtgatactttgctgtgcgacattggtgaaagctccccctctcctaccgtggaggagagcaggacaatccgcgtcctcaagatggtggaaccatggttaaagaacaatcagttctgtattaaagttctgaacccctacatgcctgcggtaatcgagcaccttgaacggctgcaacgaaagcacggcgggatgctagtgagaaatccactctccaggaactcaacccatgagatgtattggatatctaatggaactggcaacattgtcagttcggtgaatatggttagccgcctgttgctgaaccggttcacgatgacacacagacgtcccaccatcgaaaaagatgtggacctcggtgccgggactaggcatgtcaacgcagagccggagacccctaatatggatgtgatcggagaacggattaagcgcataaaagaggaacacaactccacatggcactacgacgacgagaatccatataagacgtgggcttaccatggctcttatgaagtaaaggccaccggctcagcaagctccatgatcaacggggtggttaaacttctgactaagccctgggatgtcgtgcctatggtgacacagatggccatgaccgacactacaccatttggacagcaacgagtcttcaaagagaaggttgataccagaacacccaggccgatgcctggtactcggaaagtgatggagattaccgctgaatggttatggcgcacgctgggcagaaataagaggccccgattgtgcacccgggaggaatttacaaagaaagtacgtactaacgccgcgatgggggcagtgttcaccgaggaaaatcagtgggacagtgccaaggctgccgtcgaggatgaggaattttggaaactcgtggacagagagcgcgaactgcacaagctaggaaaatgtggctcttgcgtttacaacatgatgggtaagagggagaagaaacttggggagttcggaaaagcaaaaggcagccgggctatctggtacatgtggctgggcgccagatatctcgaatttgaggctctggggttcttgaatgaagatcattggttttcacgcgagaactcctacagtggagtggaaggtgagggcctgcacaagctcgggtatattcttagggacatcagcaaaataccaggaggcgccatgtacgcagatgacacagcgggttgggatactcgaatcaccgaggacgacctgcataatgaagagaagattacgcagcagatggatcctgaacaccggttactggccaacgctatcttcaaattgacatatcaaaataaggtcgtgaaggtacagagacccaccccaactgggacagttatggacattatctctaggaaagatcagcgcggatccggccaggtgggcacctacgggctcaacacttttaccaatatggaggcccaactggtccgtcagatggaaggagagggtgtgctatcaaaggcagaccttgagaacccccatctgcctgagaagaagataacacagtggctcgagacgaaaggcgtggaacggctgaagagaatggctattagcggggatgactgcgtcgttaagccaatcgatgacaggttcgccaacgcattgttagccctgaatgatatgggaaaagtgcgcaaggacatcccgcagtggcaaccctcgaaaggctggcatgattggcagcaggtacctttttgttctcaccatttccacgagctcattatgaaggacggtcgaaaacttgtggtcccatgccggccccaggatgaactgatagggagagcgaggatcagtcaaggagctggctggtccctacgcgagaccgcctgtctgggcaaggcatatgcccagatgtggagcctcatgtacttccacagacgggacttgaggctggcttcaaacgccatttgctccgcagtgcctgttcattgggtgccaacttctcgtacaacctggagcatccacgctcatcaccagtggatgactacagaggacatgcttaccgtctggaatcgagtgtggattgaagataacccctggatggaggacaagacgcctgtaacaacctgggaaaatgttccgtacctggggaaacgcgaggatcaatggtgtggaagtctcatcggtttaacttccagagccacctgggcgcagaacataccaacagctatccaacaggtgcggagcctgattggcaatgaggaatttttggactatatgccctctatgaagaggttccgcaaagaggaagagtcagaaggggccatctggtga

SEQ ID NO: 15639 - RNA, 9873 nt, synthetic construct
  misc_feature 1..9873: note = derived and/or modified CDS sequence (opt3) from DENV-3__GU370053__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttgggccagcggggcaacaaccgaaactccaacatggaataggaaagagcttctggtaacgtttaagaacgctcacgccaaaaagcaagaagttgtggtcttgggctcccaggagggagctatgcacaccgccctcactggcgcaacagaaattcagaattcagggggaaccagtatattcgccggtcatctgaagtgtcggttaaaaatggacaagctggagctaaaaggcatgagctacgctatgtgcacaaacacttttgtgctcaagaaagaggtctctgaaacccagcacgggacgatcctgattaaggtggagtacaagggagaagatgcgccctgtaaaatccctttctccaccgaggacggccaaggtaaggcacataacgggcgtcttataacagccaatccagttgtgactaaaaaggaggaacccgtaaacattgaggctgaaccgcctttcggcgagtcaaatatcgtcatcggaattggcgataacgccttgaaaatcaattggtataagaaggggagcagtattggaaaaatgtttgaagcaaccgcccgcggtgctagaaggatggccatactgggcgacacagcatgggatttcgggtctgtgggaggcgttctcaactccctgggtaagatggtgcaccagatctttgggagcgcgtacactgctcttttctcgggcgtctcttgggtgatgaaaattggaatcggcgtactgttgacctggatcgggctcaattccaagaacacgtcaatgagttttagctgcattgccataggaatcattacactgtatttaggcgcagtggttcaggccgacatgggttgtgtcatcaattggaaagggaaggagctgaagtgcggatccggcattttcgtgaccaacgaggtgcatacttggacagaacagtacaaatttcaagctgattctcccaagcggctagccaccgcaatcgctggtgcctgggagaatggcgtctgtgggatacgaagcactacccgcatggaaaacctcctgtggaaacagatcgcgaatgagcttaactatattttgtgggaaaataacatcaagctgacagttgtggtgggagacacgattggcgtactcgagcaggggaaaagaaccctgactccacagcctatggagttaaagtactcatggaaaacatggggaaaggccaagatcgtcaccgctgaaatacaaaacagttccttcattatcgatggccccaatacaccagagtgccccagcgcatctagggcctggaacgtgtgggaagttgaggactatggttttggggtgttcactaccaatatttggctgaaacttcgggaagtctacacgcagttgtgtgaccaccgcctcatgtcagctgccgtgaaggatgagagagcagttcacgcggacatgggatactggatcgagagtcagaaaaacggcagctggaagctggaaaaagcctccctaatagaggtgaagacatgcacctggcctaagtctcatactctgtggtcgaatggtgtactcgaaagcgatatgatcattccaaaatccctggctggcccgatctcacagcacaactataggcccgggtaccatacccaaacagccggaccttggcaccttggcaagttggagctggactttaattattgcgaggggactaccgtcgtgattacagaaagttgtggaacgcgtggcccatctttacggaccactacagtgagcggtaaactcatccacgagtggtgctgtcgatcctgcaccctgccccctcttagatacatgggggaagatggatgttggtatggcatggagataaggccaatttcagaaaaggaggagaacatggtcaaaagcctggtttctgcaggttccggcaaggtggacaatttcactatgggggtattgtgcctcgctatcctgtacgaagaggtgatgcgcggaaagtttggcaaaaagcatatgatcgccggggtcttcttcacatttgtgctactgctcagtggacagattacctggcgggatatggcacacacgctgatcatgattggcagcaacgcctctgacagaatgggtatgggggttacttatcttgctttgatagcgaccttcaaaatccagccctttctggccttaggattctttctcaggaagctgacatcccgcgaaaatcttctgctaggcgtgggcctcgcaatggctaccactctgcaattgccggaggatattgaacagatggccaacgggatcgccctgggattaatggctctcaaactgattacacagttcgagacctaccagctttggacagcactggtctcattgacttgtagtaataccatctttacgctcacagtggcctggcgaaccgcgactctgatactagctggtgttagcctgcttcctgtgtgccaatcgtcctctatgcggaagaccgactggctcccaatggccgtcgcagccatgggcgtaccccctctgcccttgttcatctttagcctgaaggatacattaaaacgtagatcatggccactcaacgagggggtgatggctgttggactggtgagtattcttgcatcctctctgttgaggaatgacgtccctatggccggccccctcgtggcgggtgggctgctaatcgcttgttacgtaattactggaaccagcgccgatctgacggtggaaaaggcagccgacgtcacatgggaggaagaggctgaacagaccggcgtttcccataaccttatgatcactgtggacgatgacggcacaatgcgcataaaagatgacgagaccgagaacattctcactgtgctgttgaagacagccttactgatcgtctcagggatcttcccatatagcattccggcaaccctcctggtgtggcacacgtggcagaaacagactcaacggagtggagttctttgggatgtaccttctcccccagaaacccagaaggctgagctggaagagggtgtgtacagaataaaacagcagggcatctttgggaagacacaagtcggagtgggcgttcagaaggagggtgtgttccataccatgtggcacgtcacaaggggggccgtgttgactcacaatggaaaacgactagaacccaactgggcgtccgtaaagaaagacctgattagctatggcggcgggtggcgcctctcggcccagtggcaaaagggagaggaagtccaggtgatcgcagttgagcctggtaaaaatccaaagaactttcagaccatgcccggcacgttccagacaactaccggggaaattggagctatcgccctggatttcaagcctggcacatcaggttctccgataatcaatcgggaggggaaagtggtcggactttacggcaacggcgtggttaccaagaatgggggatatgtgagtggtattgctcaaactaacgcagagccagacggccccacccctgaattagaggaagagatgtttaaaaagagaaatctgacaatcatggatctccatccagggtccggaaaaacgaggaagtacttgcccgccattgtccgtgaagccatcaagcgccggctgagaactctcatactggctcctaccagggtggtagcggcagagatggaggaagcccttaaaggcctgccgattcgatatcagacaaccgctactaagagcgagcacacaggtcgggaaatcgtggacttgatgtgccatgccaccttcacgatgcgcctactgtctcccgttagagtcccaaactacaatctcatcgtgatggatgaggcacactttactgaccctgccagcattgctgcgagggggtacatctccacacgggtgggaatgggcgaagccgcagctatattcatgaccgccacccccccaggcactgcagatgcctttcctcagtcaaacgctcccattcaggacgaggagcgagacatcccagaaagaagttggaatagcgggaacgagtggattacagatttcgccggaaaaaccgtctggtttgtaccgtctatcaaggcgggtaatgacatagcaaactgtttacgcaaaaacggcaagaaggtgattcaactgtccaggaaaacattcgatactgaatatcagaagacgaaacttaatgactgggattttgttgtgaccacagacatctcagagatgggggccaacttcaaggctgatcgtgtcatcgaccctcggagatgcctgaaacccgtgattctcactgatggaccagagagggttatcttggccggccccatgcctgtgaccgctgcaagtgccgctcagcgccgaggtagagtcgggcggaatccacagaaggaaaacgaccaatacatttttacaggccagcccctgaataacgatgaggaccatgcccactggaccgaagcaaagatgctcctggacaatataaacactcctgagggaatcattccggcgcttttcgaaccagagagggagaaaagcgccgctatcgatggcgaatatcgcctaaagggggagtcccgtaaaacgttcgtggaactgatgagacggggagacttgcccgtatggttagcccacaaggtggcatctgagggtatcaaatacaccgataggaagtggtgctttgacggccagcgcaataaccagattctggaagagaatatggatgttgagatatggacaaaagaaggggagaagaagaaactccgacctagatggctggacgctcggacttattcggatccccttgccctgaaggaattcaaagactttgcagccggaaggaagagcatcgctctcgatttggtcaccgagattggccgcgtgccatcacatctggcgcacagaacaaggaacgccctagacaatctggtgatgctccatacctccgaacacggtgggcgggcataccgtcacgctgtcgaggagcttcctgaaactatggagacactgttattgctgggcctcatgatcctgcttacgggaggcgccatgctgttcctcattagtgggaaaggaatcggtaagacctctataggcttgatctgtgttattgccagctccgggatgctgtggatggcagaagtgcccttacaatggatcgcttcagccattgtactagagtttttcatgatggtgctgctcatcccagagcctgaaaagcagcgcactccgcaggataaccaacttgcgtatgtcgtgataggaattctgacattggctgccatcattgcagccaatgagatgggcctgctcgaaaccaccaaacgagacctgggtatgtctaaggagcccggggttgtgagcccaacaagttaccttgatgtcgacctccatcctgcttccgcatggactctgtacgccgtagcgacgaccgtgatcacacccatgttgagacacactatagaaaacagcaccgctaatgtttctctggccgcaatcgccaaccaggctgtggtcttaatgggcctagacaaaggatggccaatttcaaagatggatctgggcgtgcctctccttgccctggggtgctattcccaggtcaaccccttgacactgaccgcagctgtgctcctgcttatcactcattacgccattatcggaccgggcttacaggcgaaagccacgagggaggcacaaaagcggacagctgccggtataatgaagaatccaaccgttgacgggattatgactatcgatctggaccctgtgatctatgatagtaaatttgagaagcagctcggacaggtaatgttgctggtgctatgtgcagtccagctgctccttatgcgcaccagctgggctctgtgcgaagccttgacactggccactggccccattaccacactctgggagggttcgccaggcaaattctggaacacgaccatcgcggtttctatggctaatatatttagagggtcctacctggcaggagccggcttagctttcagcattatgaagtcagtggggactggaaaaaggggcacaggtagtcaaggggaaacccttggagagaagtggaagaaaaagctgaaccagctctctcggaaagaatttgacctatataagaaatccggcatcactgaggtcgatcgaacagaggccaaggaaggtctgaaaagaggcgagaccacgcaccatgcagtgagccgcgggtcagccaagttgcagtggttcgtagaaaggaatatggtggttcccgagggacgggtgattgacctgggctgtgggcgtggaggctggagttactattgcgctggtctcaagaaagtcaccgaagtgagagggtacacaaagggaggccctggccacgaggagccggtccccatgagcacttacgggtggaacatcgtgaaacttatgtccggaaaggatgttttttatctgccacctgaaaaatgtgacaccttgctgtgcgatataggtgagtctagcccctcccctacagtagaagagtcaaggactatccgcgtgctcaagatggtcgagccatggttaaagaataaccagttctgtattaaagtgctgaatccctacatgcctaccgttatcgaacaccttgagcggctgcaacgaaagcatggcgggatgctagtgagaaacccactctctaggaatagtacacacgaaatgtattggatttcgaacggaaccggcaatatcgtcagctccgtgaacatggtatctcgcctgttgctgaatcggttcactatgacgcatagacgtcccacaattgagaaagacgtggatctcggtgcggggaccaggcacgttaacgccgaaccggagactcctaacatggacgtcatcggagagcggataaagcgcattaaagaagagcacaattcaacctggcattacgacgatgaaaacccatataagacatgggcataccacggcagctatgaggtgaaggctacgggctccgccagttctatgatcaatggggtggtcaaacttctgaccaagccctgggacgttgtgcctatggtaactcagatggcaatgacagataccactccatttggacagcaacgagtgttcaaagaaaaggtcgacacaagaacccccaggccgatgcctggtacacggaaagtgatggagatcactgccgagtggttatggcgcaccctgggcagaaacaagaggccccgattgtgcacgcgggaagagtttaccaagaaagttcgtacaaatgctgccatgggggcggtgttcactgaagagaaccagtgggatagcgcaaaggccgctgtcgaagacgaggagttttggaaactcgtggatagagaacgcgagctgcataagctaggaaaatgtggctcatgcgtatacaatatgatgggtaagagggaaaaaaagcttggggagttcggaaaggccaaaggctcccgggcaatttggtacatgtggctgggcgctagatatctcgagtttgaagccctggggttcttgaacgaggaccactggtttagtcgcgaaaatagctactctggagttgagggtgaaggcctgcataagctcgggtatatacttagggatatctccaaaattccaggaggcgctatgtacgccgacgataccgcaggttgggacacacgaatcactgaggacgatctgcacaacgaggaaaagattatccagcagatggaccctgagcaccggcaattagcgaatgccatattcaaactgacctatcagaacaaggtggtcaaggtgcagagacccacgccaacagggaccgtgatggatatcatttcaaggaaagaccagcgcggaagcggccaagtcggcacttacgggttgaatacatttaccaacatggaagctcagctcgttcgtcagatggagggagaaggtgtgctgactaaggccgatctagagaatccccatcttcctgagaaaaagatcacccagtggctggaaacaaaaggcgtagagcggctcaagagaatggcaatttcgggggacgattgcgtggtcaagccaatcgacgataggttcgctaacgccctgttggcattaaacgacatgggaaaagtgcgcaaggatataccgcaatggcagccctctcgaggctggcacgactggcagcaggttcctttttgtagtcatcacttccacgaactgattatgaaagatggtcggaagctcgtggtcccatgcagaccccaagacgagcttatcgggagggcccgcatctcccagggagcgggctggagcctgagagaaacggcttgtctaggcaaagcctatgcacagatgtggtcactgatgtacttccatcggagggacctccgtttggcctccaatgctatttgctctgccgtgcctgtacactgggttccaaccagccgaactacatggagtatacatgcacaccatcaatggatgaccactgaggatatgctgacagtgtggaaccgcgtctggatcgaggaaaatccctggatggaggacaagacccctgtgacgacatgggaaaacgttccgtaccttgggaagagagaggatcagtggtgtggatccctgattggtctcaccagccgggctacttgggcccagaatatcttaaccgcgattcagcaagtgaggtctctgatcggcaacgaggaatttttggactatatgccatcaatgaaacgcttcagaaaggaggaagagagtgaaggggctatatggtga

SEQ ID NO: 15640 - RNA, 9873 nt, synthetic construct
  misc_feature 1..9873: note = derived and/or modified CDS sequence (opt3) from DENV-3__JQ411814__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcattgggaacagagactttgtagaaggattgtcaggtgccacctgggttgatgtggtcctggagcacggcgggtgcgtgacgactatggcgaagaataaacccacactagacatcgagctccagaagaccgaagcaactcaactggccacacttaggaaactgtgtattgagggaaagatcaccaacataacgaccgatagccggtgccctacacagggcgaagctgtgttgccagaggaacaggaccagaattatgtctgtaaacacacttacgttgatcgcggttgggggaacggatgcggcctcttcggcaaggggagtctggtgacctgcgccaagtttcaatgtttagagcccattgagggaaaagtagtgcagtatgaaaatctgaagtacacagtcatcattactgtgcataccggtgaccagcaccaggttggcaacgagacacaaggggtgaccgcagaaatcactcctcaggcttccacgacagaggccatcctcccagaatatggaacccttggcctggagtgctctccgcgaactggtttggacttcaatgagatgattctactgaccatgaaaaacaaggcgtggatggtccatagacagtggtttttcgatctccccctgccttggacaagcggggccaccactgaaacaccaacgtggaataggaaagagcttctggtgacctttaagaacgcacacgctaaaaagcaagaagtagttgtgttgggctcccaggagggagccatgcacactgctctcacaggcgccaccgaaatacagaattcagggggaacaagtatcttcgcaggtcatctgaagtgtcggttaaaaatggacaagctggagctaaaaggcatgagctacgccatgtgcactaacacctttgtcctcaagaaagaggtgtctgaaacgcagcacgggaccattctgatcaaggtcgagtacaagggagaagatgctccctgtaaaatacctttctccacagaggacggccaaggtaaggcgcataacgggcgtcttattactgcaaatccagtggttaccaaaaaggaggaacccgtgaacatcgaggccgaaccgcctttcggcgagtcaaatatcgtaattggaatcggcgataacgctttgaaaattaattggtataagaaggggagcagtataggaaaaatgtttgaagccacagcacgcggtgccagaaggatggctatcctgggcgacactgcctgggatttcgggtctgtcggaggcgtgctcaactccctgggtaagatggttcaccagatttttgggagcgcatacaccgcgcttttctcgggcgtgtcttgggtcatgaaaatcggaatcggcgtgctgttgacgtggattgggctcaattccaagaacacatcaatgagttttagctgcatagctatcggaattatcaccctgtatttaggcgccgtagtgcaggcagacatgggttgtgttattaattggaaagggaaggagctgaagtgcggatccggcatcttcgtcactaacgaggtgcatacatggaccgaacagtacaaatttcaagccgattctcccaagcggctagctactgccatagcaggtgcttgggagaatggcgtgtgtgggatccgaagcaccacacgcatggaaaacctcctgtggaaacagattgccaatgagcttaactatatcttgtgggaaaataacattaagctgacggtcgttgtgggagacaccatcggcgtgctcgagcaggggaaaagaactctgacaccacagcctatggagttaaagtactcatggaaaacctggggaaaggcgaagatagtaacagccgaaactcaaaacagttccttcattatcgatggccccaataccccagagtgccccagcgcttctagggcatggaacgtctgggaagtggaggactatggttttggggttttcacgacaaatatttggctgaaacttcgggacgtgtacacccagttgtgtgatcaccgcctcatgtcagccgctgtcaaggacgaaagagccgtgcacgcagatatgggatactggatcgagagtcagaaaaacggcagctggaagctggagaaagcgtccctaatagaagttaagacttgcacctggcctaagtctcatacactgtggtcgaatggtgtgctcgagagcgacatgatcattccaaaatccctggccggcccgatctcacagcacaactataggcccgggtaccatactcaaaccgctggaccttggcaccttggcaagttggaactggattttaattattgcgaggggacaacggtagtcattaccgagaactgtggaactcgtggcccaagtttacggacaaccactgtgtctggtaaactcatccacgaatggtgctgtcgaagctgcacactgccccctcttagatacatgggggaggacggatgttggtatggcatggaaataaggccaatttccgagaaggaagagaatatggtgaaatcactggtcagcgccggttctggcaaggttgataacttcaccatgggggtgttgtgcctcgcaatcctgtttgaggaagtaatgcgcggaaagttcggcaaaaagcatatgatcgctggggtgctattcacgtttgtcctgctcctgtccggacagattacttggcgggacatggcccacacccttatcatgattggcagtaatgcaagcgatagaatgggtatgggggtgacatacttggccctgatagctaccttcaaaatccagccctttttagcgctcggattctttctgaggaagcttacttctcgcgagaacctgctactcggcgttggcctggccatggcaacaaccttgcaactgccggaagacattgagcagatggctaatgggatcgccttaggactcatggccctgaaacttattacacagttcgaaacttatcagctgtggaccgctttggtgtccctcacgtgttcaaacacaatcctgaccctaactgtcgcatggcgaaccgccacactgatacttgcgggtgtgagtctcctgcctgtttgccaaagctcgtccatgcggaagactgattggttgccaatgaccgtggctgccatgggcgtcccccctctgcccttatttatcttctctctcaaggacacgctgaaacgtagaagctggccacttaatgagggggtaatggcagtgggactggtttcaattttggccagttccctcctgaggaacgatgtgcctatggctggccccctagtcgcaggtgggctgcttatcgcctgttacgtgattacaggaacctctgcggacctcactgtagagaaggctgccgacgtgacatgggaagaggaagcagagcagaccggcgtcagccataacctgatgatcactgttgatgacgatggcacaatgcgcataaaagacgatgaaaccgagaatattttgacggtgttactgaagactgccctcctgatcgtgtccgggatctttccatactcaattccggctacccttctggtctggcacacatggcagaaacagacccaacggagcggagtgttgtgggacgttcctagtcccccagagacacagaaggccgaactagaggaaggtgtatatagaataaaacagcagggcatcctggggaagactcaagtgggagtcggcgtgcagaaggagggtgttttccataccatgtggcacgtgacgaggggggcagtcctcacacacaacggaaaacgactggagcccaattgggcttctgtgaagaaagatcttatttcctacggcggcgggtggcgcttaagcgcccagtggcaaaagggagaagaggtacaggtcatcgcggtggaacctggtaaaaacccaaagaattttcagactatgcccggcaccttccagacaaccactggggagattggagccatcgcactggactttaagcctggcacctcgggttcaccgataatcaaccgggaagggaaagttgtgggactctatggcaatggcgtcgtgacaaagaacgggggatacgtttctggtattgctcaaacgaatgccgagccagatggccccactcctgagttggaagaggaaatgttcaaaaagagaaacctgaccatcatggacctccatccagggagtggaaaaacaaggaagtatctgcccgctattgtgcgtgaggcaatcaagcgccggcttagaaccctgatattggcccctactagggtcgtggccgctgaaatggaggaggcgctaaaaggcctgccgattcgataccagacaaccgcaacgaagtccgaacacactggtcgggagatcgtagatctcatgtgccatgccacattcaccatgcgcttactgagccccgtgagagttccaaattataaccttatcattatggacgaagctcactttaccgatcctgcctctatcgcagccagggggtacataagcactcgggtcggaatgggcgaggctgcggccattttcatgacagcaacccccccaggcacagctgacgcctttcctcagtccaatgcacccatccaggacgaagagcgagatattccagagagatcatggaacagtgggaatgaatggatcactgacttcgccggaaaaacggtgtggtttgtgccgagcataaaggctggtaacgatattgccaactgtctgcgcaaaaatggcaagaaggtcatccaactctctaggaaaaccttcgacacagagtaccagaagactaaattgaacgattgggactttgtagtgaccacagatatctccgaaatgggggcgaatttcaaggcagaccgtgttattgatcctcggagatgcctgaaacccgtgatcctcaccgacggaccagagagggtcattctggccggccccatgcctgtgactgctgcctcagctgcacagcgccgaggtagagttgggcggaacccacagaaggagaatgatcaatatatatttacgggccagccccttaacaatgacgaagaccatgcccactggaccgaggctaagatgctactggataacatcaatacacctgaaggaattatcccggccttgttcgagccagaaagggagaaaagtgcagcgatcgacggcgagtaccgcttaaagggggaaagccgtaaaacttttgtggagctgatgagacggggagatctccccgtctggctggcccacaaggtggcttccgaaggtattaaatataccgacaggaagtggtgcttcgatggccagcgcaacaatcagatacttgaggaaaacatggacgtagagatctggacaaaagagggggaaaagaagaaactgcgacctagatggctcgatgcccggacctactctgaccccttggcactgaaggagttcaaagattttgctgccggaaggaagtcgattgcactagacctggtgactgaaatcggccgcgttccaagccatctcgcccacagaacaaggaatgctcttgataacctggtcatgttacatacgtcagagcacggtgggcgggcgtatcgtcacgccgtggaagagttgcctgagaccatggaaactctgctcctgcttggcctgatgattctcttgacaggaggcgcaatgctgttcttaatctccgggaaaggaataggtaagaccagtatcggcctaatttgtgtgatcgcttctagcgggatgctgtggatggccgagattcccctccaatggatcgcctccgcaatagtccttgaatttttcatgatggttctgttgattccagagcctgagaagcagcgcaccccgcaggacaatcaactggcttacgtggtaatcggaattctcacactggccgcgatcatagctgccaacgaaatgggccttctcgagactacgaaacgagatctgggtatgtcaaaggaacccggggtggtctctccaaccagctatttggacgtggacctgcatcctgcaagtgcctggacattatacgctgttgcaactaccgtgatcacacccatgctaagacacaccattgagaattccactgccaacgtcagcctggcggctatcgccaaccaggcagtagtgctcatgggccttgataaaggatggccaatttctaagatggacctgggcgttcctttgctggccctcgggtgctactcacaggtgaatcccctgacgcttacagctgccgtcttactgctcatcacccattatgcaataattggaccgggcttgcaggctaaagccactagggaagcgcaaaagcggaccgccgcaggtatcatgaagaacccaacagtggatgggatcatgactattgacctggatcctgtcatctacgactccaaatttgagaagcagctaggacaggtgatgctgctcgttctttgtgctgtgcagctgttgctgatgcgcaccagttgggccctctgcgaggcactgacattagctacgggccccataaccactctttgggaaggtagcccaggcaaattctggaatacaaccattgccgtatcgatggccaacatctttagagggtcttatctggcgggagctggcctcgcattctccattatgaagagcgtggggactggaaaaaggggcacaggttcacaaggggagaccctaggagaaaagtggaagaaaaagctgaatcagttgagtcggaaagagtttgatctgtacaagaaatctggcatcacggaagtcgaccgaaccgaggccaaggagggtctcaaaagaggcgaaataacacaccatgctgtttcccgcgggagcgccaagcttcagtggttcgtggagaggaacatggtcatccccgaaggacgggtgattgatctgggctgtgggcgtggaggctggtcatattactgcgcaggtttgaagaaagtaactgaggtgagagggtataccaagggaggccctggccacgaagagccggttcccatgagtacatacgggtggaatatcgtgaaactgatgagcggaaaggacgtcttttacctcccacctgagaaatgtgatactttactgtgcgacattggtgaatcctctcccagccctaccgtggaggaatccaggacaatccgcgtccttaagatggtggagccatggctgaagaacaatcagttctgtattaaagttctaaacccctatatgcctaccgtaatcgagcacctcgaacggctgcaacgaaagcatggcgggatgttggtgagaaatccactgtcaaggaactctactcacgagatgtactggataagtaatggaacgggcaacattgtctcgagcgtgaatatggtttcccgcctccttctgaaccggtttacaatgacccatagacgtcccactatcgaaaaagatgtggacttaggtgccgggaccaggcacgtcaacgctgagccggaaacacctaatatggacgtgatcggagagcggattaagcgcataaaagaggaacacaactctacgtggcattatgatgacgagaatccatacaagacctgggcgtatcacggctcatacgaagtaaaggccactggcagcgcatccagtatgatcaacggggtggttaaactgttgacaaagccctgggatgtcgtgcctatggtgacccagatggctatgactgacacaaccccattcggacagcaacgagtcttcaaagagaaggttgatacaagaactcccaggccgatgcctggtacccggaaagtgatgggcattacggccgaatggctctggcgcaccctggggagaaataagaggccccgactatgcacacgggaggagtttactaagaaagtacgtaccaacgcagccatgggagctgtgttcacagaagagaatcagtgggactctgccaaggcggcagtcgaagatgaggaattttggaaacttgtggacagagagcgcgagctgcataagctcggcaaatgtggtagctgcgtttataacatgatggggaagagggaaaaaaagctgggagagttcggcaaggccaaaggctcacgggctatctggtacatgtggttgggggccagatacctggaatttgaggcactcggattccttaatgaggatcactggttttcccgcgacaacagttatagcggtgtggaaggcgaggggctgcataagttaggatacattctgagggatatctctaaaataccaggcggtgctatgtatgccgacgacactgctgggtgggatacccgaatcacggaagacgatttgcacaatgaggaaaagattacacagcagatggaccctgagcaccggcaactcgccaacgcaatcttcaaactgacctaccagaataaggtcgtgaaggtacagagacccactccaacaggaaccgttatggatattatctccaggaaagaccagcgcggctcaggccaagtggggacttatggactaaacacctttacaaatatggaggtccagcttgtgcgtcagatggaaggtgagggcgtgctgagcaaggcggatctcgaaaacccccatctgcctgagaaaaagataacgcagtggttggaaaccaaaggggtcgagcggttaaagagaatggccatttcgggagacgattgcgttgtgaagccaatcgacgataggttcgctaacgccctgctcgcacttaatgacatgggcaaagtacgcaaggatatcccgcaatggcagccctctaaaggttggcacgactggcagcaggtgcctttttgtagtcatcacttccacgagctgattatgaaggacgggcgaaaactagtcgtgccatgccggccccaagatgaactgataggaagagctaggatctcccagggcgccggctggagcctccgcgagactgcatgtttggggaaggcctacgcgcagatgtggtcactgatgtattttcatagacgggaccttaggctggcttccaacgccatttgctctgcagttcctgtgcactgggtcccaacaagccgtaccacttggagtatccatgcccaccatcaatggatgacaaccgaagatatgctcacggtgtggaatcgagtatggattgaggacaacccctggatggaagataagacacctgttaccacttgggagaatgtgccgtacttaggaaaacgcgaggaccagtggtgtggttccctgatcggcttgaccagcagagctacatgggcccagaacataccaactgcaatccagcaagtccggtctctgattgggaatgaagagttcctcgattacatgccctcaatgaagaggttccgcaaagaagaggagagtgaaggagctatctggtga

SEQ ID NO: 15641 - RNA, 9873 nt, synthetic construct
  misc_feature 1..9873: note = derived and/or modified CDS sequence (opt3) from DENV-3__KM190937__SS-prME
  source 1..9873: mol_type = other RNA
acctcgctgtgcctcatgatgatgcttcccgccacactggctttccacttgacttccagagacggcgaacctaggatgatcgtggggaagaatgaacggggaaaatctttactgtttaagacggcctcaggtattaatatgtgtaccctgatagccatggatctcggcgagatgtgcgacgatacagtcacttacaaatgtccacatatcaccgaagttgagccggaagacattgattgctggtgtaacctgacaagtacctgggtgacttatgggacatgcaatcaggcgggagagcaccgccgagacaagcgtagcgtagctatcgcaccccatgtgggcatgggtcttgataccagaacgcagacttggatgtccgcagagggggcctggaggcaggtcgaaaaagtggagacctgggctctgcggcaccctggattcacaattttggcactctttctggcccattacatcggcacttctctgacccagaaggttgtgatattcatcctcttaatgctggtcacaccatcgatgaccatgcgctgtgtgggcgtagggaacagagactttgttgaaggactttcaggtgctacgtgggtggatgtcgtgttggagcacggcgggtgcgtgactacaatggccaagaataaacccaccctggacattgagctacagaagactgaagcgacacaactcgcaaccctgaggaaactttgtatcgagggaaagattacgaacatcaccacagatagccggtgccctactcagggcgaagccatactgccagaggaacaggaccagaattatgtctgtaaacacacctacgttgatcgcggttgggggaacggatgcggcttgttcggcaaggggagtctcgtgacatgcgctaagtttcaatgtctggagtccattgagggaaaagtagtgcagcatgaaaatttaaagtatactgtcatcattaccgtgcacacaggtgaccagcatcaggttggcaacgagatgcaaggggtgaccgccgaaatcactccccaggcatctacggctgaggtcatcctgcctgaatacggaacactcggccttgagtgcagcccacgaaccggtctggacttcaatgagatgatttccttgactatgaaaaacaaggcctggatggtgcacagacagtggtttttcgatctaccgctgccctggacctcaggggcgacagccgaaacccctacttggaataggaaagagctcctggtaacatttaagaacgcacacgctaaaaagcaagaagttgtggtccttggcagtcaggagggagccatgcatacggctctgaccggcgccactgaaatacagacaagcgggggaacctctatcttcgcaggtcacttgaagtgtcggctcaaaatggacaagctggagttaaaaggcatgtcctatgccatgtgcctgagctcatttgtgctaaagaaagaggtcagtgaaacacagcatgggactattctcatcaaggtggagtacaagggagaagatgctccatgtaaaatacccttctctaccgaggacggccaaggtaaggcgcacaatgggcgtctgattacggcaaaccctgttgtgaccaaaaaggaggaaccagtaaacatcgaggccgaacccccgttcggcgagtccaatatcgtcattggaatcggcgataaagctcttaagattaactggtacaagaaagggagctcgataggaaagatgtttgaagccacagcacgcggtgccagaaggatggctatcttgggcgacactgcctgggatttcgggtctgtgggaggcgttctaaattccctcggtaaaatggtgcatcagatttttgggtcagcatataccgcgctgttcggcggagtcagttggatgatgaagatcggcatcggggtgcttctgacatggattggattgaacagcaaaaatacttccatgtcttttagctgcatagctatcggcattatcaccctctacctgggtgccgtagtgcaggcagacatggggtgtgttattaactggaagggaaaggagttaaaatgcggctcaggtatcttcgtcacgaatgaggtgcacacatggaccgaacagtataagtttcaagccgatagtcctaaacggctggctactgccatagcaggcgcttgggagaacggggtgtgtggaatccgatccacaacccgcatggaaaatctactctggaagcagattgccaacgagctgaattacatcctttgggaaaacaatattaaattgactgtcgttgtgggcgacatcaccggggtgctggagcagggaaagagaacactcacgccccagccaatggagctgaaatatagctggaagacctggggcaaggcgaaaatagtaactgccgaaacacaaaactcttcattcattatcgatggtcctagtacccccgagtgcccaagcgcttccagggcatggaatgtctgggaagtggaggactacgggtttggagttttcacaactaacatttggttaaagctgcgggaagtgtatacccagctttgtgaccaccgcttgatgtctgccgctgtcaaagatgagagagccgtgcatgcagacatgggctactggatcgagtcgcagaagaacggtagctggaaactcgaaaaggcgtcctttatagaggttaagacgtgcacatggcccaaatcacacaccctgtggagtaatggcgtgctagaatctgatatgatcattcctaagagcctggccgggccaatctcccagcataaccacaggccgggataccacactcaaaccgctggcccctggcatctcgggaaactggagcttgacttcaattattgcgagggaacaactgtagtcatttcagaaaactgtggcacccgtggtcctagcttgcggacaacgaccgtgtctgggaagctgatccacgagtggtgctgtcgatcctgcactttaccacccctcagatacatgggagaagatggctgttggtatggtatggagataaggcctattaatgaaaaagaggagaacatggtgaagagtctggccagcgcaggctctgggaaggtcgacaattttacaatgggagttctttgcctggctatcttgttcgaagaggtgatgcgcggcaaattcgggaagatccatatgattgccggagtactctttaccttcgtgctgctactgtccggccagatcacttggcgggatatggcacacacactcattatgataggttcaaacgccagtgacagaatggggatgggagtcacctacctggctcttatcgcgacgtttaaaattcagccattcttggccctgggctttttcttaaggaagctcactagccgcgaaaatctgcttctgggcgtggggctagcaatggctgccaccctccgactgcccgaggatatcgaacaaatggccaacggaattgctttgggtctgatggcattaaaactcatcacacagtttgagacctatcagctgtggactgcccttgtttcgctgacatgttccaataccatattcacattgactgtggcgtggcggaccgctacgctcatcctggccggcatttctctactgccggtctgccagagctcaagtatgcgtaagacagactggcttcctatgaccgtggcagccatgggggctcaaccactccccctgtttatcttctccttgaaggatactctgaaaagaaggtcttggcctttaaacgagggagttatggcagtgggcctcgtcagcattctggcctcctcacttctgcgcaatgacgtacccatggcgggtccattggtggctgggggactcctgatcgcctgttacgttataaccggcacaagcgcagatctaactgtggaaaaggccgctgacgtcacctgggaggaagaggccgaacagacgggcgtgagtcataacctgatggtaacagtggacgatgacgggaccatgcggattaaagatgacgagactgagaatatccttacagtcctcctgaagaccgcattgttaatcgtttctggaatttttccttattccatacccgctactctgctcgtgtggcacacatggcagaaacagacccaaagaagcggtgtgctgtgggatgtcccatcgccgcctgaaacgcagaaggccgagcttgaagagggcgtgtacaggatcaaacagcaggggattttcggaaagactcaagttggcgtaggtgtgcagaaggagggggtctttcacaccatgtggcatgtgacacgaggagcggttctgacccacaacggcaaacgcttggaacccaactgggcctcagtgaagaaagacctaatctcttacggcgggggatggcggctgagtgcacagtggcaaaagggtgaggaagtccaggtgattgctgtagagccaggcaaaaatcccaagaacttccagacaatgcctgggatcttccagactaccacgggagaaataggcgccatcgctctcgattttaagccaggtacatccgggagccccattatcaatagagagggaaaagtcgtgggcctgtatggcaacggggttgtgactaagaatggaggttacgtctctggcattgcacaaaccaacgccgagcctgacgggccgacaccagaacttgaggaagagatgttcaaaaagaggaatttaaccatcatggatctgcatcccggaagcggcaaaactcgtaagtatctccctgccatagtgcgcgaagctattaagcggagattgaggaccctgatcctcgcgccaacacgagttgtggcagccgagatggaggaagctctgaaaggtcttcccatccggtaccagacgactgccaccaagtccgagcacacagggcgcgaaattgtcgacctgatgtgccatgcaacctttactatgagattgctatcacctgtgagggtaccgaactataatctgatcataatggatgaggcccacttcacagaccccgctagtattgcggcccggggatacatcagcacccgagtgggcatgggcgaagcagctgccatttttatgacggcaactccacctgggacagccgatgctttcccccagtctaacgccccaatccaggacgaggagagagacatacctgaacgctcctggaactcaggaaacgagtggattaccgattttgttggtaaaaccgtctggttcgtgcccagtatcaaggcgggcaatgacatcgcaaactgtctcaggaaaaatgggaagaaggtgattcaattaagccgtaaaacttttgatacagaatatcagaagaccaaactgaacgactgggatttcgtcgtaacaactgacatctccgagatgggagccaactttaaggctgatcgggtgattgacccaagaaggtgccttaaaccggttatactgacggatggccctgagcgcgtgatcctcgccggtcccatgccagtcaccgtggcttctgcagcccagcgaagagggcgggttggcaggaatccccagaaggaaaacgaccaatacattttcatgggacagcctttgaataacgatgaggaccacgctcattggacagaagccaagatgctgctcgacaatatcaacactccagagggcatcattcccgcactgttcgaacctgagcgcgagaaatcggcggccatagatggggaataccgtcttaagggagagagcagaaaaacctttgtggaactaatgcggaggggtgacctgccggtctggttggctcacaaggtggcctcagagggcatcaaatatacagatcgcaagtggtgcttcgacggggaacgaaataaccagattttagaggagaatatggatgtagaaatctggaccaaagagggagaaaagaagaaactgagaccacggtggctcgacgcaaggacttactccgatcccctggctcttaaggagtttaaagacttcgccgcaggccgcaagagtattgccctggatctcgtgacggaaatcggtagagttccttctcatttggctcacaggacccggaacgcgctggacaatctagtcatgctgcacacaagcgagcatgggggccgtgcctatcgccacgcagtggaggaactccccgagactatggaaacccttctgttattgggactgatgatactcctgacaggcggggctatgctttttctgatctccggaaaaggtattggcaagacctcaatcgggctcatttgtgtgatcgcctctagcggaatgttgtggatggccgatgtcccactgcagtggatagcaagtgctattgttttagagttctttatgatggtgctactgatccctgagcccgaaaagcaacgaactccacaggacaaccagctcgcctacgtagtgattggcatccttacactggcggctatagtcgccgcaaatgagatgggtttgctggaaacgaccaaaagagatctcgggatgtccaaggagcctggcgtggttagcccgacttcttatctggacgtggaccttcatcccgcctcagcttggacactctacgcagtcgccaccaccgtaatcacaccaatgctgaggcacactattgaaaactccacggcgaatgtgagtttggctgccatcgcaaaccaagccgttgtgctgatgggattagataaaggctggcctattagcaagatggacctaggggtccccctgctcgctcttggatgctatagccaggtgaatccactgaccttggccgcagctgtcctgctcctggtgacacattacgccatcataggccctggtcttcaggcgaaagccactcgggaggcacagaagcgcaccgctgccgggattatgaagaaccccacagttgatggaatcatgaccatcgacttagatccggtgatttacgactctaaattcgagaagcaactgggccaggtaatgctcttggtgctgtgtgcagtccagctactgctcatgagaacttcctgggctctttgcgaagttctgacgttggccacaggtccaatcaccactctgtgggagggcagccctgggaaattttggaacaccacaatagccgtgtcaatggcgaatattttcaggggaagttatctcgctggcgcagggctggccttttctatcatgaagtccgtcggaactggcaaacggggtaccgggagccagggagaaacattaggcgagaagtggaagaagaaacttaaccaactgtcacgaaaagagttcgatctctacaagaaaagtggtattacggaggtggacagaaccgaggctaaagaaggcctaaaacgcggggagatcactcaccacgccgtaagcaggggatccgcaaagctgcagtggtttgtggaacggaatatggttatacccgagggccgtgtgatcgatttggggtgtggaagaggcggttggtcttattactgcgccgggctgaagaaagtcacagaagtgaggggatataccaagggcggcccagggcatgaggagcccgtccctatgagcacttacggatggaacattgtgaaactcatgtccggtaaggacgttttctatcttccgcccgaaaaatgtgatacactgttgtgcgacatcggcgagtcatctccaagtcctaccgtagaagagtcgcgcacgattcgggtgctgaagatggtcgagccctggctcaagaataaccagttctgtatcaaagtgttaaatccttacatgccaaccgttattgaacacctggagcgacttcagagaaagcatgggggaatgctggtgaggaaccccctaagccgcaattccacacacgaaatgtactggatctctaacggcactggtaatatagtctcaagcgtgaacatggtatcccggctcctgttgaatagatttaccatgacacaccgtaggcctactattgagaaagatgtggacctgggggctggaacccggcatgttaacgcggaaccagagacacccaatatggacgtcatcggcgagcgcatcaagcgaattaaagaagaacacagttctacctggcattatgatgacgaaaacccgtacaagacttgggcctatcacggcagctacgaggtgaaggcaacggggtcagcttccagtatgataaacggagtggtcaaactccttacaaagccttgggatgttgtgccaatggtaacccaaatggccatgactgacaccacacccttcggtcagcagagagtgtttaaagaaaaggtcgatacgaggacccctcggccaatgcccggcactcgcaaagtgatggagatcacagcagagtggctgtggagaaccttagggaggaataagcgaccgcggctgtgcactcgtgaagagttcacaaagaaagttagaaccaacgccgctatgggagccgtgtttacagaagagaatcaatgggacagcgcgcgcgcagccgtcgaagatgaggagttctggaagttggtggacagggaacgggagctccataaactgggcaagtgtggttcttgcgtatataacatgatggggaaaagagaaaagaaactaggagagtttggcaaggctaagggctcccgcgccatttggtacatgtggcttggggcaaggtatctggagttcgaagctctcggatttctgaatgaggatcactggttctcacgagaaaacagctactcgggtgttgagggcgaagggttgcacaaactgggatacatcctccgggacatttctaagatccctggcggtgccatgtatgctgatgacactgccgggtgggacaccagaataacggaggatgaccttcataatgaggagaagatcacccagcagatggatcccgagcacaggcagctggcaaacgcgatttttaagttaacataccaaaataaagtggtcaaggtgcagcgcccaactcctaagggaaccgtgatggacatcattagtcgtaaagatcagcggggctccggccaggtcgggacatatggactgaacactttcaccaatatggaagcccaattgatcagacagatggagggtgaaggcgttctcagcaaggctgacctggagaacccccatccactagagaaaaagataacgcagtggcttgaaacaaaaggggtggagaggctgaagcgcatggccatttcaggagatgactgcgtagtgaagcccatcgatgaccgatttgcaaatgctctcctggccttgaacgatatgggcaaagtccggaaggacatccctcagtggcaaccatccaaaggttggcacgattggcaacaggtgccgttctgttctcaccatttccacgaattaattatgaaggacgggagaaaactggttgtgccctgcaggcctcaggacgagctcataggacgcgcaagaatcagccaaggcgccggctggagtcttcgggaaaccgcgtgtctggggaaggcttacgcccagatgtgggcactaatgtattttcataggcgtgatctgcgactcgcctccaatgctatttgcagcgccgtcccagtgcactgggtacccacttctcgcacaacctggtcaatccatgcacaccaccagtggatgactaccgaggacatgttgacagtttggaacagagtgtggattgaggataacccttggatggaagacaagacgccagtcaccacttgggaggatgtgccctacctgggaaaacgggaagaccaatggtgtggtagtcttatcggcctgacatccagggctacctgggcccagaatatactcactgcgatccagcaggttcgcagcttaattgggaacgaggagttcctggattatatgccttctatgaagagatttcggaaagaagaggaatcggagggagctatctggtga

SEQ ID NO: 15642 - RNA, 9873 nt, synthetic construct
  misc_feature 1..9873: note = derived and/or modified CDS sequence (opt3) from DENV-3__JQ920487__SS-prME
  source 1..9873: mol_type = other RNA
accagcctgtgcctcatgatgatgcttcccgccacactggctttccacttgacttcccgagacggagaacctaggatgatcgtggggaaaaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgttgctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctcctgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacagtcgttgtgggagacgtgatcggcgtactggagcaggggaaacgcacgttaacaccccagccaatggagctgaagtatagttggaagacttggggaaaagcgaagatagtcacagccgaaacccaaaattccagctttattatcgatggccctaacacacccgagtgcccatctgcttcaagagcatggaacgtgtgggaagttgaggactacggtttcggggtgtttactaccaatatttggcttaaattgagggaaatgtatacgcagctctgtgaccaccggctgatgagtgccgctgtcaaggatgagcgcgccgtgcacgcagacatgggatactggatcgagagccagaaaaacggctcctggaagctagaaaaggcgtctctgatagaggttaaaacatgcacctggcccaagtcgcatactctctggagcaatggtgtgctggaatccgatatgatcattcctaaatcacttgccggcccaatcagtcagcacaactacagaccggggtatcatacccaaacagctggaccctggcacttgggcaagctggagttagacttcaattactgcgaggggactaccgtagtcattacagaaaactgtggaacgaggggcccttctctccgtaccactacagtgagcggtaaactgatccacgagtggtgctgtcggtcctgcacccttccacccctgcgatatatgggggaagatggatgttggtacggcatggagataagacctattaatgaaaaggaggagaacatggtgaagtcattggtcagcgccggttctggcaaagcagacaattttactatgggggttctctgcctggctatcctattcgaagaggtgatgaggggaaagttcggcaaaaagcatatgatcgccggggcactgtttacattcgtactcctgctttccggacagattacctggcgcgatatggcccacacgttgatcatgattggcagtaacgctagcgaccggatgggtatgggggtgacttatctggcgttaatagccacctttaaaatccagccattcctcgcactgggatttttccttagaaagctgacatctagggaaaatctactcctgggcgtcggcttggctatggccaccactctgcaattacccgaggatattgaacagatggccaacgggatcgctctcggactgatggcacttaagctgattacacagtttgagacctaccagttgtggacagccctcgtgtccctgatgtgttcaaatactatcttcaccctaacggttgcgtggcgcacagctaccctgatacttgccgtgatcagtctcctgccggtctgccaaagctcgtccatgcgaaaaactgactggttgcctatgaccgtggcagccatgggtgttccacccctgcctttatttattttctctctcaaggatacactgaaacggcgtagctggccccttaacgagggcgtgatggctgtcgggctggtatcaatcttggcaagttcctttctcagaaatgacgtgccaatggccggacctctggttgcgggcggtctactgattgcttgttatgtgatcactgggacctctgccgatcttacggtcgaaaaggcagccgacgtgacatgggaggaagaggctgaacagaccggagtaagccataacctcatgataactgtggacgatgacggcacaatgaggattaaagatgacgagaccgagaacatcctgactgtcttgttaaagacagccctgctcatcgtttccggcattttcccctactcaataccagcaaccctgcttgtgtggcacacgtggcagaaacagactcaacgcagcggggtgctgtgggatgtcccgagtcctcccgaaacccagaaggctgagttggaagagggagtgtaccggatcaagcagcagggtatttttggcaaaacacaagttggggtaggagtgcagaaggagggcgtcttccataccatgtggcacgtgacaagaggtgccgttctaactcacaatgggaaaaggctggaaccaaactgggcgaatgtgaagaaagacctcatctcttatggaggcggctggaagctgtccgcccagtggcaaaagggggaggaagtccaggtgattgcagtagagcccggcaagaaccctaagaatttccagaccatgccaggtatctttcagacgacaactggcgaaataggggctatcgcccttgatttcaaacccggaaccagcggctcgcctattatcaaccgagagggtaaggtcgtggggttatacggaaatggcgttgtgaccaagaacggcgggtatgtctcaggaattgctcaaaccaatgcagagccggacggtccaactcccgaactggaggaagagatgtttaagaagcgcaacctcaccatcatggatttgcatcctggctctgggaaaacacggaagtacctgccagccatagtgagagaagccattaaaaggcgtctccgcacgctgatccttgctcccactcgggttgtggcggcagagatggaggaagccctgaagggattgcctatcagatatcagaccacagctaccaaaagtgagcacactggcagggaaattgtcgacctaatgtgccatgccacattcaccatgcgactgctctccccggtgcgggtacccaattacaacttaatcgtgatggatgaggcacactttacggacccagccagcatagctgcgcgcggttatatttctactagagttgggatgggagaagccgcagctatcttcatgacagccacccctcccggcaccgcagatgcctttccacagagcaatgctcctattcaggacgaggagagggacatccccgaacggtcctggaactcaggcaatgagtggataactgatttcgccgggaagacagtctggtttgtgccaagtattaaggcgggaaacgacatcgcaaactgtctgagaaagaatggtaagaaagtgatccaacttagcagaaagaccttcgatacagaataccagaaaactaagctgaacgactgggattttgtcgtaacgaccgacatttctgagatgggcgccaatttcaaggctgatcgcgtgatcgacccgaggcgttgcctcaaacctgttattttgacagatgggcccgagcgggtgatactggccggaccaatgcccgtcactgtggcttccgcagcccagagaaggggccgcgttggtcgaaaccctcagaaggaaaatgaccaatacatcttcaccgggcagccactcaacaatgatgaggaccatgctcactggacagaagccaaaatgctgcttgacaacattaatacccccgagggcatcatccctgcactatttgaaccggagagagagaagtcagcggccattgatggagaatatcggctgaaaggcgagagtaggaagactttcgtggaattgatgcgccgtggggacttaccagtctggctggctcacaaagtggccagcgagggaataaagtacacggatagaaagtggtgctttgacggtgaacggaacaatcagatcctcgaggagaacatggatgtagaaatttggaccaaagagggcgaaaagaaaaagctgaggccccgctggcttgacgcacgaacatattccgatcctctggctctcaaagagttcaaggactttgccgcagggagaaagtctatcgccttggatctggtgactgaaattggacgggttccctcgcatctagctcacaggacccgcaatgcgctggacaacctcgtcatgcttcatacaagcgagcacggcggtagagcctacaggcacgcagtggaggaactgccagagaccatggaaactttattgctgctcgggctgatgatccttctgacaggcggagctatgctattcttgatatcaggcaaagggatcggaaagacgtccattggtctgatctgtgtggtcgccagttctggcatgttatggatggccgatgttcctctacagtggattgcaagcgctatcgtgctggagtttttcatgatggtactccttatacccgagccagaaaaacaacggacccctcaggacaatcagctggcctatgtggtcattgggatcttgactctggcggctattgtggccgcaaacgagatgggactcctggaaacaaccaagcgtgatcttggcatgtccaaagagccgggtgttgtgtcacccacctcttacctcgacgtcgacctgcatccagccagcgcttggacattgtatgcagtagccactacggtgatcacccctatgctgcgccacacaatagaaaatagtactgcgaacgtttccttagctgccatcgcaaaccaagccgtggtcctaatggggctggataagggctggcccattagcaagatggacctcggagtgccacttctggctttgggctgctactctcaggtcaatcctctgaccctcacagccgcagtgctgcttttagttacccattacgctatcattgggcccggactgcaggccaaagcgactcgagaggcccagaagagaacggcagctggcatcatgaaaaacccgacagtggatggtataatgaccattgacctcgatccagtaatctatgactcaaagtttgagaaacaattgggacaggtgatgctgctagtcctgtgtgccgttcagctccttctgatgaggacttcctgggcattctgcgaagctctaaccctggccacaggacctatcactaccctctgggagggcagtcccggtaagttttggaatacaacgattgccgtgagcatggcgaacatcttccggggctcgtacctggctggggcaggattagccttttctataatgaagtccgtcggcaccgggaaacgcggaactggcagccagggtgaaacacttggggagaagtggaaaaagaaactgaatcaactctcaagaaaggagttcgatctatataaaaagagtggaattaccgaggtggacaggactgaggctaaggaaggcctgaaacggggtgagatcacacaccatgccgtatctcgaggctccgcaaagttgcagtggttcgtggaaagaaacatggttattccagaggggcgcgtgatcgatctgggatgtggcagaggcgggtggagctactattgcgccgggctcaaaaaggtcaccgaagtgcggggttacacgaaagggggacccggccacgaggagcctgtcccgatgtcaacctatggctggaatatagtgaaacttatgagtgggaaggacgtattttacctgcccccagaaaaatgtgatacattgctgtgcgacatcggagagagctccccttctcccactgtagaagagagccgtaccattagagtgctcaagatggtcgagccttggttgaaaaacaatcagttctgtatcaaggtgctgaacccatacatgcccacagttattgaacaccttgagaggctgcagcgcaaacatggtggcatgctagtgcggaatcctctctcccgaaactcaactcacgaaatgtattggatctctaatgggaccggaaacattgtcagttcggtgaatatggtaagcagactgttgctgaacaggtttacaatgacccatcgccggccaactatcgagaaggatgtggacctcggcgctggtacgagacacgttaacgcggaacccgagacaccgaatatggacgtcataggggagcgtattaggcggatcaaggaagaacactcctctacctggcattacgatgacgaaaacccttataaaacttgggcctaccacggatcatatgaggtgaaggcaaccggcagcgcttccagtatgatcaatggcgtggtcaaacttctgacaaagccatgggatgttgtgcccatggtaacgcaaatggccatgaccgacactacacctttcgggcagcagcgcgtgtttaaagaaaaggtcgatacccgaactccaagacccatgccgggaacaaggaaggtgatggagattaccgcagagtggttatggcggacactgggtcgcaacaaaagacctaggttgtgcactcgagaagagttcataaagaaagttcggaccaatgccgctatgggcgccgtgtttacggaagagaaccaatgggactctgcgcgtgcagccgtcgaagatgaggagttctggaagctcgtggacagagaacgcgagctgcataaactagggaagtgtggaagctgcgtatacaatatgatgggcaaaagggaaaagaaacttggtgagtttgggaaagctaagggatcacgggccatctggtatatgtggctgggcgcaagatacctcgagttcgaagctctgggctttttgaacgaggatcactggttctcccgcgaaaatagtcatagcggggttgagggagaaggtctgcacaaactcggctacattcttagggacatctctaagattcccgggggagccatgtatgctgatgacaccgccggctgggacacacgaatcactgaggatgacctgcacaacgaggagaaaataacccagcagatggatccagagcatcggcagttagcaaatgcgatctttaagctgacataccaaaacaaggtggtcaaagtgcagagacctactcccaagggtaccgtgatggacattatctccaggaaagatcagcgcgggtcaggacaggtcggcacgtatggcttgaatacattcaccaacatggaagcccaactcattcgtcagatggagggggaaggagttctgagcaaggctgacctagagaatccacaccttctggagaaaaaggtgactcagtggctcgaaacaaagggtgtagagcggctgaaaagaatggccatctcgggcgatgactgcgtggtcaagcccatagatgacaggttcgcaaacgctttgttagccctgaacgatatggggaaagtgcgcaaggacattcctcagtggcaaccatctaaaggatggcatgattggcagcaggttccgttttgtagtcaccacttccatgaactcatcatgaaggacggccgaaaacttgtggtcccctgccggcctcaggacgagctgatcggtagagcaaggatttcccaaggggccggatggagcctacgcgaaaccgcgtgtctgggcaaggcttacgcccagatgtgggcactcatgtattttcacagacgggatttgaggctggcctcaaatgctatatgctccgccgtgccagtacattgggttcccacttctcgtaccacatggagcatccacgcacatcaccagtggatgacgaccgaggacatgcttactgtgtggaaccgagtctggattgaggataatccttggatggaagacaagacaccagtgaccacttgggaggatgttccctacctgggcaaacgcgaagaccaatggtgtgggagtctcatcggattaacatccagagctacctgggcccagaacattctgacggcgatccaacaggtgcggagcttgataggtaatgaggagttcctggattatatgccttctatgaagaggtttcgcaaagaagaggaatcagagggcgctatctggtga

SEQ ID NO: 15643 - RNA, 9873 nt, synthetic construct
  misc_feature 1..9873: note = derived and/or modified CDS sequence (opt3) from DENV-3__JQ920488__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaagtctttactgtttaagacggcatcaggtattaatatgtgtaccctgatagccatggatctcggcgaaatgtgcgacgatacagtcacttacaagtgtccactgatcaccgaagttgaaccggaagacattgattgctggtgtaaccttacaagtacctgggtgacttatgggacatgcaatcaggcgggagaacaccgccgagacaagcgtagcgtagctctggcaccccacgtgggcatgggtttggataccaggacgcagacttggatgtccgcagagggggcctggaggcaggtcgaaaaggtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataagcccaccctagacatcgagctccagaagactgaagcgacacaactggcaacccttaggaagctgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgctcttagagcatggaacgtctgggaagtggaggactacggtttcggggtttttactaccaatatctggttgaaactcagggaaaagtatacgcagctgtgtgaccaccggctaatgtcagccgctgtgaaagatgagcgcgccgtccacgcagacatgggatactggatagagagtcagaagaacgaaagctggaagctggagaaagcgtccctcatcgaagtgaagacatgcacctggcccaaatctcatactctgtggtcgaatggcgttcttgagagcgatatgattatccctaagtccttggccggtccaatttcacagcacaactacagaccgggctatcatacccaaacagctgggccctggcacctgggaaaattagagctcgacttcaattactgcgaaggcactaccgtggtaatcacagagaactgtgggataaggggacctagtctgcgtacgaccactgtctctggcaaacttattcacgaatggtgctgtcggagctgcacactgccacccttgcgatatatgggtgaggatgggtgttggtacggaatggaaatcagacctatcaatgagaaggaggaaaacatggtgaaatccctcgtgtcagccggcagcggtaagaccgacaattttactatgggcgtcctgtgcctagcaattctgttcgaggaagttatgagggggaaattcggaaagaaacatatgatcgctggcgccctctttacattcgtgctgcttttgtctgggcagattacctggcgcgatatggcacacacgctgataatgatcggatccaacgccagtgaccggatgggcatgggtgtaacttatttagctctcattgcgacctttaagatccagccattcctggcccttgggtttttcctgagaaagctaacaagcagggagaatctcctgttgggagtgggcctggcaatggctaccactttacaactccccgaagatattgagcagatggccaacggcatcgccctggggcttatggctctgaaattgataacacagtttgagacctaccagctctggacagcactgatctctctaatgtgttccaatactattttcaccctgacggtcgcctggcgcacagcgacccttatcctcgctgtgatttcactgttgccggtttgccaaagtagctcgatgcgaaagactgactggctgcctatgaccgtggccgcaatgggagtcccacccttacctctctttatcttctccctgaaagatacacttaagcggcgttcttggcccctgaacgaaggtgtgatggccgttggcttggtgagcatactcgcttcaagttttctgagaaatgacgtcccaatggcagggcctctagtagccggaggcctgcttattgcgtgttatgtgatcactggtacctccgctgatctcacggttgagaaagccgcagacgtgacatgggaagaggaagccgagcagaccggggtctctcataacctgatgatcactgtggacgatgacggaacaatgaggattaaggatgacgagaccgaaaacatattgactgtattactgaaaacagctctcctgatcgtgagcggcattttcccctactccatcccagccacccttctggtctggcacacgtggcagaagcagactcaacgctcaggcgttttgtgggatgtgccgagccctcccgagacccagaaggcagaactagaggagggggtgtaccggattaaacagcagggaatctttggtaagacacaagtcggcgtgggggttcagaaagaaggagtattccataccatgtggcacgtgacaagaggcgctgtcctgactcacaatggtaagaggctcgagccaaactgggccaatgtgaaaaaggacctgataagttatgggggaggctggaaacttggcgcgcagtggcaaaaaggggaagaggttcaggtgatcgccgtcgaacccggaaagaaccctaaaaatttccagaccatgccaggtatttttcagacgacaactggcgagatcggggcaattgctttagatttcaagcccggaacctctggctcccctatcataaaccgagagggtaaagtggtagggctgtacggaaatggcgtcgtgacaaagaacggcgggtatgttagcggaattgcccaaaccaatgctgaaccggacggtccaactcccgagctcgaagaggaaatgtttaagaaacgcaacttgaccatcatggatctgcatcctggctcggggaagacacggaaatacctcccagcaatcgtgagagaggccattaagaggcgtctgcgcacgcttatcctggcccccactcgggtcgtggctgcggagatggaagaggcattgaaaggactacctataagatatcagaccacagccaccaagtcagaacacactggcagggagattgttgacctgatgtgccatgctacattcaccatgcgactcttatctccggtgcgggtccccaattacaacctgatcgtgatggatgaagcccactttacggacccagcaagtattgccgctcgcggttatatctccactagagtagggatgggagaggcggccgcaatattcatgacagctacccctcccggcaccgccgatgcatttccacagagcaatgcccctattcaggacgaggaaagggacatccccgagcggtcttggaacagcggcaatgaatggatcactgatttcgctgggaagacagtgtggtttgttccatccattaaagccggaaacgacatcgcgaactgtcttcgaaagaatggtaaaaaggtcattcaactgtcaagaaaaaccttcgatacagagtaccagaagactaagctcaacgactgggattttgtggtgacgaccgacataagtgagatgggcgcaaatttcaaagccgatcgcgtcatcgacccgaggcgttgcttgaagcctgtaattctgacagatgggcccgaacgggtgatcctcgctggaccaatgcccgttactgtggccagcgctgcacagagaaggggccgcgtcggtcgaaactctcagaaagagaatgaccaatacatcttcaccgggcagcctctgaacaatgatgaagaccatgcccactggacagaggctaagatgcttctagacaacattaataccccagaaggcataatccccgccctgtttgagcctgagagagaaaaatccgcagcgattgatggagagtatcggttgaagggcgaatcaaggaaaactttcgtggagttaatgcgccgtggggacctgccggtttggctcgcccacaaggtggctagtgaaggaatcaagtacacggatagaaaatggtgctttgacggtgagcggaacaatcagattctggaggaaaacatggatgtcgagatctggaccaaggaaggcgagaaaaagaaacttaggccacgctggctggacgcccgaacatatagcgatcccctcgcattgaaggagttcaaggactttgctgccgggagaaaatccatagcactggatctagtgactgagatcggacgggtaccttctcatctggcccacaggacccgcaatgctctcgacaaccttgtgatgctgcatacatcggagcacggcggtagagcgtacaggcacgccgttgaagagttacccgaaaccatggagactttgctgctcctggggcttatgattctgctcacaggcggagcaatgttgttcctgatcagcggcaaggggattggaaaaacgtcaatcggtttaatatgtgtcgtggcttccagtggcatgctatggatggccgatgtgccactgcagtggattgcctctgcaatcgtcctcgagtttttcatgatggttcttctgattcctgaacccgagaagcaacggaccccacaggacaatcagttggcttatgtggtaatcgggatactgactctcgccgcgatcgtggctgccaacgaaatgggactgcttgagacaaccaaacgtgatctcggcatgagcaaggaacctggtgtcgtgtccccgacctcatacctggacgttgacttgcatcccgcatctgcctggacactgtatgctgtggcaactacggtcattaccccaatgttacgccacacaatcgagaatagcactgccaacgtaagtctagcggctattgccaaccaagcagtggttctgatggggctcgataagggctggcctatctccaaaatggaccttggagtgcccctgttggccctgggctgctacagccaggtcaatccactcaccctgacagctgccgtgcttttactggtcacccattacgcaataattgggcctggactccaggctaaggccactcgagaggcgcagaaaagaacggccgcaggcatcatgaagaaccccacagtggatggtatcatgaccattgacttggatccggttatctatgactctaaatttgaaaagcaactgggacaggtgatgctactggtactctgtgctgtgcagcttctgttgatgaggacttcatgggccttctgcgaggcactgaccctcgctacaggaccaataactaccctgtgggaaggctcccctggtaagttttggaatacaacgattgccgtcagtatggccaacatcttccggggcagctacttagcgggggctggacttgcattttcgattatgaaatctgttggcaccgggaagcgcggaactggctcccagggtgagacactgggggaaaaatggaagaaaaagctcaatcaactaagcagaaaagagttcgatctgtataagaagtcaggaatcaccgaggtggacaggactgaagccaaagagggcttgaagcggggtgaaataacacaccatgctgtcagtcgaggctctgccaaactgcagtggttcgtggagagaaacatggtaatccccgaagggcgcgtgattgatctcggatgtggcagaggcgggtggtcctactattgcgcagggcttaagaaagttaccgaggtgcggggttacacgaaagggggaccaggccacgaggaacccgtccctatgagcacctatggctggaatatcgtgaagctgatgtcagggaaagacgtcttttacttgccgcccgagaagtgtgatacactgctctgcgacattggagaaagtagcccatcccctactgtggaggagtctcgtaccatcagagttttaaaaatggtagaaccctggctgaagaacaatcagttctgtattaaagtgcttaacccttacatgccaacagtcatcgagcacctggaaaggctacagcgcaagcatggtggcatgctcgtgcggaatcccctgagccgaaactccactcacgagatgtattggatatcaaatgggaccggaaacattgtttctagtgtgaatatggtctcgagattgctgctcaacaggtttacaatgacccatcgccggcctactatcgaaaaggatgtggaccttggcgccggtacgagacacgtaaacgctgagccagagacacccaatatggacgtgatcggggaacgtattaggcggataaaagaggaacacagctccacctggcattacgatgacgagaacccgtataagacttgggcgtaccacggatcttatgaagttaaagccaccggctcagcaagctccatgatcaatggcgtcgtgaagctgttaacaaaaccttgggatgtggtcccaatggttacgcaaatggctatgaccgacactacacccttcgggcagcagcgcgtgtttaaggagaaggtagatacccgaactcctagaccaatgcccggaacaaggaaagtgatggagattaccgccgaatggctgtggcggacattgggtcgcaacaagagaccgaggctctgcactcgagaggagttcatcaaaaaggtccggaccaatgcagccatgggcgctgtgtttacggaggaaaaccaatgggacagtgcccgtgcggcagttgaggatgaggagttctggaaactggtggacagagagcgcgaactacataaacttgggaaatgtggatcttgcgtctacaatatgatgggcaagagggagaagaaactgggtgagtttgggaaggccaaaggaagccgggctatttggtatatgtggctcggcgccagatacctggagttcgaggcattgggctttctgaacgaagatcactggttctcacgcgaaaattcccatagtggggtggaaggagagggtctccacaaacttggctacatcctgagggacataagcaaaatccctgggggagctatgtatgccgatgacaccgctggctgggacacacgaattactgaggatgacttacacaacgaagagaagatcacccagcagatggatcccgaacatcggcagctggccaatgcaatttttaagttgacataccaaaacaaagtagttaaggtgcagagaccaactcctaaaggtaccgtcatggacatcatatctaggaaggatcagcgcgggtccggacaggtgggcacgtatggcctcaatacattcaccaacatggaggcgcaactgattcgtcagatggaaggggagggagtgctatcaaaagccgaccttgagaatccccatctgctcgaaaagaaggtcactcagtggctggagacaaaaggtgttgaacggttgaagagaatggctatcagcggcgatgactgcgtggtaaaaccaatcgatgacaggttcgccaacgcattactggctctcaacgatatggggaaggtgcgcaaagacattccccagtggcaaccttcgaagggatggcatgattggcagcaggtcccattttgttctcaccacttccatgagcttataatgaaggacggccgaaaactggtggttccgtgccggccccaggacgaactaatcggtagagccaggattagtcaaggggcaggatggtccctgcgcgagaccgcctgtctcggcaaggcgtacgctcagatgtgggccttgatgtattttcacagacgggatctgaggcttgcaagcaatgccatctgctcagctgtgcctgtccattgggtgccaacttcccgtaccacatggtctattcacgcccatcaccagtggatgacgaccgaggacatgctgactgtatggaaccgagtttggatcgaagataatccctggatggaggacaaaacacctgtgaccacttgggaagatgtcccatacctcggcaagcgcgaggaccaatggtgtgggagcttaataggactgacaagtagagcaacctgggctcagaacatcttgacggccattcaacaggtgcggtccctgatcggtaatgaggagttcctcgattatatgcccagcatgaaaaggtttcgcaaggaggaagagtctgaaggcgcgatttggtga

SEQ ID NO: 15644 - RNA, 9873 nt, synthetic construct
  misc_feature 1..9873: note = derived and/or modified CDS sequence (opt3) from DENV-3__JQ920489__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaagtctttactgtttaagacggcatcaggtattaatatgtgtaccttaatagccatggatctcggcgagatgtgcgacgatacagtcacttacaagtgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggatacccggacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacattaccacagatagccggtgccctactcagggcgaagccatcttgccagaggaacaggaccagaattatgtctgtaaacacacctacgttgatcgcggttgggggaacggatgcggcctctttggcaaggggagtctggtgacatgcgctaagttccaatgtttagagtccatagagggaaaagccgtacagcacgaaaatctgaagtatactgtgattatcaccgtccatacaggtgaccagcaccaggtgggcaacgagacccaaggggttactgcagaaattacgccccaggcttctacagtggaggccatcctccctgaatacggaacccttggcctggagtgcagcccacgaactggtttggactttaatgagatgatcctcctgaccatgaaaaacaaggcgtggatggtccatagacagtggttctttgatctcccgctgccctggacatccggggccaccactgaaacacctacgtggaataaaaaggagcttctggtgaccttcaaaaacgcacacgctaagaagcaagaagtagttgtgttgggctcacaggagggagccatgcacactgctctcacaggcgccaccgaaattcagacaagtgggggaactagcatatttgcaggtcatctgaaatgtaggttaaagatggacaaactggagctaaagggcatgtcttatgccatgtgcctcaatgctttcgtcctgaaaaaggaggtgtccgaaacccagcacgggacgatccttattaaggtcgagtacaaaggagaagatgcgccatgtaagatccccttctcaaccgaggacggccaaggtaaagcacataacgggcggttgataacagccaaccctattgtgactaagaaagaggaaccagttaatatcgaggctgaacccccgtttggcgagagcaacatcgtgattggaatcggcgataaggccctgaagattaattggtacaaaaaggggagttctataggaaaaatgttcgaagcaaccgcccgtggtgctcgcagaatggccatcctcggcgacacagcatgggattttgggtccgtaggaggcgtcctgaacagccttggtaagatggtgcaccagattttcgggtcggcgtatactgctctgttttctggcgtttcctggatcatgaaaatcggaattggcgtgttgctcacctggatagggctaaattcaaagaacacgagtatgagcttctcctgcatcgtcattggaatcattacattatacctgggcgccgtggtacaggcagacatgggttgtgtgatcaattggaaggggaaagagctaaagtgcggatctggcatatttgttaccaacgaggtccatacttggacagaacagtataaattccaagccgatagccctaagaggctcgctaccgccatcgccggtgcttgggagaatggcgtgtgtgggattcggtcaactacccgaatggaaaacctgctttggaaacagatcgccaatgagttgaactacattctgtgggaaaataacatcaagctcacaatagtggtcggagacgttattggcgtgctggagcaggggaaacgcacgttaacaccccagccaatggagctgaagtatagttggaagacttggggaaaagcgaagatcgtgacagccgaaacccaaaattccagctttattatcgatggccctaacacacccgagtgcccatctgcttcaagagcatggaacgtatgggaagtcgaggactacggtttcggggtgtttactaccaatatatggcttaaattgagggaaaagtatacgcagctctgtgaccaccggctgatgagtgccgctgttaaagatgagcgcgccgtgcacgcagacatgggatactggatcgagagccagaagaacggctcctggaagctagaaaaagcgtctctgattgaggtcaagacatgcacctggcccaaatcgcatactctctggagcaatggtgtgctggaatccgatatgatcattcctaagtcacttgccggcccaatcagtcagcacaactacagaccggggtatcatacccaaacagctggaccctggcacttgggcaaactggagttagacttcaattactgcgaggggactaccgttgtgataacagaaaactgtggaattaggggcccttctctccgtacgaccactgtaagcggtaagctgatccacgagtggtgctgtcggtcctgcacacttccacccctgcgatatatgggggaagatggatgttggtacggcatggagatcagacctattaatgaaaaggaggagaacatggtcaaatcattggtgagcgccggttctggcaagaccgacaattttactatgggggtgctctgcctggcaatcctattcgaagaggtcatgaggggaaaattcggcaagaaacatatgattgctggggccctgtttacattcgttctcctgctttccggacagataacctggcgcgatatggcacacacgttgatcatgattggcagtaacgccagcgaccggatgggtatgggggtgacttatctggctttaatcgcgacctttaagattcagccattcctcgccctgggatttttccttagaaagctgacatctagggaaaatctactcctgggcgtaggcttggcaatggctaccactctgcaattacccgaggatatcgaacagatggccaacgggatagccctcggactgatggctcttaaactgatcacacagtttgagacctaccagttgtggacagcactcatttccctgatgtgttcaaatactatcttcaccctaacggtggcctggcgcacagcgaccctgattcttgctgtcatcagtctcctgccggtgtgccaaagctcgtccatgcgaaagactgactggttgcctatgaccgttgccgcaatgggtgtgccacccctgcctttatttatattctctctcaaagatacactgaagcggcgtagctggccccttaacgagggcgtcatggccgtggggctggtttcaattttggctagttcctttctcagaaatgacgtgccaatggcaggacctctggtcgccggcggtctactgatcgcgtgttatgtaatcactgggacctctgctgatcttacggtggaaaaagccgcagacgttacatgggaggaagaggccgaacagaccggagtgagccataacctcatgattactgtcgacgatgacggcacaatgaggataaaggatgacgagaccgagaacatcctgactgtgttgttaaaaacagctctgctcattgtatccggcatcttcccctactcaattccagccaccctgcttgtgtggcacacgtggcagaagcagactcaacgcagcggggtcctgtgggatgttccgagtcctcccgaaacccagaaggcagagttggaagagggagtgtaccggatcaaacagcagggtatatttggcaagacacaagtgggggtcggagtgcagaaagagggcgttttccataccatgtggcacgtaacaagaggtgctgtgctaactcacaatgggaagaggctggaaccaaactgggccaatgtcaaaaaggacctcatctcttatggaggcggctggaagctgtccgcgcagtggcaaaaaggggaggaagtgcaggttattgccgtggagcccggaaagaaccctaaaaatttccagaccatgccaggtatctttcagacgacaactggcgaaattggggcaatcgctcttgatttcaagcccggaaccagcggctcgcctataattaaccgagagggtaaagtcgtggggttatacggaaatggcgtagtcacaaagaacggcgggtatgtgtcaggaatcgcccaaaccaatgctgagccggacggtccaactcccgaactggaggaagagatgtttaagaaacgcaacctcaccatcatggatttgcatcctggctctgggaagacacggaaatacctgccagcaattgttagagaagccatcaagaggcgtctccgcacgctgatacttgcccccactcgggtggtcgctgcggagatggaggaagcactgaaaggattgcctattagatatcagaccacagccaccaagagtgagcacactggcagggaaatcgtggacctaatgtgccatgctacattcaccatgcgactgctctccccggttcgggtgcccaattacaacttaattgtcatggatgaggcccactttacggacccagcaagcatcgccgctcgcggttatatatctactagagtggggatgggagaagcggccgcaattttcatgacagctacccctcccggcaccgccgatgcatttccacagagcaatgcccctatccaggacgaggagagggacatccccgaacggtcctggaactcaggcaatgagtggattactgatttcgctgggaagacagtatggtttgtgccaagtatcaaagccggaaacgacattgcgaactgtctgcgaaagaatggtaaaaaggttatacaacttagcagaaaaaccttcgatacagaataccagaagactaagctgaacgactgggattttgtcgtgacgaccgacatctctgagatgggcgcaaatttcaaagccgatcgcgtgattgacccgaggcgttgcctcaagcctgtcatcttgacagatgggcccgagcgggtaatcctggctggaccaatgcccgtgactgttgcctccgctgcacagagaaggggccgcgtgggtcgaaactcacagaaagaaaatgaccaatacattttcaccgggcagcctctcaacaatgatgaggaccatgcccactggacagaagctaagatgctgcttgacaacataaataccccagagggcatcattcccgccctatttgaacctgagagagagaaaagtgcagcgatcgatggagaatatcggctgaagggcgagagcaggaaaactttcgtcgaattgatgcgccgtggggacttaccggtgtggctggcccacaaggttgcttccgagggaattaagtacacggatagaaaatggtgctttgacggtgaacggaacaatcagatcctcgaggagaacatggatgtggaaatatggaccagggagggcgaaaagaaaaagctgcgcccacgatggcttgacgccagaacatattctgatcccctggcactcaaagagttcaaggactttgctgccgggcggaagtcgatcgcattggatctggtcactgaaattggaagggtgcctagccatctagcccaccgcaccagaaatgctctggacaacctcgtaatgcttcatacatcagagcacggcggtagggcgtaccggcacgccgtggaggaactgcccgagaccatggaaactttattgctgctcgggctgatgatccttctgacaggcggagcaatgctattcttgatttccggcaaagggatcggaaagacgagtataggtctgatttgtgttgtcgcttctagcggcatgttatggatggccgatgtgccactacagtggatcgcctccgcaattgtgctggagtttttcatgatggtcctccttatccctgagcccgaaaaacaacgtaccccacaggacaatcagctggcttatgttgtgatagggatcttgactctggccgcgattgtagctgccaacgagatgggactcctggaaacaaccaagcgcgatcttggcatgtcaaaagagcctggtgtggtctctccgaccagctacctcgacgtggacctgcatcccgcaagtgcctggacattgtatgctgttgcaactacggtgatcaccccaatgctgcgacacacaattgaaaattccactgccaacgtcagcttagcggctatcgccaaccaagcagtagtgctaatggggctggataagggctggcctatatctaagatggacctcggagttccccttctggccttgggctgctactcacaggtgaatccactgaccctcacagctgccgtcctgcttttagtgacccattacgcaattatcgggcctggactgcaggctaaagccactagagaggcgcagaagaggacggccgcaggcatcatgaaaaaccccacagtcgatggtattatgaccatcgacctcgatccggtgatatatgactccaagtttgagaaacaattggggcaggttatgctgctagtgctgtgtgctgtacagctccttctgatgcggaccagttgggccttctgcgaagcattgactctggctacaggaccaattactaccctctgggagggcagccctggtaagttttggaatacaacgatcgccgtgtcgatggccaacattttccgcggctcttacctggcgggggctggattagcattttccatcatgaaaagcgtcggcaccgggaaaagaggaactggctcacagggtgaaacacttggggagaagtggaaaaagaaactgaatcaactcagtaggaaggagttcgatctatataaaaagtctggaataaccgaggttgaccggatcgaggccaaggaaggcctgaaacgaggtgagattactcaccatgctgtgtccagaggcagcgccaagttgcagtggttcgtcgaacgcaacatggtgatccccgaggggagggtaattgatctgggatgtggcagagggggatggtcatactattgcgcaggcctcaaaaaggtgacagaagttcgtggttacaccaaagggggaccaggccacgaggagcccgtgcctatgagtacgtatggctggaatatcgtcaaacttatgagcgggaaggacgtgttttacctgccgcccgaaaaatgtgataccttgctgtgcgacattggagagtcctctccaagccctacagtcgaagagtccagaactatcagggtgctcaagatggttgagccctggctaaagaacaatcagttctgtataaaggtactgaacccttacatgccaaccgtgattgaacaccttgagcgcctgcagcggaaacatggtggcatgctagtccgaaatcccctctcaagaaactctacacacgaaatgtattggatcagtaatgggactggaaacatcgtgtcgagcgttaatatggtgtccaggctgttgctgaaccgctttaccatgacacatcggagacctaccattgagaaggatgtcgacctcggcgccggtactcgtcacgtgaacgctgaaccagagacgcccaatatgaacgtaataggggagaggatccggcgcattaaggaagaacactcttcaacatggcattacgacgatgaaaatccgtataaaacctgggcgtaccacggaagctatgaggtgaaggccactggctccgcaagttctatgatcaacggcgttgtcaaacttctgaccaagccttgggacgtggtgccaatggtcacacaaatggctatgacggataccactcccttcgggcagcagcgagtttttaaagaaaaggtggacacaagaacccctaggccaatgcccggaactcggaaggtaatggagattacagccgagtggttatggcgcaccctgggtagaaataaaaggccgcgattgtgcacacgggaagagttcatcaagaaagtgcgtactaacgcagccatgggcgctgtctttaccgaagagaatcaatgggatagcgccagagcggcagtggaagacgaggagttctggaagctcgttgatcgcgaaagggagctgcataaactagggaagtgtggatcatgcgtgtacaacatgatgggcaaacgggaaaagaaacttggtgagtttgggaaagccaagggatccagagctatatggtatatgtggctgggcgcccgctacctcgagttcgaagcactgggctttttgaatgaggaccactggttcagtagggaaaacagccattctggggtcgagggagaaggtctgcacaaactcggctacatccttcgagatatttccaagatccctgggggagctatgtatgccgacgatacggctggctgggacacccggattacagaggacgatctgcacaatgaggagaagatcactcagcagatggaccccgagcatagacagttagccaacgcaatatttaagctgacctaccaaaataaggtggtaaaagttcagaggccaacacctaagggtactgtgatggatattatctcacgcaaagaccagcgtgggagcggacaggtcggcacctatggcttgaacacgttcacaaatatggaagcgcaactcatccggcagatggagggggaaggagtgctgtcgaaggccgatctagagaacccccaccttctggagaaaaaggtgacccagtggctcgaaactaagggtgtcgagagactgaaaaggatggctatttctggcgacgattgcgttgtgaagccaatagacgatcgcttcgccaacgcattgttagctctgaatgacatggggaaagtacgaaaggatatcccccagtggcaacctagtaaaggatggcatgactggcaacaggtgccattttgttcccaccacttccatgaactcattatgaaggatggccggaaacttgtcgtgccgtgcagaccccaggacgagctgatcggtagggcccgcattagccaaggggcaggatggtcactaagagaaacagcctgtctgggcaaagcgtacgctcagatgtgggccctcatgtattttcaccggagggacttgcgtctggcatccaacgccatctgctctgctgttcctgtgcattgggtcccaaccagccgaactacctggagtatacacgcccatcaccagtggatgacaacggaggatatgcttaccgtgtggaatcgcgtatggatcgaggacaacccctggatggaagataagactcctgttacaacctgggaggacgtgccatacctgggcaaaagagaagatcaatggtgtgggtccctcattggattaactagccgggcaacatgggctcagaatatcctgaccgccattcagcaggtcaggtctttgatcggtaacgaggagttcctggactatatgccctcaatgaagcgctttagaaaagaagaggaaagtgagggcgcgatttggtga

SEQ ID NO: 15645 - RNA, 9873 nt, synthetic construct
  misc_feature 1..9873: note = derived and/or modified CDS sequence (opt3) from DENV-3__KF824902__SS-prME
  source 1..9873: mol_type = other RNA
acaagcctgtgcctcatgatgatgcttcccgccacactggctttccacttgacttccagagacggcgagcctaggatgatcgtggggaagaacgaacgggggaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtggccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaacaaccgagactcctacatggaataggaaagaactgttggtaacgtttaagaacgctcacgccaaaaagcaagaggttgtggtcctcggctcacaggaaggagctatgcacaccgccctgactggcgcaacagagatccagaatagtgggggaaccagcattttcgccggtcatttaaagtgtcggctgaaaatggataagctagaactcaaaggcatgtcttatgctatgtgcctgaacacatttgtgcttaagaaagaggtctccgagactcagcacgggaccatattgatcaaggtggaatacaagggagaggacgcgccatgtaaaattcccttctcaacggaagatggccaaggtaaggcacataacgggcgtctgatcaccgccaatcctgttgtgaccaagaaggaggagccagtaaacatagaagctgagcccccgttcggcgaaagcaatattgtcatcggaatcggcgacaaagccctcaagattaactggtacaagaaagggagttctatcggaaagatgtttgaggcaactgcccgcggtgctagaaggatggccattctgggcgataccgcatgggacttcgggtccgtgggaggcgttcttaatagcctgggtaaaatggtgcaccagatatttgggtcggcgtatacagctttgttcggcggagtctcttggatcatgaagattggcatcggggtgctcctgacttggatcggattaaactccaaaaatacctcaatgagttttagctgcattgtaataggcatcattacgctgtacctaggtacagtggttcaggccgatatggggtgtgtcatcaactggaagggaaaggaactcaaatgcggctccggtattttcgtgaccaatgaggtgcatacttggacagagcagtataagtttcaagcagactctcctaaacggctggccaccgctatcgccggcgcatgggaaaacggggtctgtggaatacgaagcactacccgcatggagaatcttttgtggaagcagatcgctaacgaactgaattacattctctgggagaacaatatcaaactgacagttgtggtgggcgatattatcggggtattagaacagggaaagagagccctgacgccccagccaatggagcttaaatattcatggaagacctggggcaaggcgaaaatagtcactgccgagattcaaaacagttccttcatcattgacggtcctaacacacccgaatgcccaagcgcttctagggcatggaatgtgtgggaggttgaagactacgggtttggagtgttcaccacaaacatctggttgaagctccgggaggtctatactcagacctgtgatcaccgcctgatgtcagccgctataaaagacgaaagagccgtgcacgcagatatgggctactggatcgagagtcagaagaatggtagctggaaactagagaaggcgtcctttattgaagttaagacgtgcacatggcccaaaacccatactctgtggtctaacggcgtgctcgagtcggacatgatcattcctaagagcctggccgggccaatctcccagcacaatcataggccgggataccacacccaaacagctggcccctggcaccttgggaaattggaactggatttcaactattgcgagggaactaccgtagtcataacagagaattgtggcacgcgtggtccttcattacggaccactacagtgagtgggaagctcattcatgaatggtgctgtcgatcttgcaccctgccaccccttagatacatgggagaggacggctgttggtatggtatggaaatcaggcctatcaacgagaaagaagagaatatggtaaagagcctggtctccgccggctcagggaaggttgataactttactatgggagtgttgtgcctcgcaattctgttcgaggaagtaatgcgcggcaaattcgggaagaaacacatgatcgctggagtgctatttacattcatgctgctcctgagcggccagattacctggcgggacatggcccatacgcttataatgatcggttctaatgcatccgatagaatggggatgggagtcacttacttggccctgattgctacctttaagatccagccattcttagcgctcggctttttcctgaggaaacttacaagtcgcgagaacctgctactcggcgtggggctggccatggcaaccactttgcaactgcccgaagacattgagcagatggctaatggaatcgccttaggtctcatggccctgaaacttataacacagtttgaaacctatcagctgtggacagctttggttagcctcacttgttctaacaccatcttcacgctgacagtggcatggcgaaccgccactctaattctggcgggcgtctcccttctcccggtgtgccaatcaagtagcatgcggaagaccgattggctgcctgttgctgtggccgcaatgggggtcccacccttgcctctgtttatcttctcgttaaaagacacactcaagcgtagatcctggcccctgaatgagggagtaatggccgtgggccttgtttctattctggctagctcattgctcaggaacgatgtgccaatggcaggtcctctggtcgccgggggactactgatcgcgtgttacgtgataactggcaccagtgctgaccttacggtagagaaagccgcagacgtgacatgggaagaggaagccgagcagaccggcgtctcccacaacctcatgattactgttgatgacgatgggacaatgcgcatcaaggacgatgaaaccgagaatatcctgactgtgttgttaaaaacagctctgctcattgtgtctggaatatttccctatagcatcccagccaccctgcttgtctggcatacgtggcagaagcagactcaacggtccggtgtgctgtgggacgttccgtcacctcccgagacccagaaagcagaattggaggaaggcgtatacagaattaagcagcaggggatcttcggaaagacacaagtgggcgtcggtgtgcagaaagagggggtttttcacaccatgtggcacgtgacaaggggagctgtcctaactcataacggcaagcgactggagccaaattgggccagcgtgaaaaaggatctcattagttacggcgggggatggcgcctgtctgcgcagtggcaaaaaggtgaagaggtacaggtcatcgccgtggaacccggccggaaccctaagaatttccagaccatgccagggatattccagacgacaactggagagatcggcgcaattgctcttgactttaagcccggtacctccgggagccctatcattaacagagaaggaaaagttgtgggcttatatggcaatggggtcgtgacaaagaacggaggttacgtttcgggcatcgcccaagctaatgcagagccggaggggccaacccccgaactggaggaagagatgttcaaaaagaggaacctcactataatggatttgcaccctggatcaggcaaaacccgtaagtatctgccagccattgtgcgcgaagccatcaagcggagactcaggacactgatccttgctcccacgcgagtcgtggcggcagagatggaggaagccctgaaaggtttgcctattcggtaccagactaccgctacaaagtctgagcataccgggcgcgaaatcgtagtgctaatgtgccacgccacttttacaatgagactgctcagtccggttagggtccccaattataacttaataattatggacgaggcacatttcaccgatccagcctccatcgctgcgcggggatacattagcacgcgagtgggcatgggcgaagccgcagctatctttatgactgccacacctcccgggaccgcagaggccttcccacagtctaatgctcctatacaggacgaggaaagagatattcccgagcgcagctggaactccggaaatgaatggatcaccgactttgtgggtaaaactgtctggttcgtaccatcaatcaaggccggcaacgacattgcgaactgtctgaggaaaaatgggaagaaggtgatccaacttagtcgtaaaacatttgataccgagtatcagaagacaaaactgaacgactgggatttcgttgtgactacggacattagcgagatgggagcaaattttaaggccgatcgggtcatagacccgagaaggtgcctcaaacctgtgatcttgaccgatggccccgaacgcgttattctggctggtccaatgcccgtgacagccgcttctgcagcccagcgaagagggcgggtcggcaggaaccctcagaaggagaatgaccaatacatcttcatgggacagccactcaacaatgatgaagaccacgctcactggactgaggccaagatgctgcttgataacatcaatacccccgaaggcattatacctgcactattcgagccggagcgcgaaaaatccgcggccatcgacggggagtaccgtctgaagggagaatcaagaaaaacatttgtggagttgatgcggaggggtgacttaccagtatggctggctcataaggtggccagtgaaggcattaaatataccgatcgcaagtggtgcttcgacggggagcgaaacaatcagatcctcgaggaaaacatggatgttgagatttggactaaagaaggagagagaaagaagctgcggcccaggtggcttgacgcacgcacgtacagcgatcctctggctctcaaagaatttaaggacttcgccgcaggcagaaaatccatcgccttggatctggtcaccgagataggtagggtgccctctcacctagctcatcggacacgtaatgcgctggacaacctcgtgatgcttcacacttcggagcacgggggccgcgcctatcgacatgcagtcgaggaactgccagaaaccatggagacattattgctgctcggactgatgatccttctgaccggcggggctatgctctttttgattagcggaaagggtatcggcaaaacttcaattgggctgatctgtgttatagtgtccagtggaatgttatggatggccgatgtacctctacagtggattgcctctgcaatcgtgctggagttctttatgatggtcctccttattcccgaaccagagaagcaaagaacacctcaggacaatcagctggcttacgtggttatcggcatattgacgctggccgcgatcgtggctgccaacgaaatgggtctcctggagaccactaagagggatcttgggatgagcaaagaaccgggcgtcgtatcccccacatcatatctcgacgtggatctgcacccagcatctgcctggaccttgtacgctgttgcaaccacagtgattactcctatgctgcggcatacgatcgagaatagcaccgccaacgtcagtttagcggctattgccaaccaagcagtggtcctaatgggactggacaagggctggcccatctccaaaatggacctcggggtgccacttctggccttgggatgctatagccaggttaatcctctgacactcactgctgccgtgctgcttttagtaacccactacgcaataattggccccggtctgcaggctaaggccacacgcgaggcgcagaaaagaaccgccgcagggatcatgaagaacccgactgtggatggaatcatgacgattgacctcgatccagtcatctacgactctaagttcgaaaaacaattgggccaggttatgctgctagtgctgtgtgctgtccagctccttctgatgaggacatcatgggccttgtgcgaggcactgaccctcgctactggtcctataaccacactgtgggaaggctcccccgggaagttttggaatactaccattgccgtgagtatggccaacatcttccggggaagctatttagcgggcgctgggcttgcattttcgattatgaaatctgtaggaacaggcaagcgaggtacggggtcccagggagagaccctgggcgaaaaatggaagaagaaactcaatcaactaagcagacgcgagttcgagctgtacaagaaatcaggtatcactgaagtggataggacagaggccaaggaaggcttgaaacgtggggaaaccactcatcacgctgttagtcggggatctgccaagctgcagtggtttgtggaaagaaacatggtcataccagagggcagggtgatcgacctcgggtgtggacgcggcggttggtcctattactgcgcagggcttaaaaaggtcacagaggtgcggggatataccaagggcggccccgggcacgaagaacctgttccgatgagcacgtacggatggaataccgtaaaactgatgtcaggtaaggatgtgttctatttgcccccagaaaaatgtgacacactgctctgcgatattggcgagagtagcccttcccccactgtcgaggaatctcgaaccatcagagtgttaaagatggttgagccttggctgaaaaacaatcagttctgtattaaggtgcttaacccatacatgcccacagtcatcgaacatctggagaggctacagcgcaagcacgggggaatgctcgtgcggaatcctctgagcagaaactccactcatgaaatgtactggatttcaaatggcaccggtaacatcgtatctagtgtgaatatggtttcgcgtttgctgctcaacaggtttacaatgacccaccggcgcccaactatagagaaagacgtcgatcttggggccggaacgcgacacgtgaacgctgagcccgaaacaccgaatatggacgtgattggcgagagaatcaagaggatcaaagaagaacacagctccacctggcactatgatgacgaaaacccttacaagacttgggcgtatcatggctcttacgaggtcaaagccaccgggtcagcaagctccatgattaatggagttgtgaagctgttaacaaagccatgggacgtagtgcccatggtcacgcaaatggctatgaccgatactacacctttcggtcagcagcgggtgtttaaagagaaggttgacacccgcactccaagacccatgccgggcacaaggaaagtgatggaaataaccgccgagtggctgtggcgaacattggggcggaacaagcgtcctagactctgcactcgcgaagagttcaccaaaaaggtcaggacgaatgcagccatgggagctgtgtttaccgaagagaaccaatgggagagtgcccgggcggcagtagaagatgaggagttctggaagctggttggcagagagcgcgagctacacaaacttggtaagtgtgggtcttgcgtgtataatatgatgggaaaaagggaaaagaaactgggcgagtttggcaaggccaaagggagccgagctatctggtacatgtggctcggagcccggtatctggagttcgaggcattgggttttctgaacgaagaccattggttctcaagagaaaattcctacagtggcgtcgagggggaaggactccacaaacttggctacattctgagggatatcagcaagattcccggtggggctatgtatgccgacgatacagctggatgggacactcgcatcaccgaggatgacttacacaacgaagagaaaataacacagcagatggatccagaacatcgtcagctggccaatgcaatctttaagttgacttaccaaaacaaagtggtgaaggtccagcggcctacccccaaaggcacggttatggacattatctctagaaaggaccagaggggctccggacaggtgggaacatatggtctcaataccttcactaacatggaggcgcaactgattcgccagatggagggcgaaggggtactatcaaaggccgatcttgagaatccacatctgctcgagaagaagatcacacagtggctggagaccaaaggagtggaacgattgaagcggatggctataagcggcgacgattgcgtcgtgaaacccattgacgatagatttgccaacgcattactggctctcaacgacatgggtaaggttaggaaggatatccctcagtggcaaccatcgaaagggtggcatgactggcaacaggtgccgttctgttctcaccacttccatgagcttatcatgaaggatggacgcaaactggtcgtgccctgcagacctcaggacgagctaattggccgggccaggataagtcaaggcgcagggtggtccctgaaggaaactgcctgtctcggaaaagcgtacgctcagatgtggagcttgatgtattttcaccgtcgagatctgcgccttgcctcaaatgcaatctgctccgccgtaccagttcattgggtgcccacctctagaacaacgtggagcattcacgctcatcaccagtggatgaccactgaggacatgctgacagtctggaaccgggtgtggatcgaagataatccttggatggaggacaagaccccagttactacatgggaggacgtgccctacctcggtaagagggaagatcaatggtgtggcagtttaattgggctgacctcccgcgccacgtgggcacagaacatcttgacagctatacagcaggtcagaagcctgatcggagacgaggagttcctcgattatatgccttctatgaaacggtttaggaaggaggaagagtcagagggcgccatttggtga

SEQ ID NO: 15646 - RNA, 9873 nt, synthetic construct
  misc_feature 1..9873: note = derived and/or modified CDS sequence (opt3) from DENV-3__KF824903__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcacaattactgtgcataccggtgaccagcaccaggttggcaacgacacacaaggggtgaccgctgagatcactccccaggcctctacggtcgaagcgattcttcctgagtacggaacactgggcttggaatgcagcccacgaaccggtctagatttcaatgagatgatcctgctcactatgaaaaacaaggcctggatggtgcatagacagtggtttttcgacctgccgcttccctggacctccggggcaacaaccgagactcctacatggaataggaaagaactgttggtaacgtttaagaacgctcacgccaaaaagcaagaggttgtggtcctcggctcacaggaaggagctatgcacaccgccctgactggcgcaacagagatccagaatagtgggggaaccagcattttcgccggtcatttaaagtgtcggctgaaaatggataagctagaactcaaaggcatgtcttatgctatgtgcctgaacacatttgtgcttaagaaagaggtctccgagactcagcacgggaccatattgatcaaggtggaatacaagggagaggacgcgccatgtaaaattcccttctcaacggaagatggccaaggtaaggcacataacgggcgtctgatcaccgccaatcctgttgtgacaaaaaaggaggagccagtaaacatagaagctgagcccccgttcggcgaaagcaatattgtcatcggaatcggcgacaaagccctcaagattaactggtacaagaaagggagttctatcggaaagatgtttgaggcaactgcccgcggtgctagaaggatggccattctgggcgataccgcatgggacttcgggtccgtgggaggcgttcttaatagcctgggtaaaatggtgcaccagatatttgggtcggcgtatacagctttgttcggcggagtctcttggatcatgaagattggcatcggggtgctcctgacttggatcggattaaactccaaaaatacctcaatgagttttagctgcattgtaataggcatcattacgctgtacctaggtacagtggttcaggccgatatggggtgtgtcatcaactggaagggaaaggaactcaaatgcggctccggtattttcgtgaccaatgaggtgcatacttggacagagcagtataagtttcaagcagactctcctaaacggctggccaccgctatcgccggcgcatgggaaaacggggtctgtggaatacgaagcactacccgcatggagaatcttttgtggaagcagatcgctaacgaactgaattacattctctgggagaacaatatcaaactgacagttgtggtgggcgatattatcggggtattagaacagggaaagagagccctgacgccccagccaatggagcttaaatattcatggaagacctggggcaaggcgaaaatagtcactgccgagattcaaaacagttccttcatcattgacggtcctaacacacccgaatgcccaagcgcttctagggcatggaatgtgtgggaggttgaagactacgggtttggagtgttcaccacaaacatctggttgaagctccgggaggtctatactcagacctgtgatcaccgcctgatgtcagccgctataaaagacgaaagagccgtgcacgcagatatgggctactggatcgagagtcagaagaatggtagctggaaactagagaaggcgtcctttattgaagttaagacgtgcacatggcccaaatctcataccctgtggtcgaacggcgtgctcgagagcgacatgatcattcctaagtccctggccgggccaatctcacagcacaatcataggccgggataccacactcaaaccgctggcccctggcaccttgggaaattggaactggatttcaactattgcgagggaacaactgtagtcataaccgagaattgtggcacacgtggtcctagtttacggacgaccactgtgtctgggaagctcattcatgaatggtgctgtcgaagctgcacactgccaccccttagatacatgggagaggacggctgttggtatggtatggaaatcaggcctatcaacgagaaagaagagaatatggtgaagtccctggtctcagccggcagcgggaaggttgataactttaccatgggagtgttgtgcctcgcaattctgttcgaggaagtaatgcgcggcaaattcgggaagaaacacatgatcgctggagtgctatttactttcatgctgctcctgtctggccagattacatggcgggacatggcccatacccttataatgatcggttccaatgcaagtgatagaatggggatgggagtcacgtacttggccctgattgctacttttaagatccagccattcttagcgctcggctttttcctgaggaaacttaccagccgcgagaacctgctactcggcgtggggctggccatggcaacaaccttgcaactgcccgaagacattgagcagatggctaatggaatcgccttaggtctcatggccctgaagcttataactcagtttgaaacatatcagctgtggaccgctttggtttctctcacatgttccaacactatcttcaccctgacggtggcatggcgaacagccaccctaattctggcgggcgtctcacttctcccggtgtgccaaagtagctcgatgcggaagactgattggctgcctgttgctgtggccgcaatgggggtcccacccttgcctctgtttatcttctccttaaaagacaccctcaagcgtagatcttggcccctgaatgagggagtaatggccgtgggccttgttagcattctggcttcaagtttgctcaggaacgatgtgccaatggcaggtcctctggtcgccgggggactactgatcgcgtgttacgtgataacaggcacttccgctgaccttaccgtagagaaagccgcagacgtgacgtgggaagaggaagccgagcagacaggcgtctctcacaacctcatgattaccgttgatgacgatgggactatgcgcatcaaggacgatgaaacagagaatatcctgaccgtgttgttaaaaactgctctgctcattgtgagcggaatatttccctattccatcccagccacactgcttgtctggcatacctggcagaagcagacgcaacggtcaggtgtgctgtgggacgttccgagccctcccgagactcagaaagcagaattggaggaaggcgtatacagaattaagcagcaggggatcttcggaaagacccaagtgggcgtcggtgtgcagaaagagggggtttttcacacaatgtggcacgtgaccaggggagctgtcctaacacataacggcaagcgactggagccaaattgggccagtgtgaaaaaggatctcatttcttacggcgggggatggcgcctgtccgcgcagtggcaaaaaggtgaagaggtacaggtcatcgccgtggaacccggccggaaccctaagaatttccagactatgccagggatattccagaccacgacaggagagatcggcgcaattgctcttgactttaagcccggtactagcgggtcgcctatcattaacagagaaggaaaagttgtgggcttatatggcaatggggtcgtgaccaagaacggaggttacgtttcaggcatcgcccaagctaatgcagagccggaggggccaacacccgaactggaggaagagatgttcaaaaagaggaacctcaccataatggatttgcaccctggatctggcaaaactcgtaagtatctgccagccattgtgcgcgaagccatcaagcggagactcaggaccctgatccttgctcccacacgagtcgtggcggcagagatggaggaagccctgaaaggtttgcctattcggtaccagacgactgctaccaagagtgagcatacagggcgcgaaatcgtagagtgcatgtgtcacgccacctttactatgagactactgtccccggtgagggttcccaattataacctcataattatggacgaagcacatttcacagatccagccagcatcgctgcgcggggatacatttctacccgagtcggcatgggcgaggccgcagctatctttatgacggccactcctcccgggacagcagaggccttcccacagagcaatgctcctatacaggacgaagagagagatattcccgaacgctcctggaactcaggaaatgagtggatcaccgactttgtgggtaaaaccgtgtggttcgtcccaagtatcaaggccggcaacgacattgcgaactgcttaaggaaaaatgggaagaaggtaatccaactgagccgtaaaacttttgatacagagtatcagaagaccaaacttaacgactgggatttcgtggttacaactgacatttctgaaatgggagcaaattttaaggccgatcgggtgatagacccgagaaggtgcctgaaacctgtcatcctcacggatggccccgagcgcgtgattttggctggtccaatgcccgttaccgccgcttccgcagcccagcgaagagggcgggtgggcaggaaccctcagaaggaaaatgaccaatacatcttcacaggacagccactgaacaatgatgaggaccacgctcactggactgaagccaagatgctcctggataacatcaatacccccgagggcattatacctgcacttttcgagccggaacgcgagaaatcagcggccatcgacggggaataccgtctaaagggagagagtagaaaaacatttgtcgaactgatgcggaggggtgacttgccagtgtggttagctcataaggtagccagcgagggcattaaatataccgatcgcaagtggtgtttcgacggggagcgaaacaatcagatcctggaagagaacatggatgtggaaatttggactaaagagggagaaagaaagaagctccggcccaggtggctggacgcacgcacgtactccgatcctcttgctctgaaagagtttaaggacttcgccgcaggcagaaaatctatcgccctcgatttggttaccgagataggtagggtcccctcgcacctggctcatcggacacgtaatgcgctagacaacctggtgatgctccacactagcgaacacgggggccgcgcctatcgacatgcagtggaggaacttccagagaccatggagacactgttattgctgggactcatgatcctgcttaccggcggggctatgctgtttctcatttcaggaaagggtatcggcaaaacttccattgggttgatctgcgtcatagttagttctggaatgctgtggatggccgatgtgcctttacagtggattgccagcgcaatcgtactagaattctttatgatggtgctgctcattcccgagccagaaaagcaaagaacacctcaggacaatcagcttgcttacgtcgtgatcggcatactgacgttggccgcgatcgttgctgccaacgagatgggtctgctcgaaaccactaagagggatctggggatgtccaaagagccgggcgtggtctcacccacatcttatcttgacgtagatctccacccagcaagcgcctggaccctgtacgctgtggcaaccacagttattactcctatgttgcggcatacgatcgagaatagtaccgccaacgtgtccctggcggctattgccaaccaagcagtcgtgttaatgggactagacaagggctggcccatcagcaaaatggacctgggggtcccactccttgccctgggatgttattctcaggtgaatcctttgacactgactgctgccgttctcctgcttgtgacccactacgcaataattggccccggtttacaggctaaggccacacgcgaagcgcagaaaagaaccgccgcagggatcatgaagaacccgactgtagatggaatcatgacgattgacctggatccagtgatctacgactcaaagttcgagaaacaactcggccaggtcatgttgctggttctatgcgctgtgcagctgctccttatgaggacatcctgggccctgtgtgaagcattgaccctggctactggtcctataaccacactctgggagggcagtcccgggaagttttggaatactaccattgccgtcagcatggccaacatcttccggggatcgtatctggcgggcgctgggttagcattttctattatgaaatccgtgggaacaggcaagcgaggtacggggagccagggagaaacccttggcgagaaatggaagaagaaactgaatcaactctcaagacgcgagttcgaactatacaagaaaagtggtatcactgaggtagataggacagaagccaaggagggcctgaaacggggggaaaccactcatcacgctgtgtctcgtggatccgccaagttgcagtggtttgttgagagaaacatggtgataccagagggcagggtcatcgacctggggtgcggacgcggcggttggagctattactgtgcagggctcaaaaaggtgacagaagtccggggatataccaagggcggccccgggcacgaggaacctgtgccgatgtcaacgtacggatggaataccgttaaacttatgagtggtaaggatgtattctatctgcccccagagaaatgcgacacattgctgtgtgatattggcgagagctccccttctcccactgtggaagagagccgaaccatcagagtcctcaagatggtggaaccttggttaaaaaacaatcagttctgcattaaggttctgaacccatacatgcccacagtgatcgagcatcttgaaaggctgcagcgcaagcacgggggaatgctagtccggaatcctctctccagaaactcaactcatgagatgtactggatttctaatggcaccggtaacatcgtgagttcggtaaatatggtgagccgtctgttgctgaacaggtttacaatgacccaccggcgcccaactatagagaaagacgttgatctcggggccggaacgcgacacgtcaacgctgaacccgagacaccgaatatggacgtgattggcgaaagaatcaagaggatcaaagaggaacattcctctacctggcactatgatgacgagaacccttacaagacttgggcgtatcatggctcatacgaggtgaaagccaccgggagcgcatccagtatgattaatggagtcgttaagcttctgacaaagccatgggacgtggtacccatggtgacgcaaatggctatgaccgatactacacctttcggtcagcagcgggtctttaaagaaaaggtggacacccgcactccaagacccatgccgggcacaaggaaagttatggagataaccgccgaatggttatggcgaacactggggcggaacaagcgtcctagattgtgtactcgcgaggaattcaccaaaaaggtgaggacgaatgcagccatgggagctgtctttaccgaggagaaccaatgggaatctgcccgggcggcagtggaggatgaagagttctggaagctcgtaggcagagagcgcgaactgcacaaactaggtaagtgcgggagctgcgtttataatatgatgggaaaaagggagaagaaacttggcgaatttggcaaggccaaagggtcacgagctatctggtacatgtggctgggagcccggtatctcgagttcgaagcactgggttttttgaacgaggaccattggttctccagagagaatagttacagcggcgtggaaggggagggactgcacaagctcggctacattcttagggatatctctaagattcccggtggggctatgtatgccgacgatacagctggatgggacactcgcatcaccgaagatgacctgcacaacgaggaaaaaataacacagcagatggatccagagcatcgtcagttagccaatgcaatctttaagctgacttaccaaaacaaagtcgtgaaggtgcagcggcctacccccaaaggcacggtcatggacattatctccagaaaggaccagaggggctcagggcaggttggaacatatggtttgaataccttcactaacatggaggcgcaactcattcgccagatggaaggcgagggggtgctgagcaaggccgatctagaaaatccacaccttctggagaaaaagatcacacagtggctcgaaaccaaaggagtagagcgactgaagcggatggctatatcgggcgacgattgtgtggtcaaacccattgacgatagatttgccaacgcattgttagctctgaacgacatgggtaaggtgaggaaggatatccctcagtggcaaccatctaaagggtggcatgactggcagcaggttccgttctgcagtcaccacttccatgagctcatcatgaaggatggacgcaaacttgtggtcccctgtagacctcaggacgaactgattggccgggccaggatatcccaaggcgcagggtggagcctaaaggagactgcctgcctgggaaaagcgtacgctcagatgtggtcactcatgtattttcaccgtcgagatttgcgcctggcctccaatgcaatctgttctgccgtgccagtacattgggttcccaccagcagaacaacgtggagtattcacgctcatcaccagtggatgaccactgaagacatgcttacagtgtggaaccgggtctggatcgaggataatccttggatggaggacaagaccccagtgactacatgggaagacgttccctacctgggtaagagggaggatcaatggtgcggctccctcattgggttaaccagccgcgccacgtgggcacagaacatcctgacagctatacagcaggtgagatctttgatcggagacgaagagttcctggattatatgccttcaatgaaacggtttaggaaggaagaggagagtgaaggcgccatttggtga

SEQ ID NO: 15647 - RNA, 9873 nt, synthetic construct
  misc_feature 1..9873: note = derived and/or modified CDS sequence (opt3) from DENV-3__JF504679__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacggccaaggtaaggcgcataacgggcgtcttataactgcaaatccagttgtgaccaaaaaggaggaacccgtaaacattgaggccgaaccgcctttcggcgagtcaaatatcgtcatcggaattggcgataacgctttgaaaatcaattggtataagaaggggagcagtattggaaaaatgtttgaagccacagcacgcggtgccagaaggatggctatactgggcgacactgcctgggatttcgggtctgtgggaggcgttctcaactccctgggtaagatggtgcaccagatctttgggagcgcatacaccgcgcttttctcgggcgtctcttgggtgatgaaaattggaatcggcgtactgttgacgtggatcgggctcaattccaagaacacatcaatgagttttagctgcattgctataggaatcattaccctgtatttaggcgccgtggttcaggcagacatgggttgtgtcatcaattggaaagggaaggagctgaagtgcggatccggcattttcgtgactaacgaggtgcatacatggaccgaacagtacaaatttcaagccgattctcccaagcggctagctactgtcatcgccggtgcatgggagaatggcgtttgtgggatacgaagcaccacacgcatggaaaacctcctgtggaaacagatcgctaatgagcttaactatattttgtgggaaaataacatcaagctgacggtggtggtaggagacaccattggcgtcctcgagcaggggaaaagaactctgacaccacagcctatggagttaaagtactcatggaaaacctggggaaaggccaagatcgtgacagcggaaactcaaaacagttccttcataattgatggccccaataccccagagtgccccagcgcctctagggcttggaacgtttgggaagtggaggactatggttttggggtcttcacgacaaatatctggctgaaacttcgggaagtgtacacccagatgtgtgaccaccgcttgatgtcagcagccgttaaggatgagagagctgtgcacgccgacatgggatactggattgagagtcagaaaaacggcagctggaagctcgaaaaagcatccctgatcgaggtaaagacttgcacctggcctaagtctcatacactatggtcgaatggtgtcctggaaagcgatatgataatcccaaaatccctcgcgggcccggtgtcacagcacaactataggcccgggtaccatactcaaaccgccggaccttggcacctgggcaagcttgagttggactttaattattgcgaggggacaacggtggtcattaccgaaaactgtggaactcgtggcccaagtctgcggacaaccactgtttctggtaaattaatccacgagtggtgctgtcgaagctgcacactcccccctctgagatacatgggggaagatggatgttggtatggcatggagattaggccaatctccgaacgcgaggagaatatggtgaagtcacttgtaagcgctggttctggcaaagtggacaacttcaccatgggggtcctgtgcttggccatactctttgaagaggtgatgcggggaaagttcggcaagaaacatatgattgcaggggttttctttacgttcatgctgctactgtccggacagatcacttggagagatatggctcacaccctcatcatgattggcagtaatgccagcgacaggatgggtatgggggtgacatacctggcacttatcgccacctttaagattcagcccttcttggctctgggatttttcttacgcaaactcacttctcgagaaaacctgcttctgggcgtcggcctagcgatggccacaaccatacaactcccggaggatatcgaacagatggcaaatgggattgctctgggattgatggccctgaagttaatcacacagtttgagacttatcagctctggaccgccctgatttcccttacgtgttcaaacacaatcttcaccctgactgtggcttggcggaccgcaacattgatactcgccggtgttagtctgctacctgtgtgccaaagctcgtccatgcgtaaaactgactggctgccaatgaccgtcgcggctatgggcgtaccccctcttcccctctttatcttctctctgaaggatacgttgaagagaaggagctggccactgaatgagggggtgatggccgttggattagtgtcaattctcgcaagttccctgcttcgcaacgacgtccctatggccggccccctggtggctggtgggttgctcatcgcatgttacgtaattacaggaacctctgccgatctgactgtggaaaaagcggctgacgtcacatgggaggaagaggccgaacagaccggcgttagccataacctaatgatcactgtggacgatgacggcacaatgcggataaaggatgacgagaccgagaatattctgacggtgcttctcaaaactgcactgttgatcgtctccgggatctttccatactcaattccggccaccttactggtgtggcacacatggcagaagcagacccaaagaagcggagttctctgggatgtacctagtcccccagaaacacagaaagctgagctggaagagggtgtgtataggataaagcagcagggcatccttgggaaaactcaagtcggagtgggcgttcagaaggagggtgtgttccataccatgtggcacgtcacgcgaggggccgtgctgacacacaacggaaagcgcttggaacccaattgggcatctgtaaaaaaggacctaatttcctacggcggcgggtggcggctgagcgctcagtggcaaaaaggagaggaagtccaggtgatcgccgttgagcctggtaagaacccaaaaaattttcagactatgcccggcaccttccagacaaccactggggaaattggagcgatcgccctcgatttcaagcctggcacctcgggttcaccgataatcaacagagaggggaaggtggtcggactgtatggcaatggcgtggttacaaaaaacgggggatacgtgtctggtattgcacaaacgaatgctgagccagacggccccactcctgaacttgaggaagagatgtttaagaaaaggaacttaaccatcatggatctgcatccagggagtggaaagacacgtaaatatctccccgccattgtccgcgaagctatcaagcggagattgaggaccctgatactcgcacctactcgagtggtagccgccgagatggaggaagctctgaagggccttccgattcggtaccagacaaccgcgacgaaatccgagcacactggtcgcgaaatcgtggacctgatgtgccatgcaacattcaccatgagattgctaagccccgttagggtcccaaattataacctgatcattatggatgaggcccactttaccgaccctgcttctatcgccgcacgggggtacataagcactcgagtgggaatgggcgaagccgctgcgattttcatgacagccacccccccaggcacagcagatgcttttcctcagtccaatgcccccatccaggacgaggagagagacattccagaacgctcatggaacagtgggaatgagtggatcactgatttcgcaggaaagacggtgtggtttgtcccgagcataaaagccggtaacgacattgctaactgtctcaggaagaatggcaaaaaggtaatccaattatctcgtaagaccttcgatacagaataccagaaaactaagctgaacgactgggattttgtggttaccacagacatctccgagatgggggccaatttcaaagcggatcgggtgattgaccctagaaggtgccttaagcccgtcatcctgaccgatggaccagagcgcgtgattctcgcaggccccatgcctgttactgtggcctcagctgcccagcgaagaggtcgggtcgggaggaacccacagaaagaaaatgaccaatatatatttacgggccagcccttgaacaatgatgaggaccatgctcactggaccgaagcaaagatgctgctcgacaacatcaatacacctgagggaattatcccggccctgttcgaaccagagcgcgagaagagtgctgccatcgatggcgaataccgtcttaaaggggagagcagaaagactttcgtggaactaatgcggaggggagacctgcccgtatggttggcacacaaagtggcgtccgagggtattaagtataccgatcgcaaatggtgctttgacggccagcgaaacaatcagatattagaagagaacatggatgttgagatctggacaaaggaaggggagaaaaagaagctgagacctcggtggctcgacgccaggacctactctgatcccctggctcttaaagaattcaaggactttgccgcaggacgcaaatcgattgctctggatctcgtcactgagatcggcagagtgccaagccatttggcccacaggacacggaatgcactggacaacctagtgatgctgcatacgtcagaacacggtgggcgtgcctatcgccacgctgtcgaggagctccctgaaaccatggagactcttctgttattgggcctgatgattctcctgacaggaggcgcgatgcttttcctgatctccgggaagggaataggtaaaaccagtatcggcctcatttgtgttatcgcctctagcgggatgttgtggatggcagaaattcccctgcaatggatcgcttccgccatagtgttagagtttttcatgatggtactactgattccagagcctgaaaagcagcgaaccccgcaggataatcaactcgcctacgtggtcatcggaattcttacactggcagctatcatagccgcgaacgagatgggcttgctggaaactacgaagagagacctcggtatgtcaaaagagcccggggtggtttctccaaccagctatctggatgtggaccttcatcctgctagtgcctggacactctacgcagtcgccactaccgtaatcacacccatgctgaggcacaccattgaaaattccactgctaacgtgagcttggcagccatcgcgaaccaggctgttgtgctgatgggcttagacaagggatggccaatttctaaaatggatctaggcgtccctctgctcgcccttgggtgctactcacaggtgaatcccctgacgttgacagcagccgtcctgctcctggtgacccattatgctatcataggaccgggccttcaggccaaggcaactcgggaggctcaaaaacgcaccgccgcgggtattatgaagaacccaacagttgacgggatcatcactattgatttagaccctgtgatctacgattccaagtttgagaaacagctgggacaggtaatgctcttggtgctgtgtgccgtccagctactgctcatgagaaccagttgggcactttgcgaagctctgacattggccacgggccccataaccactctgtgggagggtagcccaggcaagttctggaatacaaccattgcagtttcgatggctaacatctttagggggtcttatctcgccggagccggcctggcgttctccattatgaaaagcgtggggactggaaagcggggcacaggttcacaaggggaaaccttaggagagaaatggaagaagaaacttaatcagctgagtcgaaaggaatttgacctctacaaaaagtctggcatcacggaggtcgatagaaccgaggctaaagaaggtctaaagcgcggcgagacaactcaccatgcagtgtccagggggagcgccaaactgcagtggttcgtagaacggaacatggtgatacccgagggacgtgttatcgacttgggctgtgggagaggaggctggtcatattactgcgctggtctgaagaaggtgaccgaagtcagggggtatacaaaaggaggccctggccacgaggagccggtgcccatgagtacttacgggtggaatattgtcaagctcatgagcggaaaagatgtgttttaccttccacctgaaaagtgtgacaccctgttgtgcgatatcggtgagtcctctcccagccctacagttgaagagtcccgcaccattcgggtactgaaaatggtggagccatggctcaagaacaatcagttctgtatcaaggtcttaaacccctatatgcctgccgtgattgaacacctggagcgacttcaaagaaaacatggcgggatgctggttaggaatccactatcacgcaactctactcacgaaatgtactggatcagtaatggaacgggcaacatagtgtcgagcgtcaatatggtgtcccggctcctgttgaacagattcacaatgacccatcgtaggcccactattgagaaggacgtagatctgggtgcagggacccggcacgtgaacgccgaaccggagacacctaatatggacgttatcggagagcgcatccgaagaattaaagaagagcacaactctacgtggcattatgacgatgaaaatccatacaagacctgggcttatcacggctcatacgaggtcaaagcgactggcagcgcctccagtatgataaacggggtggtgaagctccttacaaagccctgggacgtcgttcctatggtgacccagatggcaatgactgatacaaccccatttggacagcaaagggtattcaaagaaaaggtggacacacggactccccgcccgatgcctggtaccagaaaagtcatggagatcacggctgagtggctgtggaggaccttaggccgaaataagcggccccgtctgtgcacaagagaagagtttactaaaaaggtgcgcaccaacgccgcaatgggggccgttttcacagaagagaatcagtgggattctgctaaggccgcggtggaagacgaggagttttggaaattggtcgatagggaacgggagctccataagctgggaaaatgtggcagctgcgtgtataacatgatgggtaagagagaaaaaaagctaggggagttcggaaaagcaaagggctcacgcgccatttggtacatgtggcttggcgctaggtacctggagtttgaagccctcgggttcctgaatgaggaccactggttttcccgagaaaacagttatagcggagtagagggtgaaggcttgcataagctggggtacatcctccgggatatttctaaaatcccaggaggcgcaatgtatgctgacgatactgccggttgggacaccagaataacggaggacgatcttcacaatgaggaaaagatcacacagcagatgaaccctgagcacaggctgttagctaatgccattttcaaactgacctaccaaaacaaggttgtgaaagtccagcgccccactccaacagggaccgtgatggacatcatttcccgtaaggatcagcggggatcaggccaggtgggcacttatgggttgaatacctttacaaacatggaagcacaactcgtcagacagatggagggagaaggtgttctgagcaaggcggacctagagaacccccatcttcctgagaaaaagatcacgcagtggctggaaaccaaaggcgtggagaggctcaagcgcatggccatatcgggggatgactgcgtagtgaaaccaattgatgaccgattcgctaatgccctgttggcattaaacgatatgggaaaggtccggaaggacatcccgcagtggcaaccctctaaaggctggcacgattggcagcaggtgcctttttgtagtcatcacttccacgaactgatcatgaaggacggtagaaaactcgttgtgccatgcaggccccaggatgagcttattgggcgcgctagaatatcccaaggagccggctggagcctgcgggaaactgcatgtctaggcaaggcctacgcgcagatgtggtcactgatgtatttccataggcgtgacctccgattggcttccaatgccatctgctctgcagtccctgtgcactgggtaccaacaagccgcaccacttggagtattcatgcccaccatcagtggatgacaaccgaggacatgctgacggtttggaacagagtgtggatcgaggataatccctggatggaagacaaaacacctgtcaccacttgggagaacgtgccgtaccttgggaagcgggaagatcaatggtgtggatccctgattggtctcaccagcagggctacatgggcccagaatatcccaactgcaatacagcaggttcgctctttaatcggcaacgaggagtttctggactacatgccctcaatgaagagattccggaaagaagaggaaagtgagggggctatttggtga

SEQ ID NO: 15648 - RNA, 9873 nt, synthetic construct
  misc_feature 1..9873: note = derived and/or modified CDS sequence (opt3) from DENV-3__KC425219__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcgcaggtcacctgaagtgtcgtttaaaaatggacaagctggagctaaaaggcatgagctacgccatgtgcactaacacctttgtgctcaagaaagaggtctctgaaacgcagcatgggaccatcctgattaaggtggagtaccgcggagaagatgctccctgtaagatccctttctccacagaggacggccaaggtaaagcgcacaacgggagacttataactgcaaatccagttgtgaccaagaaagaggaacccgtaaacattgaggccgaaccgcctttcggcgagtcaaatatcgtcatcggaattggcgataacgctttgaagatcaattggtataaaaaggggagcagtattggaaagatgtttgaagccacagcaaggggtgcccggcgaatggctatactgggcgacactgcctgggatttcgggtctgtgggaggcgttctcaactccctgggtaaaatggtgcatcagatctttgggagcgcatacaccgcgcttttctcgggcgtctcttgggtgatgaagattggaatcggcgtactgttgacgtggatcgggctcaatcccaaaaacacatccatgtcatttagttgcattgctataggaatcattaccctgtatttaggcgccgtggttcaggcagacatgggttgtgtcatcaattggaaggggaaagagctgaagtgcggaagcggcattttcgtgactaacgaggtgcacacatggaccgaacagtacaagtttcaagccgattccccaaaacgcctagctactgccatcgcaggtgcttgggagaatggcgtctgtgggataagatctaccacaaggatggaaaacctcctgtggaagcagatcgccaatgagcttaactatattttgtgggaaaataacatcaaactgacggttgtggtgggagacattatcggcgtactcgagcaggggaagcggaccctgactcctcagcccatggagttaaaatacagctggaagacatggggaaaagcgaagatagtcaccgccgaaacacaaaactcaagtttcattatcgatggcccaaatactcccgagtgcccttccgctagccgcgcatggaacgtgtgggaagttgaggactatggttttggggtgttcaccacgaatatttggctgaagcttagagaagtctacacacagttgtgtgaccataggctcatgtctgccgctgtgaaagatgagcgtgccgttcacgcagacatgggatactggatcgagtcacagaagaacggcagttggaaactggaaaaggcgagcctaatagaggtgaaaacctgcacttggccaaagtcccacaccctgtggtctaatggtgtactcgaatcggatatgatcattccgaagagcctggccggccccatctcccagcataaccaccggcctgggtatcatacacaaactgctggaccatggcaccttggcaaattggagctggactttaattactgcgaggggaccacagtcgtgattacggaaaactgtggaacccgaggcccctcattaagaactacaaccgtgagtggtaagctcatccacgagtggtgctgtaggtcttgcactctgcctccacttcgctatatgggggaagatggatgttggtacggcatggagatacggcccattagcgaaaaagaggagaatatggtcaagtccctggtttcagccggtagcggcaaagtggacaacttcacaatgggggtattgtgcctcgcaatcctgtttgaagaggtgatgagaggaaagttcggcaagaaacatatgatcgctggggtcttctttaccttcgtgctactgctctctggacagattacgtggagggatatggcccacactctgatcatgattggctccaatgcaagtgaccgcatgggtatgggggttacctatcttgccttgatagctacatttaagatccagccgttcctggcgttaggatttttcctccgaaaactgaccagccgggaaaaccttctgctaggcgtgggcctcgccatggcaactacactgcaattgcctgaggatattgaacagatggctaatgggatcgccctgggattaatggccctcaagctgattacccagtttgagacataccagctttggactgctctgatctctttgacctgttccaacacgatgttcacactcaccgtcgcatggcgtactgccaccctgatactagcgggtgtgtcactgcttccagtttgccaaagtagctcgatgagaaaaacagactggctccccatggctgtggccgcaatgggcgtccctcccctgccattgtttatcttctccctgaaggatactttaaagaggcgctcttggcctctcaatgagggggtaatggccgtgggactggttagcattcttgcttcaagtctgttgcggaacgacgtgcccatggcaggcccactcgtcgccggtgggctgctaatcgcgtgttatgtgattaccggaacgtccgctgatctgacagtagaaaaagccgcagacatcacctgggaggaagaggccgaacagactggcgtgtctcataaccttatgataacagtcgacgatgacggcaccatgagaattaaggatgacgagactgagaatatcctcacagttctgttgaaaaccgctttactgatcgtgagcggggtgtttccgtactccattcctgccacgctcctggtctggcacacttggcagaagcagacccaaaggtcaggagtgctttgggatgttcccagcccacccgaaacacagaaagcagagctggaagagggtgtataccgaataaagcagcagggcatcttcgggaaaacccaagtgggagtcggcgtgcagaaggagggtgtttttcatacaatgtggcacgtgactcgcggggctgtcttgacctataacggaaagcggctagaacctaattgggccagtgtgaaaaaggacctgatttcttacggcggcgggtggagactctccgcgcagtggcaaaaaggagaggaagtacaggtcatcgccgtggagccaggtaagaaccccaaaaatttccagacgatgcctggcacattccagactaccacaggggaaattggagcaatcgctctggattttaagccgggcaccagcggttcgccaataatcaacagggaggggaaggttgtgggactttatggcaatggcgtcgtgactaaaaacgggggatacgtttcaggtattgcccaaaccaatgctgagcccgacggccctacaccagaattagaggaagagatgttcaagaaacgtaacctgacgatcatggatctccaccccgggtctggaaagactcgcaaatatttgcctgcaattgtgcgggaagccatcaagagaaggctgcgaaccctcatactggccccgacacgggtcgtggctgcggagatggaggaagcacttaagggcctgcccattcgctaccagaccactgccacaaaaagtgagcataccggtagagaaatcgtagacttgatgtgccacgctacgtttactatgaggctactgtccccagtgcgggttcctaattataacctcatcattatggatgaggcccatttcacagaccccgcaagcatcgccgctcgagggtacatatctaccagagtcggaatgggcgaagcggccgcaatttttatgaccgctactccacctggcacagccgatgcattcccccagagcaatgccccaatccaggacgaggagcgcgacattccggaaaggtcctggaactcagggaatgagtggatcaccgattttgctggaaagacagtgtggttcgtgcctagtataaaagccggtaacgacattgcgaactgtttacgtaagaatggcaaaaaggtcatccaactgagccggaagacttttgatacggaataccagaaaaccaagcttaacgactgggatttcgtagtgacaactgacatctctgagatgggggcaaattttaaagccgatagagttattgaccccaggcgctgcctgaagccagtgatcctcaccgatggacccgagcgagtcattttggctggccctatgccagtgacagccgcttccgcagcccagagacggggtagggttgggcgcaacccccagaaagaaaatgaccaatatatattcaccggccagcctctgaacaatgatgaggaccacgctcattggactgaagccaagatgctcctggacaacatcaatacgccggagggaattatcccagcacttttcgaacccgagcgtgagaagtcagcggccatcgatggcgaatacagactaaaaggggagagtcggaagacctttgtggaactgatgaggcgcggagacttgcctgtctggttagctcacaaagtggccagcgagggtattaagtatacagatcgaaaatggtgcttcgacggccagagaaacaatcagatactggaagagaacatggatgtagagatctggactaaggaaggggagaaaaagaagctccggcccaggtggctggacgcacgcacctactccgatccacttgctctgaaagaatttaaggacttcgccgcaggaagaaaatctattgccctcgatttggtgacagagatcggcagggttccttcgcacctggctcatcggacccgtaatgcgctagacaacctggtcatgctccacactagcgaacatggtgggcgcgcctatcgacacgcagtggaggagcttcccgaaacaatggagacgctgttattgctgggcctcatgattctgcttaccggaggcgctatgctgtttctcatctcagggaagggaataggtaaaacttccatcggcttgatttgtgtgatcgccagttctgggatgctgtggatggccgaaattccattacaatggatcgcaagcgctatagtcctagagttctttatgatggttctgctcattcctgagccggaaaagcagagaacaccccaggataatcaacttgcctacgtggtaatcggaattctgaccttggcggctatcatagccgcaaacgagatgggcctgctcgaaaccacaaagagggacctgggtatgtccaaagagccaggggtggtctcacctacttcttatcttgatgtggacctccaccccgccagcgcttggacgctgtacgcagttgccaccacagtgatcactccaatgttgcggcataccattgaaaatagtacagcgaacgtctccctggctgccatcgcaaaccaggccgtagtgttaatgggcctagacaagggatggcctattagcaaaatggatctgggcgttcccctccttgctctggggtgctactctcaggtgaatccgttgaccctgactgccgcagtcctcctgcttatcacgcactatgctataattggaccaggcttacaggccaaggcgacacgcgaggcccaaaaaagaaccgcagctggtatcatgaagaaccctactgtggacgggatcatgaccattgatctggaccccgtcatctacgattcaaagttcgagaaacagctcggacaggtgatgttgctggttctatgtgccgtgcagctgctccttatgaggacatcctgggcactgtgcgaagctttgactctggccaccggcccaataacaacgctctgggagggtagtcccggcaagttttggaataccactattgccgtaagcatggcgaacatcttccgggggtcgtatctggctggagcaggcttagccttttctattatgaaatccgtggggacaggaaagcgaggcaccggtagccaaggggaaactcttggagagaaatggaagaagaaactgaatcagctctcaagaaaggaattcgacctatacaaaaagagtggcatcacagaggtcgatcgcaccgaggctaaagaaggtctgaagaggggcgagataacgcatcacgccgtttctcgggggtccgcaaaattgcagtggtttgtggaacgtaacatggtcatccctgagggaagagtgattgacctgggctgtgggaggggaggctggagctattactgcgccggtctcaagaaggtaaccgaagtgcgcgggtatacaaaaggaggcccgggccatgaggagcccgttccaatgtcaacttacgggtggaatatcgtgaagcttatgagtggaaaagatgtcttctacctgcctcccgaaaagtgtgacaccttgctgtgcgatattggtgagagctccccttctccaacagtggaagagagccggactatccgagtcctcaaaatggtggagccctggttaaagaacaatcagttctgtattaaggttctgaacccttatatgccaaccgtaatcgaacaccttgagagactgcaaaggaaacacggcgggatgctagtgcgcaatcccctctcccggaactcaacacatgaaatgtactggatatctaatggaaccggcaacattgtcgctagtgtgaatatggtttcgagactgttgctgaaccgttttactatgacgcacaggcggccgacaatcgagaaggacgtggatctcggtgcggggacccgccatgtcaacgccgaacctgagactccaaatatggacgtgatcggagagcgaattaaaagaataaaggaagagcacaacagcacctggcactatgacgatgaaaatccctacaaaacatgggcatatcatggctcctacgaggtaaaggctacgggctctgcctcaagcatgatcaacggggtggttaagcttctgaccaaaccttgggacgtcgtgccaatggtgactcagatggcaatgacagataccactcccttcggacagcaaagggtctttaaggaaaaagttgacacacggaccccgcgctccatgcctggtacaagaagggtgatgggcattactgccgagtggttatggcgaaccctggggcggaataagaaaccccgtttgtgcacgagagaggaattcaccaagaaggtacgcacaaacgctgccatgggagcggtgtttactgaggaaaatcagtgggatagtgcaaaagccgctgtcgaggacgaagatttctggaagctcgtggacagggagcgggagctgcacaaactaggcaagtgtggttcttgcgtttataacatgatggggaaaagagaaaagaaacttggagagtttggcaaggccaagggcagccgcgcaatctggtacatgtggctgggggctaggtacctcgaattcgaggccctgggatttttgaatgaggatcattggttctcacgagaaaactcctatagtggtgtggagggcgaagggctgcacaaactcggatacattcttcgggacatcagcaagataccaggcggtgctatgtatgccgatgacaccgcagggtgggacacaagaatcactgaggatgacctgcataatgaagagaaaattacccagcagatggatcctgagcacaggcaattagcgaacgccatctttaagctgacgtaccagaataaagtcgtgaaggtacagcgccccacaccaaccggaactgttatggacattatctctcgtaaggatcagcggggctccggccaagtggggacatatggattgaacaccttcactaatatggaagctcagctcataagacagatggagggtgaaggcgtcctgtcaaaagccgacctagagaacccccaccttcctgaaaagaaaattacccagtggctggagacaaagggggtggagaggctcaaacgcatggcaatcagcggagatgactgcgtggtcaagccaatcgatgaccgatttgctaacgccctgttggcattaaatgatatgggcaaggttcggaaagacattccgcaatggcagccctcgaagggttggcatgattggcagcaggtgcctttctgttctcaccatttccacgaactgataatgaaagacgggagaaagctcgtagtgccatgcaggccccaagacgagcttatcggacgcgccagaattagtcagggcgcgggctggtccctgcgggaaacggcttgtctagggaaagcctacgcacagatgtggagcctgatgtattttcacaggcgtgatctccgattggcctcaaacgctatctgctccgccgtccctgtgcattgggttccaacctctcgcactacatggagcattcacgcacatcaccaatggatgaccactgaggacatgctgacagtgtggaatagagtctggatcgaagataacccctggatggaggacaagacccctgtgacgacatgggagaatgtaccgtaccttggaaagcgggaagatcagtggtgtggtagtctgataggcctcacctccagggctacttgggcccagaacatcccaaccgcgattcagcaagttcgcagcttaatcgggaatgaggaattcctggactacatgccctctatgaaaagatttcggaaggaggaggaatcagagggagctatttggtga

SEQ ID NO: 15649 - RNA, 9873 nt, synthetic construct
  misc_feature 1..9873: note = derived and/or modified CDS sequence (opt3) from DENV-3__AY858037__SS-prME
  source 1..9873: mol_type = other RNA
accagcctgtgcctcatgatgatgcttcccgtgacactggccttccacttgacttccagggacggcgagcctaggatgatcgtcgggaagaacgaacggggaaagtctttactgtttaagacggcttcaggtattaatatgtgtacccttatagcaatggatctcggcgagatgtgcgacgatacagttacttacaagtgtccactgatcaccgaagtggagccggaagacattgattgctggtgtaaccttacaagtacctgggtaacttatgggacatgcaatcaggccggagagcatcgccgagacaagcgtagcgtggcgctggctccccacgtcggcatgggtttggataccagagcccagacgtggatgtccgcagagggggcctggagacaggtggaaaaggttgagacttgggctttccggcatcctggatttaccatcctcgcactgttcctggcccactacattggcacatctctcactcagaaggtggtcatctttatattactgatgcttgtgaccccatcgatgacaatgcgctgtgtaggcgttgggaacagagacttcgtggaaggattgtcaggtgctacctgggtcgatgtggtgctggagcatggcgggtgcgtcacgactatggccaagaataagcccacactagacatcgagctccagaagaccgaagcgactcaactggcaacacttaggaaactgtgtattgagggaaagatcaccaacgttacgaccgatagccggtgccctacacagggcgaagccattttgccagaggaacaggaccagaattatgtgtgtaaacacacttacgtagatcgcggttgggggaacggatgcggcctctttggcaaggggagtctggtgacctgcgctaagttccaatgtttagagtccatcgagggaaaagtcgtgcagcacgaaaatctgaagtatacagttataattactgtgcataccggtgaccagcaccaggtcggcaacgagacacaaggggtgaccgccgaaatcactccccaggcatctacggtagaggctattctccctgaatacggaacacttggcctggagtgcagcccacgaaccggtttggactttaatgagatgatcctactgactatgaaaaacaaggcctggatggttcatagacagtggttctttgatctcccgctgccctggacctccggggcgacaaccgaaactcctacatggaataaaaaggagcttctggtgacgttcaaaaacgcccacgcaaagaagcaagaagtcgtggtcttgggctcacaggagggagctatgcacaccgccctcactggcgctacagaaatccagaccagtgggggaacaagcatttttgccggtcatctgaaatgtaggttaaagatggacaaactggagctaaagggcatgtcttatgcaatgtgctccaatgccttcgtgctcaaaaaggaggtttcagaaactcagcacgggaccatactgatcaaggtggagtacaaaggagaagatgctccatgtaagattcccttcagcacggaggacggccaaggtaaagcgcataacgggcggcttatcaccgcaaaccctgtagtcacaaagaaagaggaaccagtgaatatagaggccgaacccccgtttggcgagagtaacattatcatcggaattggcgatcgtgctttgaagatcaattggtacaagaaagggtcttccattggaaagatgttcgaagccactgcacgcggtgccagaaggatggctatactgggcgacaccgcctgggattttgggagcgttggaggcgtgctcaactcgctgggtaaaatggtccaccagatcttcgggtctgcatatacagcgctattttccggcgtgtcatggattatgaagatcggaatcggcgtactgttgacttggattgggctcaatagtaaaaacaccagcatgtccttctcttgcatagtgatcggaattatcacgctgtacttaggcgctgttgtccaggccgacatgggttgtgtgattaattggaaggggaaggagctgaaatgcggaagcggcatctttgtgacaaacgaggtccatacctggactgaacagtataagttccaagcagattcacctaaacggctagccacagctatagccggtgcatgggagaatggcgtttgtgggatccgaagtaccactcgcatggaaaacctcctgtggaagcagattgctaatgagcttaactacatcttgtgggaaaataacattaaactgaccgtggtggtaggagacatcataggcgtcctcgagcaggggaagagaacactgacgccccagccaatggagttaaaatattcctggaagacctggggaaaggccaaaattgtgactgcggaaacacaaaatagctcttttatcattgatggccctaacacccccgagtgcccaaacgcctcaagggcttggaatgtttgggaagtggaggactacggtttcggggtctttacaactaacatctggctgaaacttcgggaaatgtatacccagttgtgtgaccaccgcctcatgagtgcagccgtgaaagatgagagagctgttcacgccgacatgggatactggatagagagccagaagaatggctcctggaaactggaaaaggcatctctaatcgaggtgaagacgtgcacatggcccaaatcgcataccctgtggagcaacggtgtactcgaatccgatatgattatccctaagtcactggcgggcccaattagtcagcacaattacaggccggggtatcatactcaaaccgccggaccctggcaccttggcaaattggagctggacttcaactactgcgaggggacaactgtcgtgatcaccgaaaattgtggaacacgtggcccttctttacggacgaccactgtgagcggtaagctcatacacgagtggtgctgtcgatcctgcacactgccaccccttagatatatgggggaagatggatgttggtacggcatggagattaggcctatcaacgaaaaagaggagaatatggtcaagtcactggttagcgctggttctggcaaggtggacaactttaccatgggggtattgtgcctcgccatcctgttcgaagaggtgatgcgcggaaaattcggcaagaaacatatgattgcaggggtcctatttactttcgtgctgctcctgtccggacagatcacatggcgggatatggctagaacccttattatgataggcagtaatgccagcgacaggatgggtatgggggttacgtatttggcactgatcgccacttttaagattcagccattcttagctctcggatttttcctgcgcaaacttacctctcgagaaaacctgctactcggcgtgggcctggcgatggccacaaccttgcaactgcccgaggatatcgaacagatggcaaatgggattgctttaggactcatggccctgaaacttatcactcagtttgagacataccagctgtggaccgccttggtctccctcatgtgttcaaacacaatattcactctgaccgtggcttggcggacggcaacactaatcctggccggtattagtctttttccggtttgccaaagctcgtccatgcgtaagaccgactggctccctatgactgtggcggctatgggcgtcccacccctgcctttgttcatcttttctctgaaagataccttaaagagaaggagctggcccctcaatgagggggtaatggccgtgggactggtttcaattcttgcaagttccctgttgcgcaacgacgtgccaatggccggccctctcgtcgctggtgggctgctaatcgcatgttatgtgataacaggaacttctgccgatctgaccgtagaaaaagcggctgacgtgacgtgggaggaagaggccgaacagacaggcgtcagccacaaccttatgattaccgttgacgatgacggcactatgcggatcaaggatgacgagacagagaatatcctcaccgtgctgttgaaaactgcattactgattgtgtccgggatattcccctactcaatcccagccacactcctggtctggcatacctggcagaagcagacgcaaagaagcggagtgctttgggatgttccgagtcctcccgaaactcagaaagctgagctggaagagggtgtatacaggattaagcagcagggcatctttgggaagacccaagtgggagtcggcgtgcagaaagagggtgttttccacacaatgtggcatgtgacccgaggggccgtcttgacatataacggaaagcgcctagaaccaaattgggcatctgtgaaaaaggacctgatttcctacggcggcgggtggcggctcagcgctcagtggcaaaaaggagaggaagtacaggtcatcgccgtggagcccggtaagaaccctaagaatttccagactatgccaggcatatttcagaccacgacaggggaaatcggagcgattgccctggatttcaaacccggcacttcgggttcacctatcattaacagagaggggaaggttgtgggactttatggcaatggcgtcgtgaccaaaaacgggggatacgtttctggtatcgcacaaacaaatgctgagccggacggcccaacccccgaattagaggaagagatgtttaagaaaaggaacctgactataatggatctccaccctgggagtggaaagacccgtaagtatttgccagccattgtgcgcgaagctatcaaacggagactgaggacactcatcctggcacccacgcgagtcgtggccgccgagatggaggaagctcttaagggcctgcctattcggtaccagactaccgcgacaaaatccgagcacaccggtaaggaaatcgtagacttgatgtgccatgcaactttcacaatgcgcctactgagcccggtgagagttcccaattataacctcataattatggatgaggcccactttaccgacccagcttctatcgccgcaagggggtacattagcacgcgggtcggaatgggcgaagccgctgcgatcttcatgactgccacacctcccggcaccgcagatgcttttccacagtccaatgcccctatacaggacgaggagcgagacattcccgaaagatcatggaacagtgggaatgattggatcaccgacttcgcaggaaaaactgtgtggtttgtgccaagcatcaaggccggtaacgatattgctaactgtttacgcaagaatggcaaaaaggtcatccaactgtctaggaaaacattcgacaccgagtaccagaagacaaaacttaacgattgggactttgtagtgactacggatatttccgaaatgggggccaatttcaaggcggaccgtgttatagatccgcggagatgcctgaagcctgtgatcctcaccgacggacccgagagggtcattttggcaggcccaatgcccgtgacagttgcctcagctgcccagcgccgaggtagagtggggcggaaccctcagaaagagaatgatcaatatatcttcactggccagccactgaacaatgacgaagaccatgctcactggaccgaggcaaagatgctcctggataacatcaatacacccgaaggaattatacctgccctttttgagccggaaagggagaaaagtgctgccatcgacggcgagtaccgcctaaagggggaaagccgtaaaaccttcgtcgagctgatgagacggggagatttgccagtgtggttagcacataaggtagcgtccgaaggtattaaatatactgacaggaagtggtgctttgatggcgagcgcaacaatcagatcctggaagagaacatggacgtggagatttggacgaaggaaggggagaaaaagaaactccgacccagatggctggatgcccggacctactctgaccctcttgctctgaaggagttcaaagattttgccgcaggaaggaagtcgatcgctctcgacttggttacagagataggccgcgtccccagccacctggcccacagaactaggaatgcactagataacctggtgatgctccatacctcagaacacggtgggcgggcctatcgtcatgctgtggaggagcttccagaaacaatggagaccctgttattgctgggcctcatgatcctgcttactggaggcgcgatgctgttcctcatttccgggaagggagtcggtaaaacaagtatcggcttgatttgtgttgtggcctctagcgggatgctgtggatggcagacatccctttacagtggatagcttccgccattgtactagaatttttcatgatggtgctgctcatccccgagccagagaagcaacgcacgcctcaggataatcagcttgcctacgtcgtgattggaatcctgaccttggcagctatagttgccgcgaacgaaatgggcctgctcgagactacaaaacgagacctgggtatgtcaaaggaaccgggggtggtctctcccaccagctatcttgacgtagatctccacccagctagtgcctggaccctgtacgcagtggccacaactgttatcacgcctatgttgagacacaccattgaaaattccacagctaacgtgagcctggcagccatcgcgaaccaagctgtcgtgttaatgggcctagacaaaggatggcccatttctaagatggatctgggcgtcccactccttgccctggggtgctactcacaggtgaatcctttgactctgaccgcagccgttctcctgcttgtgacacattatgctatcataggacccggcttacaggccaaggcaaccagggaagctcagaaacggactgccgcgggtattatgaagaacccgacggtagacgggatcatgacaatcgatctggacccagtgatttacgattccaaatttgagaagcaactcggacaggtcatgttgctggttctatgtgccgtgcagctgctccttatgcgcaccagttgggcattctgcgaggctctgactttggccaccggccctatcacaactctgtgggaaggtagccccggcaaattttggaataccacaatagcagtctcgatggctaacattttcagagggtcttatctcgccggagccggcctggcgttttccatcatgaaaagcgtggggacgggaaagaggggcaccggttcacagggggagactttaggagaaaaatggaagaagaaacttaatcaactgagtcggaaagagttcgacctctacaagaaatctggcattacagaagtagatcgaaccgaggctaaagagggtctaaagagaggcgaaatcactcaccatgcagtgtcccgcgggagcgccaaactgcagtggttcgttgagaggaacatggtgataccagaaggacgggtcatcgacttgggctgtgggcgtggaggctggtcatattactgcgctggtctgaagaaagtgacagaggtcagagggtataccaagggaggccccggccacgaagaacctgtgccgatgagtacgtacgggtggaatattgttaaactcatgagcggaaaggatgtattttaccttcccccagagaagtgtgacaccctgttgtgcgatatcggtgaatcctctcctagccccacagtggaggaatccaggactattcgcgtcctgaaaatggtggagccttggctcaagaacaatcagttctgtatcaaagttttaaacccatatatgcccaccgtgattgagcatctggaacggcttcagcgaaagcacggcgggatgctggtcagaaatcctctatcaaggaactctacacacgagatgtactggatcagtaatggaactggcaacatagtgtcgagcgtaaatatggtgtcccgcctcctgttgaaccggtttaccatgacatatagacgtccaaccattgaaaaagacgttgacctgggtgccgggactaggcatgtcaacgcagagcccgaaacgccgaatatggatgtgatcggagagcggatccgccgaattaaggaggaacactcttcaacatggcattacgacgatgagaacccttataagacctgggcctaccacggcagctatgaagtgaaagctactggctccgcgagttctatgataaatggggtcgttaagctccttaccaaaccatgggacgtggtacccacagtgacgcaaatggccatgaccgatactacacctttcggacagcagagagtctttaaggagaaagtggacaccaggactccaaagcccatgccgggtacacggaaggttatggaaatcaccgcagagtggctgtggcgcacattaggcagaaacaaaaggcctcgactgtgcactcgggaggagttcaccaagaaagtgcgtacgaatgctgccatgggggcagtctttaccgaggaaaaccaatgggatagcgccagagctgccgtggaggacgaagagttctggaagttggtagatcgcgagagggaactccacaaactgggaaagtgtggctcatgcgtttacaatatgatgggtaaacgggagaagaagctaggggaatttggaaaagcgaagggctccagagcaatttggtacatgtggcttggcgcccgctatctggagttcgaggctctcgggtttctgaacgaagaccattggttcagtagggagaatagctactctggagtggaaggtgagggcttgcacaaactggggtatatcctccgagatatttccaagatccccggaggcgccatgtacgcagacgacacagctggttgggatactcggataaccgaagacgatcttcataacgaggagaaaatcacacagcagatggacccagaacacagacagctggccaatgctatttttaagttaacttatcaaaacaaggtcgtgaaagtgcagaggcctacccccaaggggacggtcatggatatcatttcacgcaaagaccagcgtggaagcggccaggttggcacatacgggctgaataccttcactaacatggaggcccaattgatccggcagatggaaggagagggtgtgctctcgaagacagatctggaaaatccacatctacttgagaaaaagataacccagtggctggagactaagggcgtagaaagactcaaaaggatggcaatttctggggacgattgcgtggtcaagcccatcgacgatcgcttcgcgaacgccctgttggctttaaacgacatgggaaaagtgcgaaaggatatccctcagtggcaaccaagtaaaggctggcacgactggcagcaggttccgttttgttcccaccatttccacgagctgattatgaaggacggtcggaagctcgtggtcccctgcagacctcaggatgaacttatagggagggcccgcatcagccaaggagcaggctggtcactgaaagagaccgcttgtctaggcaaggcctatgcacagatgtgggccctgatgtactttcatagacgggacctcaggttggcgtccaatgctatttgctctgccgtgccagtacactgggttcccacaagccgtacgacctggagtatccacgcacatcaccagtggatgactacagaagatatgctgaccgtgtggaaccgagtctggattgaggacaatccttggatggaggataaaactccagtgacaacctgggaagacgttccctaccttgggaagcgcgaggatcaatggtgtggatccctgatcggtctcacgagcagagccacatgggctcagaacatattaaccgccatccaacaggtgcggtctctgattggcaatgaagagttcttggactatatgccttcaatgaaaaggtttcgcaaggaggaagagagtgaaggggcaatctggtga

SEQ ID NO: 15650 - RNA, 9873 nt, synthetic construct
  misc_feature 1..9873: note = derived and/or modified CDS sequence (opt3) from DENV-3__KJ737429__SS-prME
  source 1..9873: mol_type = other RNA
acaagcctgtgcctcatgatgatgcttcccgcaacactggctttccacttgacttccagagacggagaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcaccgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcagcttgccacactgaggaaattgtgtattgagggaaagatcaccaacattacgaccgatagccggtgccctacacagggcgaagctatcctcccagaggaacaggaccagaattatgtctgtaaacacacttacgttgatcgcggttgggggaacggatgcggcctgttcggcaaggggagtttagtgacctgcgccaagtttcaatgtctggagcccatagagggaaaagtagtgcagtatgaaaatctcaagtacacagtcattatcactgtgcacaccggtgaccagcatcaggttggcaacgacacacaaggggtgaccgtcgagattactcctcaggcatccacggtggaagctgtacttccagagtatggaacactgggcttggaatgctctccgcgaaccggtctagatttcaatgagatgatcctgctcactatgaaaaacaaggcctggatggttcacagacagtggtttttcgacctgccccttccttggaccagcggggcgacaaccgagactccaacatggaataggaaagaactgttggtgacgtttaagaacgcccatgccaagaagcaagaggtcgtggtcctcggctcccaggaaggagctatgcacaccgccctgactggcgctacagagatccaaaattcagggggaaccagtattttcgccggtcacttaaagtgtcggctgaaaatggataagctagaactcaaaggcatgagctacgcaatgtgcctgaacacatttgtgcttaagaaagaggtttctgagactcagcatgggaccatattgatcaaggtggaatacaagggagaggacgccccctgtaaaattcctttctccacggaagatggccaaggtaaggctcacaacgggcgtctgatcaccgcgaatccagtagtcaccaagaaggaggagcccgtgaacatagaagcagagccgcctttcggcgaatcaaatattgttatcggaatcggcgacaaagccctcaagattaactggtataagaaagggagcagtatcggaaagatgtttgaggctactgcccgcggtgcaagaaggatggccattctgggcgataccgcttgggacttcgggtctgtgggaggcgtccttaattccctgggtaaaatggtgcatcagatatttgggagcgcctacacagcattgttctcgggcgtatcttggatcatgaagattggaatcggcgtgctcctgacttggatcgggttaaactccaaaaatacctcaatgagttttagctgcattgttataggaatcattacgctgtatctaggcgcggtcgtgcaggctgatatgggttgtgtgatcaactggaaggggaaggaactcaaatgcggatccggcattttcgtcacaaatgaggttcacacctggactgagcagtacaagtttcaagccgactctcccaaacggctggcaacagccatcgctggtgcctgggaaaacggcgtgtgtgggatacgaagcaccactcgcatggagaatcttttgtggaagcagatcgcaaacgaactgaattatattctctgggagaacaatatcaaactgaccgtggtagtcggagatattatcggcgtgttagaacaggggaagagaacactgacgccacagcctatggagcttaaatactcatggaagacctggggaaaggctaaaatagttactgccgagacacaaaacagttccttcattatcgacggccccaacaccccagaatgccccagcgcgtctagggcctggaatgtgtgggaggtcgaagactatggttttggggtgttcacaactaacatttggttgaagctccgggaggtttacacccagtcatgtgatcatcgcctgatgagtgctgcaatcaaagacgaaagagccgtgcacgctgatatgggatactggatagagagccagaagaatggctcctggaaactagagaaggcctcttttatcgaagtaaagacgtgcacatggcctaaatcgcacaccctgtggagcaacggtgtcctcgagtccgacatgattatcccaaagtcactggcaggcccgattagtcagcataatcacaggcccgggtatcatactcaaaccgcgggaccttggcaccttggcaaattggaactggatttcaactactgcgaggggacaactgtggtgatcaccgagaattgtggaacacgtggcccatctttacggacgaccactgtcagcggtaagctcatacacgaatggtgctgtcgatcctgcacactgccccctcttagatatatgggggaggacggatgttggtacggcatggaaattaggccaatcaacgagaaagaagagaatatggttaagtcactggtgagcgccggttctggcaaggtagataactttaccatgggggtgttgtgcctcgctatcctgttcgaggaagtcatgcgcggaaaattcggcaagaaacatatgattgccggggtgctatttactttcgttctgctcctgtccggacagatcacatggcgggacatggcacacacccttattatgataggcagtaatgctagcgatagaatgggtatgggggtgacgtatttggccctgatcgcaacttttaagattcagcccttcttagccctcggatttttcctgaggaaacttacctctcgcgagaacctgctactcggcgtcggcctggctatggcgacaaccttgcaactgccggaagacatcgagcagatggccaatgggattgcattaggactcatgactctgaaacttatcacacagtttgaaacctaccagctgtggacagctttggtgtccctcacttgttcaaacaccatattcacgctgacagttgcctggcgaaccgccactctaatcctggctggtgtgagtcttctccctctgtgccaaagctcgtccatgcggaagaccgattggttgccaatgacagtcgcagccatgggcgtaccccctctgcccttatttattttctctctcaaagacactccaaagcgtagaagctggcctctgaatgagggggtgatggcggttggacttgtgtcaatcctggctagttccttgctcaggaacgatgtccccatggccggcccactggtggccggtgggctactgattgcctgttatgtaatcaccggaacgtctgctgaccttacagtggagaaagcagccgacgtcacctgggaagaggaagcggagcagactggcgttagccataacctcatgataacagtggatgacgatggcaccatgcgcattaaggacgatgaaactgagaatatcctgacagtgttgttaaaaaccgctctgctcatcgtctccgggatttttccgtactcaatacctgccacgctgcttgtgtggcacacttggcagaagcagacccaacggagcggagttctgtgggacgtacccagtccacccgagacacagaaagcagaattggaggaaggtgtgtacagaatcaagcagcagggcattttcgggaagacccaagtcggagtgggcgttcagaaagagggtgtgtttcatacaatgtggcacgtcactcgaggggcagtgctaacccacaacggaaagaggctggagcctaattgggcttctgtcaagaaggatctcatctcctatggcggcgggtggcgcctgagcgcccagtggcaaaaaggagaagaggtccaggtgattgcagttgaaccaggtaagaaccccaagaatttccagacgatgcctggcatcttccagacaactaccggggagataggagctatcgcccttgactttaaaccgggcacatcgggttcaccaattatcaaccgggaagggaaggtggtcggattatacggcaatggcgtggttaccaaaaacgggggatatgtgtctggtattgcgcaaactaatgccgagcccgatggccctaccccagagctggaagaggaaatgttcaagaaaagaaacctcacaatcatggacttgcatcccgggagtggaaagacgaggaagtacctgcctgcaatagtccgtgaggctattaaacgccggctcagaactctgatccttgccccgaccagggtggtagctgcagaaatggaggaggccctgaagggcttgcccatccgatatcagacaaccgccactaaatccgaacacacaggtcgggagattgtggatctaatgtgccatgctacctttacgatgcgcctgctcagcccagttagagtccctaattacaacttaatcataatggacgaagcgcacttcactgatcccgcatctattgccgctagggggtatatcagcacacgggtgggaatgggcgaggccgcagccatttttatgaccgctaccccacctggcactgcggaagccttcccccagtccaatgcaccaatccaggacgaggagcgagacataccggaaagatcatggaacagtgggaatgagtggattacagattttgtgggaaagaccgtctggttcgtacctagcatcaaagctggtaacgacatcgccaactgtctgcgcaagaatggcaagaaagtgattcaactttctaggaagacatttgatactgaataccagaaaacgcgtctgaacgactgggatttcgttgtgaccacagacatctccgagatgggggcaaattttaaggccgatcgggtcattgaccccagaaggtgcctcaaaccagtgatattgactgatggacccgagcgcgttatcctggctggccctatgccagtgaccgccgcgtcagcagcccagcgaagaggtcgggtcgggaggaacccccagaaggaaaatgaccaatacattttcacaggccagcctctcaacaatgatgaggaccatgctcactggaccgaagccaagatgctgcttgacaacatcaatactccggagggaatcattccagctctattcgaacccgagcgcgagaaaagtgcagccatagatggcgaatatcgtctgaagggggagagcagaaaaacgtttgtggaattgatgcggaggggagacttacctgtatggctggctcacaaggtggcctccgagggtatcaaatacaccgatcgcaagtggtgcttcgacggcgaacgaaacaatcagattctcgaggagaacatggatgttgaaatctggacaaaagagggggaaagaaagaagctgcggcccaggtggcttgacgcacgcacttattctgatccactggcgctcaaagagtttaaggacttcgccgctggaagaaaatcgattgccttggatctggtcaccgaaatcggcagggtgcctagccatctagcacaccggacacgtaatgctctggacaacctcgtgatgcttcatacctcagagcacggtgggcgcgcctaccgacacgcagtcgaggaactgcccgagactatggaaacattattgctgctcggcctgatgatacttctgacgggaggcgccatgctctttttgatctccgggaagggaattggtaaaaccagtatcggcctgatttgtgttatcgtgtctagcgggatgttatggatggctgatgtaccactacagtggatagcgtccgccattgtgctggagttctttatgatggtcctccttatccctgagccggaaaagcaaagaactccccaggacaatcagctggcatatgtggttattggaatcttgacactggctgccatagtggccgcaaacgagatgggcctcctggaaaccaccaagagggatcttggtatgtcaaaagagccaggggtcgtatctcctacaagctacctcgacgtggacctgcatcccgctagtgcctggactttgtatgcggttgctacgaccgtgatcacaccaatgctgcggcacactattgaaaattccaccgccaacgtcagcttagcagccatcgctaaccaagcagtggtcctaatgggcctggataagggatggcctatttctaaaatggacctcggcgtgccccttctggccttggggtgctactcacaggttaatccgctgacactcaccgcggctgtgctgcttttagtaactcattacgccatcataggaccaggcctgcaggcaaaggccacgcgcgaggctcagaaaagaacagccgcaggtattatgaagaaccctaccgtggatgggatcatgactatcgacctcgatcccgtcatttatgactccaagttcgagaaacaattgggacaggttatgctgctagtgctgtgtgctgtccagctccttctgatgaggaccagttgggccttgtgcgaagcgctgacactcgccactggcccaatcaccacactgtgggagggtagccccggcaagttttggaatacgaccatagcagtgtcgatggctaacattttccgggggtcttacttagccggagcaggccttgctttttccatcatgaaaagcgtagggactggacgaagaggcacaggttcacagggggaaaccctgggagagaagtggaaaaagaagctcaatcaactaagtcgcaaagagttcgatctgtataagaaatctggcattactgaggtggacaggacagaggccaaggaaggtttgaaacggggcgagaccacgcaccatgccgtttcccgtgggagcgcgaagctgcagtggtttgtggaaagaaacatggtcatccctgagggaagggtgatagatctcggctgtgggcgcggaggctggtcatactattgcgctggtcttaaaaaggtcaccgaagtgcgggggtacacaaagggaggcccgggccacgaggagcccgttccaatgagtacttatgggtggaatatcgtaaaactgatgagcggaaaggacgtgttctacttgcctcccgaaaaatgtgataccctgctctgcgacattggtgagtcctctcctagcccaacagtcgaagagtcccgaactatcagagtgttaaagatggttgagccctggctgaaaaacaatcagttctgtattaaggtgcttaacccttacatgccaaccgtcatcgaacacctggagaggctacagcgcaagtatggcgggatgctcgtgcggaatcccctgtcaagaaactctacacatgaaatgtactggattagtaatggaaccggcaacatcgtatcgagcgtgaatatggtttcccgtttgctgctcaacaggtttactatgacgcaccggcgcccgacaatagagaaagatgtcgaccttggtgcagggacccgacatgtgaacgccgaacctgagactccaaatatggacgtgattggagagagaatcaagaggatcaaagaagaacactcttcaacctggcactatgatgacgaaaacccctacaagacatgggcttatcatggcagctacgaggtcaaagccacgggctccgcaagttctatgattaatggggttgtgaagctgttaaccaagccttgggatgtagtgccaatggtcactcaaatggccatgacagacaccactcccttcggacagcagcgggtgtttaaagaaaaggttgatacacgcaccccgagacctatgcccggtacaaggaaagtgatggagataactgctgagtggctgtggcgaaccttgggccggaacaagaaaccacgtctctgcacgagagaagagttcaccaagaaggtccgcacaaatgcggccatgggggcagtgtttactgaagagaaccaatgggacagcgctagggccgcagtagaagatgaggagttctggaaactggttgaccgggaaagagagctacacaaacttggaaaatgtggctcatgcgtgtataatatgatgggtaagcgcgagaaaaagctgggggagtttggaaaagccaagggctccagggctatctggtacatgtggctcggcgcccgatacctggagttcgaagcgttggggtttctgaacgaggatcattggttcagtcgggaaaatagctattctggagtcgagggtgaaggcctccacaaacttgggtacattctgagagacatctccaaaattcctggaggcgcaatgtatgccgatgacaccgctggttgggacacaaggatcactgaggatgacttacataacgaggaaaagataacccagcagatggatcccgagcaccgccagctggccaatgcaatctttaaattgacgtaccaaaacaaggtggtgaaagtccagcgtccaacacccaaggggaccgttatggacattatctcacggaaggatcagagaggaagcggccaggtgggcacttatgggctcaatacattcaccaacatggaagctcaactggtaaggcagatggagggagaaggtgtgctatcgaaagccgaccttgagaatcctcatctgctcgagaagaaaattactcagtggctggaaaccaagggcgtcgagcgcttgaaacgaatggctatctctggggatgactgcgtggttaagccaatagatgaccggtttgccaacgcattactggcgctcaacgatatgggaaaggtgagaaaagacattccgcagtggcaacccagtaagggctggcatgattggcagcaggtccctttctgttcccaccatttccacgaacttatcatgaaagacggtaggaagctggtggtaccatgccgcccccaggacgagctaatcgggagagcccggattagccaaggagctggctggtcactgaaagaaacagcctgtctcggcaaggcatacgctcagatgtggtccttgatgtattttcacaggcgtgatctgcgacttgcctctaatgcaatatgcagcgccgttcctgtgcattgggtcccaacgagtcgcaccacttggtccatccacgcgcatcaccagtggatgacaaccgaggacatgctgactgtgtggaacagagtttggattgaggataatccctggatggaagacaagacacctgtgaccacgtgggaggatgtcccgtacctcgggaaacgggaagaccaatggtgtggcagcttaatcggtctgacatctagggctacctgggcccagaacattttgactgcaatccaacaggtgcgctcactgataggcgatgaggagttcctcgactacatgccaagtatgaagagatttcggaaagaagaggaatccgagggggccatctggtga

SEQ ID NO: 15651 - RNA, 9873 nt, synthetic construct
  misc_feature 1..9873: note = derived and/or modified CDS sequence (opt3) from DENV-3__DQ863638__SS-prME
  source 1..9873: mol_type = other RNA
acctcactgtgcctcatgatgatgcttcccgccactctggctttccacttgacttccagagacggcgaacctaggatgatcgtggggaagaatgaacggggaaaatctttactgtttaagacggcatcaggtattaatatgtgtaccctaatagccatggatctcggcgagatgtgcgacgataccgtcacttacaaatgtccacatatcgcggaagttgagccggaagacattgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccatcctcgccctgtttctggctcattacattggcacatctctcactcagaaggttgtgatcttcatattactgatccttgtcaccccatcgatggccatgcgctgtgtgggcgtagggaacagagactttgttgaaggattgtcaggtgcgacatgggtggatgtcgtgctggagcacggcgggtgcgtgaccacgatggcaaagaataaacccactctagacattgagctccagaagacagaagccacccaactggctactcttaggaaactgtgtatcgagggaaagattacaaacatcaccacggatagccggtgccctacccagggcgaagccatattgccagaggaacaggaccagaattatgtctgtaaacacacatacgttgatcgcggttgggggaacggatgcggcctcttcggcaaggggagtctggtgacttgcgcaaagtttcaatgtttagagtccattgagggaaaagtagtgcagcatgaaaatctgaagtataccgtcatcattacagtgcacactggtgaccagcatcaggttggcaacgagacccaaggggtgacagctgaaatcacaccccaggcctctactgtcgaggcgatcctccctgaatacggaacgcttggcctggagtgcagcccacgaacaggtttggacttcaatgagatgattctactgaccatgaaaaacaaggcctggatggtgcacagacagtggtttttcgatctcccgctgccctggacttccggggcaaccacagaaacccctacttggaataggaaagagcttctggtaacatttaagaacgctcacgccaaaaagcaagaagttgtggtcttgggctcacaggagggagctatgcatacggccctcaccggcgcaactgaaatacagaatagtgggggaacaagcatcttcgccggtcacctgaagtgtcggttaaaaatggacaagctggagctaaaaggcatgtcttatgctatgtgcctcaacacctttgtgctgaagaaagaggtctccgaaacacagcatgggactattcttatcaaggtggagtacaagggagaagatgcgccatgtaaaatacccttctcaaccgaggacggccaaggtaaggcacacaacgggcgtttgattacggccaatcctgttgtgaccaaaaaggaggaaccagtaaacatcgaggctgaacccccgttcggcgagagcaatatcgtcattggaatcggcgataaagccctgaagattaactggtacaagaaagggagttctataggaaagatgtttgaagcaacagcccgcggtgctagaaggatggccatcctcggcgacactgcatgggatttcgggtccgtgggaggcgttctgaatagccttggtaaaatggtgcatcagatttttgggtcggcgtataccgctctgttctctggcgtctcctggatcatgaagatcggaattggcgtgttgctcacatggatagggctgaacagcaagaatacaagtatgagcttttcctgcatcgccattggaatcattaccttatacctgggcgcagtagtgcaggccgacatgggttgtgttatcaactggaaggggaaggagctaaaatgcggatctggcatattcgtcacgaatgaggtgcacacatggaccgaacagtataagtttcaagctgatagccctaaacggctcgccactgcaatcgctggtgcctgggagaacggcgtgtgtgggattcgatcaacaacccgcatggaaaatctgctttggaagcagatcgcgaacgagttgaattacattctgtgggaaaacaatatcaaactcactgtcgttgtgggagacataattggcgtgctggagcaggggaagagaaccttaacaccccagccaatggagctgaaatatagttggaagacgtggggaaaggccaaaatcgtaaccgctgaaactcaaaactccagcttcattatcgatggccctcacacacccgagtgcccaagggcatctcgggcctggaacgtctgggaagtggaggactacggttttggggttttcaccacaaatatatggcttaagttgcgcgaagagtatactcagctctgtgaccatagactgatgtcagctgccgtgaaagatgagagggcagtccacgcggacatgggatactggatcgaaagtcagaagaacggcagctggaaactagagaaggcctccctgattgaagtgaagacctgcacgtggcccaaatctcatacactctggtcgaatggtgttctggagagcgatatgatcattcctaagtcccttgctggcccaatctcacagcacaaccaccgtccggggtaccatacccaaactgccggaccctggcacttgggcaaactggagttagactttaattattgcgaagggaccacagtggtaataactgagaactgtggaacccggggccctagtctccgaacaacgaccgtctctggtaagctgattcatgaatggtgctgtagaagctgcactcttccacccctgaggtacatgggggaggatggatgttggtatggcatggaaatccgccctatcaatgagaaagaggaaaacatggtgaagtccttggcatcagctggtagcggcaaggtggacaatttcacaatggggtttctctgcctggccattctattcgaggaagtcatgcggggaaaattcggcaagaaacacatgatcgcaggggtttttctgaccttcctcctgcttttgtctggacagattacttggagagatatggcccatacactgataatgatcggctccaacgctagtgacaggatgggtatgggggtgacctacttagcgctcattgccacgtttaagatccagccattcctggcacttggatttttcctgcgcaaactaactagccgagagaattttctcctgggcgtaggcttggctatggccaccacactgcaattacccgaagatattgagcagatggccaacgggatcgctctcggactgatggcacttaagctgataacccagttcgagacttatcagttgtggacagccctcgtgtctctgacctgttccaatacaatctttactctaaccgtcgcgtggcggacggctacactgattcttgccggtgtgtcactcctgccggtttgccaaagtagctcgatgcgtaagaccgactggttgcctatggcagtggccgctatgggcgtcccacccctgcctttattcatcttttccctcaaagatactctgaagagaaggtcttggccccttaacgaaggggtgatggcagttggactggtgagcattttggcctcaagtctcctgcgcaatgacgtcccaatggcgggccctctagtagctggtgggctgcttatcgcctgttacgtgataaccggaacatccgcagatctcactgttgagaaagccgctgacgtgacctgggaagaggaagccgagcagacgggcgtctctcacaacctgatgattacagtggacgatgacggcaccatgcggatcaaggatgacgagactgaaaacatcttgacagtattactgaaaaccgcactcctgattgtgagcgggatattcccctattccatcccagctactcttctggtctggcacacatggcagaagcagacccaaagatcaggagttttgtgggatgtgccgagccctcccgagacgcagaaagccgaactagaggagggtgtgtacaggattaagcagcagggcatctttgggaagactcaagtcggagtgggcgttcagaaagaaggtgtattccataccatgtggcacgtgacacgaggggcggtcctgacccataatggaaagcgcctcgagccaaactgggccagtgtgaaaaaggacctgatttcttacggcggcgggtggcggctttccgcacagtggcaaaaaggagaagaggttcaggtgatcgctgtcgaacccggtaagaatcctaagaacttccagacaatgccaggcatatttcagactaccacgggggagatcggagccattgctttagatttcaaacccggcacaagcggttcgcctatcattaatagagaggggaaggtggtaggactgtatggcaacggcgtcgtgactaaaaatgggggatacgtttcaggtatcgcacaaaccaacgccgaaccggacggcccaacacccgagctcgaagaggaaatgtttaagaaaaggaatttgaccataatggatctgcaccctgggtctggaaagactcgtaagtatctcccagccattgtgcgcgaggctatcaaacggagactgaggacccttatcctggcgcccacacgagtcgtggcagccgagatggaagaggctttgaagggcctacctattcggtaccagacgactgccaccaaaagtgaacatacaggtcgcgagatcgttgacctgatgtgccacgcaaccttcactatgagactcttatccccggtgagggtccccaactataatctgataattatggatgaagcccactttacagacccagctagcatcgcggcccgggggtacatttctacccgagtgggaatgggcgaggcagctgccatcttcatgacggcaactcctcccggcacagccgatgcttttccacagagcaacgcccctatacaggacgaggaaagagacattcccgagcgctcctggaactcagggaacgaatggatcaccgatttcgtaggaaagaccgtgtggtttgttccaagtatcaaagcgggtaatgacattgcaaactgtcttaggaagaacggcaagaaagtcatccaactgagccgtaagactttcgatacagagtatcagaaaaccaagctcaatgactgggattttgtggtgacaactgacatttctgagatgggggccaacttcaaagctgatcgggtcatagacccgagaaggtgcttgaagcctgtaatcctgacggatggacccgaacgcgtgattctcgccggcccaatgcccgttaccgctgcatccgccgctcagcgaagaggtcgggtggggaggaatcctcagaaggagaacgaccaatacatcttccgcggccagccactgaataacgatgaagaccatgcccactggacagaggcaaaaatgcttctagacaatatcaacactcccgaaggaattatacctgcgctgtttgagccggagcgtgaaaagtcagccgctatcgatggcgagtacagattgaaaggggaaagtcggaagaccttcgtcgagttaatgaggcgcggagacctgccagtgtggctcgcccataaagttgcaagcgaaggtattaagtatacagatcgaaaatggtgctttgacggcgagagaaataaccagatcctggaggaaaatatggatgtggagatttggaccaaggaaggggagaagaagaaacttcggcccaggtggctggacgctcgcacttactccgatcctctcgccttgaaagagttcaaagactttgcagccggaagaaaatctatcgctctggatctagtcacggagataggcagggtgccctcgcacctggcgcaccggacccgtaacgccctcgacaatcttgtaatgctgcatacaagcgagcacggtgggcgcgcatatcgacatgctgtggaagagttaccagaaactatggagaccttgctgctcctgggccttatgatcctgctcacaggaggcgccatgttgttcctgatttcagggaagggaatcggtaagacctccattggcttaatctgtgttatagccagttctgggatgctatggatggcagatgtccctctgcagtggattgctagcgccatcgtgctcgagtttttcatgatggtgcttctgattcccgaaccagagaaacaaagaactcctcaggacaaccagttggcgtacgtcgttatcggaatactgacactcgctgccatcgtggcagccaatgaaatgggcctgcttgagacgaccaagagggatctcggtatgtccaaagaaccgggggtagtgtcacccacttcttatctggacgtcgacttgcacccagctagcgcatggacactgtacgccgtggcgaccaccgttattacacctatgttacggcatactatcgagaacagtacggctaatgtgtccctagccgcaattgccaaccaagctgtcgtactgatgggcctcgataagggatggcccatcagcaaaatggaccttggcgtgccactgttggccctggggtgctattctcaggttaaccctctcaccctgacagcagctgtgcttttactggccactcactacgcgataattggacccggcctccaggccaaggcaacccgcgaggctcagaagagaacagccgcaggtatcaccaaaaatccgactgtcgatgggatcatgacgattgacttggatccagtgatctacgactcaaagtttgaaaaacaactgggacaggtcatgctactggtgctctgtgctgttcagcttctgttgatgaggacatcctgggccctgtgcgaggccctcaccctggcgactggccctataaccacattatgggaaggtagtcccggcaagttctggaacactaccattgctgtgagcatggcaaatatctttcgggggtcgtatcttgccggagctggcctggccttctctattatgaaatccgtagggacaggaaagcgaggcacgggtagccagggggagaccctcggagaaaagtggaaaaagaaactaaaccaactgtcaagaaaggagtttgatttgtacaaaaagagtggcatcactgaggtggaccgcacagaagcaaaagagggtctgaagaggggcgaaataacccggcacgccgtctctcgtgggtccgctaagctccagtggttcgttgagagaaatatggtgatcccagaaggaagggtcattgatcttggctgtgggcgcggaggctggagctattactgcgcgggtctgaaaaaggtgactgaggtacgggggtatacaaaaggaggccccggccatgaggaacctgtgccgatgtcaacctacgggtggaacatcgttaagttgatgagtggaaaagacgtgttctatctgcccccagagaagtgtgatacgctcttatgcgacattggtgaaagctccccttctcccaccgtcgaggagagccgaacaatcagagtgctgaagatggtcgaaccttggcttaaaaataaccagttttgtattaaggtgctgaatccatacatgcccactgttatcgagcacctagaaaggctccagcgcaaacatggcgggatgctggtacggaaccctttgtccagaaattcaacccacgagatgtactggatatctaacggaacaggcaatattgtgagttcggtcaacatggtgagccgtctgctccttaataggttcactatgacccaccggcgcccaacaatcgaaaaggatgttgacctgggtgccgggacccgacatgtgaacgcagagcccgagactccgaacatggacgtcatcggagaaagaattaaaaggataaaggaggaacacaattccacgtggcattatgatgacgagaacccttacaagacatgggcttatcacggctcttacgaagtgaaagccaccggctcagcaagctccatgatcaatggggtagtgaagttactgactaaaccatgggatgttgtccccatggtgattcaaatggccatgaccgacacaacgccttttggacagcagcgggtgttcaaggagaaagtcgatacccgcactccaagacccatgccgggtacaaggaaggttatggagatcaccgctgaatggttgtggcgaactctcggccggaacaagcgtcctagactgtgcacacgcgaggaatttaccaaaaaggtgaggacaaatgccgcgatgggggcagtattcactgaggaaaaccaatgggacagtgcccgggctgccgtggaggatgaggaattttggaagctagtcgacagagagcgcgaacttcataagctgggaaaatgtggctcttgcgtgtataatatgatgggtaagagggagaaaaagctcggggagttcggaaaggcaaaaggcagccgagctatttggtacatgtggctgggcgcccggtatttggaatttgaggctctggggttctttaacgaagatcactggttctcaagagaaaattcctacagtggagttgaaggtgagggcctccacaaacttgggtacatcctgagggacataagcaaaatccccggaggcgccatgtatgcagatgacaccgcgggttgggacacgcgcattaccgaggatgacttacataacgaagagaagatcacacagcagatggatccagaacaccgtcagctggccaatgctatttttaaattgacttaccaaaacaaggtggtcaaggtgcagcggcctacccccaaagggacagtaatggacatcatatctagaaaggatcagaggggatccggccaggttggcacttatgggctcaataccttcacgaacatggaggcccaactggtgcgccagatggaaggagagggtgtcctatcaaaagcagaccttgagaatccacatctgctcgaaaagaaaattacacagtggctggagaccaagggcgtggaacgattgaagcggatggctatcagcggggatgactgcgtggtcaaacccatcgatgacagattcgccaacgcattactggccctcaacgatatgggaaaggttaggaaagacattcctcagtggcaaccatcgaagggctggcacgattggcaacaggtgccgttttgttctcaccatttccacgagcttataatgaaagacggtcgcaagctggtagtgccctgcagacctcaggacgaactaatcgggcgggcgaggattagtcgtggagctggctggtccctgaaggagactgcctgtctcggcaaagcatacgcccaaatgtggagcttgatgtattttcatcgacgcgatctgagacttgcttcaaatgccatctgctccgcagtcccagtgcactgggttcccacatctcggaccacttggagcattcatgctcaccaccagtggatgaccacagaggacatgctgacggtgtggaacagggtctggatcgaagataatccttggatggaggacaagaccccagtgactacatgggaagatgtaccctacctcgggaaacgcgaggaccagtggtgtggaagtttaataggtctgacctccagagccacttgggcgcaaaacatcttgacagctattcagcaggttcggagcctgatcggcaatgaggagttcctcgattatatgccttctatgaagaggtttaaaaaggaggaagagtcagaaggggccatttggtga

SEQ ID NO: 15652 - RNA, 9873 nt, synthetic construct
  misc_feature 1..9873: note = derived and/or modified CDS sequence (opt3) from DENV-3__KJ737430__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatggccatgcgctgtgtgggcgtagggaacagagactttgttgaaggactgtcaggtgcgacatgggtggatgtcgtgctagagcatggcgggtgcgtgaccacgatggcaaagaataaacccactctcgacatcgagctgcagaagacagaagccacccaacttgctactctgaggaaattgtgtattgagggaaagatcacaaacattaccacggatagccggtgccctacccagggcgaagccatcctcccagaggaacaggaccagaattatgtctgtaaacacacatacgttgatcgcggttgggggaacggatgcggcctgttcggcaaggggagtttagtgacttgcgcaaagtttcaatgtctggagtccatagagggaaaagtagtgcagcacgaaaatctcaagtataccgtcattatcacagtgcatactggtgaccagcaccaggttggcaacgacacccaaggggtgacagtcgagattaccccccaggcttctactgtggaagccatccttcctgagtacggaacgctgggcttggaatgcagcccacgaacaggtctagatttcaatgagatgatcctgctcaccatgaaaaacaaggcgtggatggtacatagacagtggtttttcgacctgccgcttccctggacttccggggccaccacagagacccctacttggaataggaaagaactgttggttacatttaagaacgcacacgctaaaaagcaagaggtggtcgtgctcggctcacaggaaggagccatgcacacggctctgaccggcgccactgagattcagaatagtgggggaacaagcatattcgcaggtcatttaaagtgtcggctgaaaatggataagctagaactcaaaggcatgtcttatgccatgtgcctgaacacctttgtccttaagaaagaggtgtccgagacacagcacgggactatcttgattaaggttgaatacaagggagaggacgctccatgtaaaatccccttctcaaccgaagatggccaaggtaaggcgcataacgggcgtctgataacggcaaatcctgtggtaaccaaaaaggaggagccagtcaacattgaagccgagcccccgttcggcgaaagcaatatcgtgatcggaattggcgacaaagctctcaagatcaactggtacaagaaagggagttctattggaaagatgtttgaggccacagcacgcggtgccagaaggatggctatactgggcgatactgcctgggacttcgggtccgttggaggcgtgcttaatagcctgggtaaaatggtccaccagatctttgggtcggcatataccgcgttgttctctggcgtgtcctggattatgaagatcggaatcggcgtactcctgacatggattgggttaaactcaaaaaatactagtatgagcttttcctgcatagctatcggaattatcaccctgtacctaggcgccgtggttcaggcagatatgggttgtgtcattaactggaaggggaaggaactcaaatgcggatctggcatcttcgtgacgaatgaggtgcatacatggaccgagcagtataagtttcaagccgacagccctaaacggctggctactgccatagcaggtgcttgggaaaacggcgtctgtgggatccgatcaacaacccgcatggagaatcttttgtggaagcagattgccaacgaactgaattacatcctctgggagaacaatattaaactgactgttgtggtgggagatatcataggcgtattagaacaggggaagagaaccctgacaccccagccaatggagcttaaatatagttggaagacgtggggaaaggcgaaaattgtcaccgccgagactcaaaactccagcttcatcattgacggccctaacacacccgaatgcccatctgcttcaagggcatggaatgtgtgggaggttgaagactacggttttggggtgttcaccacaaacatctggttgaagctccgggaggtctatactcagagttgtgatcaccgcctgatgagcgccgctataaaagacgaaagagccgtgcacgcagatatgggatactggatcgagtcccagaagaatggctcttggaaactagagaaggcgtcgtttattgaagttaagacctgcacgtggcccaaaagccatacactgtggtccaacggtgtgctcgagtcagacatgatcattcctaagagtctggccggcccaatctctcagcacaatcataggccggggtaccacacccaaactgctggaccctggcaccttggcaaattggaactggatttcaactattgcgaggggaccacagtagtcataactgagaattgtggaacccgtggccctagcttacggacaacgaccgtgtccggtaagctcattcatgaatggtgctgtcgatcatgcactctgccaccccttagatacatgggggaggacggatgttggtatggcatggaaatcaggcctatcaacgagaaagaagagaatatggtgaagagcctggtctctgccggttccggcaaggttgataactttacaatgggggtgttgtgcctcgcaattctgttcgaggaagtaatgcgcggaaaattcggcaagaaacacatgatcgctggggtgctatttaccttcgtcctgctcctgagtggacagattacttggcgggacatggcccatacacttataatgatcggcagcaatgcatctgatagaatgggtatgggggtgacctacttggccctgattgctacgtttaagatccagccattcttagcgctcggatttttcctgaggaaacttacttcccgcgagaacctgctactcggcgttggcctggccatggcaaccacattgcaactgcccgaagacattgagcagatggctaatgggatcgccttaggactcatggccctgaagcttataacccagtttgaaacttatcagctgtggacagctttggtgtcactcacctgtagtaacacaatcttcactctgaccgtcgcatggcgaacggccacactaattctggcgggtgtgagccttctcccggtttgccaatcgtcctctatgcggaagaccgattggctgcctatggctgtggccgcaatgggcgtcccacccttgcctctgtttatcttcagcttaaaagacactctcaagcgtagatcatggcccctgaatgagggggtaatggccgtgggacttgttagtattctggcttcctctttgctcaggaacgatgtgccaatggcaggccctctggtcgccggtgggctactgatcgcgtgttacgtgataaccggaacaagcgctgaccttactgtagagaaagccgcagacgtgacctgggaagaggaagccgagcagacgggcgtctcccacaacctcatgattacagttgatgacgatggcaccatgcgcatcaaggacgatgaaactgagaatatcctgacagtgttgttaaaaaccgctctgctcattgtgtcagggatatttccctatagcatcccagccactctgcttgtctggcatacatggcagaagcagacccaacggagtggagtgctgtgggacgttccgtctcctcccgagacgcagaaagcagaattggaggaaggtgtatacagaattaagcagcagggcatcttcgggaagactcaagtgggagtcggcgtgcagaaagagggtgtttttcacaccatgtggcacgtgacaaggggggctgtcctaacccataacggaaagcgactggagccaaattgggcctccgtgaaaaaggatctcattagctacggcggcgggtggcgcctgtcggcgcagtggcaaaaaggagaagaggtacaggtcatcgccgtggaacccggtaagaaccctaagaatttccagacaatgccaggcatattccagactaccacgggggagatcggagcaattgctcttgactttaaacccggcacatcaggttctcctatcattaaccgggaagggaaggttgtgggattatatggcaatggcgtcgtgactaaaaacgggggatacgttagtggtatcgcccaaaccaatgctgagccggatggcccaacacccgagctggaagaggaaatgttcaagaaaagaaacctcaccataatggacttgcaccctgggtccggaaagactaggaagtatctgccagcaattgtgcgtgaggccatcaaacgccggctcagaaccctgatccttgcccccacaagggtcgtggctgcggaaatggaggaggcactgaagggcttgcctattcgataccagacgactgccaccaaaagcgaacatacaggtcgggagatcgtagatctaatgtgccacgctacctttactatgcgcctgctctctccggtgagagttcccaattataacttaataattatggacgaagcccatttcacagatccagcaagcatcgccgctagggggtacatttccacccgggtcggaatgggcgaggcggccgcaatctttatgacggctactcctcccggcacagccgaagcattcccacagtcaaatgcccctatacaggacgaggagcgagacattcccgaaagaagttggaacagcgggaatgagtggatcaccgattttgtgggaaagaccgtgtggttcgtcccatctatcaaagctggtaacgacattgccaactgtctgcgcaagaatggcaagaaagtaatccaactttccaggaagacttttgatacagaatatcagaaaaccaagctgaacgactgggatttcgtggttacaactgacatttcagagatgggggcgaattttaaagcagatcgtgtgatagacccgcggagatgcctcaagcctgtcatcttgacggatggacccgagagggtgattctggccggcccaatgcccgttaccgctgccagtgctgcacagcgccgaggtagagtggggcggaaccctcagaaggaaaatgaccaatacatcttcacaggccagccactcaacaatgatgaggaccacgcccactggactgaagctaaaatgctgcttgacaacatcaatacccccgagggaattatacctgccctattcgaaccggagagggagaagagcgcagcgatcgatggcgaataccgcctgaaaggggagtcccgtaagacatttgtcgaattgatgagacggggagacttaccagtgtggctggcccataaagtagcttctgagggtattaagtataccgataggaaatggtgcttcgacggcgaacgcaacaatcagatcctcgaggagaacatggatgtggaaatttggactaaggagggggaacgaaagaaactgagaccccggtggcttgacgccaggacgtactcggatcctctggcactcaaggagtttaaagacttcgctgccggacgcaagagcatcgcattggatctggttaccgaaataggcagagtcccctcacacctagcccataggacacggaatgctctggacaacctcgtgatgcttcacacttccgagcacggtgggcgtgcgtatcgccatgccgtggaggaactgccagagaccatggaaacattattgctgctcggcctgatgatccttctgaccggaggcgcaatgctctttttgattagtgggaaaggaatcggtaagacttctattggcctgatctgtgtcatagttagctccgggatgttatggatggctgatgtgcctctacagtggattgcctcagccatcgtactggagttctttatgatggtgctccttattcccgagccagaaaagcaacgaacacctcaggacaatcagctggcatacgtcgtgatcggaatattgacgctggctgccatcgttgcggctaacgagatgggcctcctggaaaccactaaaagagatcttggtatgtctaaggagccgggggtggtcagccccacaagttatctcgacgtagacctgcacccagcctccgcatggaccttgtacgccgtggctaccacagttattactcctatgctgaggcatacgatcgaaaatagcaccgcaaacgtgtctttagccgcgattgctaaccaagccgtcgtgctaatgggcctggataaaggatggcccatctcaaagatggacctcggcgtcccacttctggcattggggtgctattcccaggtgaatcctctgacactcactgccgctgttctgcttttagtgacccactacgccataattggacccggcctgcaggcaaaagctacacgggaggcccagaagcgcaccgcggccggtatcatgaagaacccgactgtagatgggatcatgacgattgacctcgatccagtgatctacgacagtaaattcgagaagcaattgggacaggtcatgctgctagttctgtgtgcagtgcagctccttctgatgagaacaagctgggctttgtgcgaagccctgaccctcgcaactggccctataaccacactgtgggagggttcgcccggcaaattttggaatactaccattgctgtctctatggccaacatcttcagggggtcctatttagccggagcgggccttgcttttagcattatgaagtcagtggggacaggaaaacggggcacgggtagtcagggggaaaccctgggagagaagtggaagaaaaagctcaatcaactatctcgaaaagaattcgatctgtacaagaaatccggcatcactgaggtagacagaacagaggcaaaggaaggtttgaaacgcggcgagaccactcatcacgccgtgagcagggggtcagctaagctgcagtggtttgttgaacggaacatggtgataccagagggacgtgtcatcgatctcggctgtgggagaggaggctggagttattactgcgccggtcttaagaaagtgacagaagtcagggggtataccaagggaggccccggccacgaggagcctgtgccgatgagcacgtacgggtggaatattgttaaactgatgtccggaaaggacgtattctatttgcccccagaaaaatgtgataccctgctctgcgacatcggtgagtctagcccttcccccacagtggaagagtcacgcactattcgggtcttaaagatggtggagccttggctgaagaacaatcagttctgtatcaaagttcttaacccatacatgcccaccgtgattgaacatctggagcgactacagagaaagtacggcgggatgctcgtcaggaatcctctgtctcgcaacagtacacacgaaatgtattggatctcgaatggaactggcaacatagtgagctccgtaaatatggtgtctcggttgctgctcaacagatttaccatgacacatcgtaggccaaccattgagaaagatgttgaccttggtgcagggactcggcacgtcaacgccgaacccgagacgccgaatatggacgtgatcggagagcgcatcaagcgaattaaagaagagcactcaagcacatggcattacgatgacgaaaacccttataagacctgggcttaccacggctcctatgaggtgaaggcgactggcagtgcctctagcatgataaatggggtcgttaaactgttaaccaagccatgggatgtggtacccatggtgatccaaatggcaatgacagacacgacccctttcggacagcagagagtctttaaagaaaaggtggatactaggacaccacggcccatgccgggtacccgcaaagttatggagattactgctgagtggctgtggagaacattgggcaggaacaagcgacctcggctctgcacccgtgaagagttcacaaagaaagtgagaactaatgccgcaatgggggccgtctttaccgaagagaaccaatgggactcagctcgcgccgcggtggaagatgaggagttctggaagctggtagacagggaacgggagctacataaacttggaaagtgtggctcctgcgtttacaatatgatgggtaaaagagaaaagaaactgggggagtttggaaaggcaaagggcagtcgcgccatctggtatatgtggctcggcgctaggtacctggagttcgaagccttggggtttctgaacgaggatcactggttcagccgagaaaattcttactccggagtggagggtgaaggcctccataaacttgggtatattctgcgggacatctcaaagatacccggaggcgcaatgtacgctgatgacacggccggttgggacaccagaatcacagaggatgacttacacaacgaggaaaaaattactcagcagatggatccagagcacaggcagctggctaatgccatctttaagttgacctatcaaaacaaagtcgtgaaggtgcagcgccctacacccaaggggactgtcatggacattatcagccgtaaagatcagcggggatcgggccaggttggcacctacgggctcaatacgttcacaaacatggaagcacaactggtgagacagatggagggagaaggtgtactatctaaggcggaccttgagaatccacatctgctcgagaaaaagataacccagtggctggaaactaaaggcgtggagaggttgaagcgcatggccattagtggggatgactgcgtcgtgaagcccatcgatgaccgatttgctaacgccttactggcactcaacgatatgggaaaagttcggaaggacatccctcagtggcaaccatccaaaggctggcacgattggcagcaggtgccgttctgtagccatcacttccacgaacttattatgaaggacggtagaaaactggtcgtgccctgcaggcctcaggacgagctaatagggcgcgctagaatctcacaaggagccggctggtccctgaaggaaacagcatgtctcggcaaggcctatgcgcagatgtggtctttgatgtactttcatcggagggatctgcgtcttgctagcaatgccatttgcagtgcagtaccagttcactgggtgcccacctcccgaactacctggagcatccatgcccaccatcagtggatgacaacggaggacatgctgaccgtctggaaccgcgtgtggattgaggataatccttggatggaagacaaaactccagttacaacctgggaggatgtgccctatctcgggaagagagaagaccaatggtgtggatctttaatcggtctgacttcacgggctacatgggcccagaacatattgaccgcaatccagcaggtcaggagtctgattggcgatgaggagttcctcgactacatgccttccatgaaacgctttagaaaggaagaggaaagcgagggggctatctggtga

SEQ ID NO: 15653 - RNA, 9873 nt, synthetic construct
  misc_feature 1..9873: note = derived and/or modified CDS sequence (opt3) from DENV-3__AY858040__SS-prME
  source 1..9873: mol_type = other RNA
accagcctgtgcctcatgatgatgcttcccgcaacactggctttccacttgacttccagggacggagaacctaggatgatcgtggggaagaacgaacggggaaagtctttactgtttaagacggcatcaggtattaatatgtgtaccctgatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtaaagcacataacgggcggttgatcaccgccaaccctgtggtaacaaagaaagaggaaccagtcaatatagaggctgaacccccgtttggcgagagcaacattatcatcggaattggcgataaggccctgaagatcaattggtacaaaaaggggagttctattggaaaaatgttcgaagcaactgcccgtggtgctcgcagaatggccatactcggcgacaccgcatgggattttgggtccgtgggaggcgttctgaacagccttggtaagatggtgcaccagatcttcgggtcggcgtatacagctctgttttctggcgtctcctggattatgaaaatcggaatcggcgtgttgctcacttggattgggctaaattcaaagaacaccagtatgagcttctcctgcatagtaatcggaattatcacgttatacctgggcgccgtggttcaggcagacatgggttgtgtcattaattggaaggggaaagagctaaagtgcggatctggcatctttgtgacaaacgaggtgcatacctggactgaacagtataaattccaagccgatagccctaagaggctcgctacagccatagccggtgcttgggagaatggcgtctgtgggatccggtcaaccactcgaatggaaaacctgctttggaaacagattgccaatgagttgaactacatcctgtgggaaaataacattaagctcaccgttgtggtgggagacatcataggcgtactggagcaggggaaacgcacattaacgccccagccaatggagctgaagtatagttggaagacctggggaaaagcgaagattgtcactgccgaaaaacaaaattccagctttatcattgatggccctaacacacccgagtgcccaaacgcttctagagcatggaatgtgtgggaagttgaggactacggtttcggggtgtttaccacaaacatctggcttaagttgagggaaatgtatactcagctctgtgaccaccggctgatgtcagccgctgtcaaagatgagcgcgccgtgcacgcagacatgggatactggatagagagtcagaagaatggcagctggaagctagaaaaagcgtccctgatcgaggttaagacctgcacgtggcccaaatctcatacactctggtcgaacggtgtgctggaaagcgatatgattatccctaagtcccttgccggcccaatttcacagcacaattacagaccggggtatcatacccaaactgctggaccctggcacttgggcaaactggagttagacttcaactactgcgaggggaccacagtagtcatcactgaaaattgtggaaccaggggccctagtctccgtacaacgaccgtgtctggtaagctgatacacgagtggtgctgtcggagctgcactcttccacccctgcgatatatgggggaagatggatgttggtacggcatggagattagacctatcaacgaaaaggaggagaatatggtgaaatccttggtctcagccggtagcggcaaggttgacaactttacaatgggggtgctctgcctggcaatcctattcgaagaggtaatgaggggaaaattcggcaagaaacatatgattgctggggtgctgtttaccttcgtcctcctgctttctggacagatcacttggcgcgatatggcccggacattgattatgataggctccaatgcaagtgacagaatgggtatgggggtgacctatctggccttaatcgctacgtttaagattcagccattcctcgcgctgggatttttccttaggaagctgactagccgcgaaaacctactcctgggcgttggcttggccatggcaaccacactgcaattacccgaggatatcgaacagatggctaatgggattgccctcggactgatggcccttaaactgatcacccagtttgagacttaccagttgtggacagctctcgtgtctctgatgtgttccaacaccatattcacactaactgtcgcatggcgaaccgccacgctgatccttgcgggtatttcactcatgccggtgtgccaaagtagctcgatgcggaagacagactggctgcctatgaccgttgctgccatgggcgtgccacccttgcctctgtttatcttctccttaaaagatactctcaagcgtagatcttggcccctgaatgagggggtcatggcagtaggacttgtgagcattctggcctcaagtttgctcaggaacgacgttccaatggctggccctctggtggccggtgggctactgatcgcctgttatgtcataaccggaacatccgcggatcttactgtggaaaaagctgccgacgtaacctgggaggaagaggcagaacagacgggcgtgtctcacaacctcatgattacagtcgacgatgacggcaccatgcgcatcaaggatgacgagactgagaatatcctgacagttttgttaaaaaccgccctgctcattgtgagcgggatatttccctactccatcccagctactctgcttgtgtggcatacatggcagaagcagacccaacggtcaggagtcctgtgggatgtgccgagccctcccgaaacgcagaaggccgagttggaagagggtgtttacagaattaaacagcagggcatcttcgggaagactcaagtaggagtgggcgtccagaaagagggtgtgtttcacaccatgtggcatgttacaagaggggcagtgctaacctataacggaaagcgactggaaccaaattgggctagtgtcaaaaaggacctcatttcttacggcggcgggtggcgcctgtccgcctattggcagaagggagaggaagtgcaagtaatcgcggtcgagcccggtaaaaaccctaagaatttccagacaatgccaggcatattccagactaccacgggggaaatcggagccattgcacttgattttaaacccggcacaagcggttcgcctatcattaaccgggaggggaaggtggttggattatacggcaatggcgtggtcactaaaaacgggggatatgtgtcaggtatcgctcagaccaatgccgagccggacggcccaacacccgaactggaggaagagatgttcaagaagagaaacctcaccataatggatttgcaccctgggtctggaaaaactaggaagtacctgccagctattgttcgtgaagcaatcaaacgccggctcagaaccctgatccttgcccccacaagggtggtcgccgctgagatggaggaagcgctgaagggcttgcctgtgcgatatcaaacgactgcaaccaaaagtgagcacacaggtaaggaaattgtagacctaatgtgccatgccacctttactatgcggctgctctccccggtgcgcgttcccaattacaacttaatcataatggatgaggctcacttcacagacccagccagcattgcagccagagggtacatctctaccagggtcggaatgggcgaagctgcggccatttttatgacggcaactcctcccggcacagctgatgccttcccacagagcaatgcacctatccaggacgaggagcgggacatacccgaacgatcctggaactcagggaatgattggattaccgactttgccggaaagaccgtgtggttcgtgccaagtatcaaagctggtaacgatatcgccaactgtctgagaaagaatggcaaaaaggtcattcagcttagccgcaaaacttttgacacagagtatcaaaagaccaagctgaacgattgggacttcgtagtgacaactgatatctctgaaatgggggcgaattttaaagcagacagggttattgatccgcgtcggtgcctcaagcctgtgatattgacggacggacccgagagagtcatcctggccggcccaatgcccgtgaccgttgcttccgccgctcagaggcgcggtcgagtggggagaaaccctcagaaagagaatgatcagtacattttcacaggccaaccactcaacaatgacgaagaccatgcacactggactgaggccaagatgctgcttgataacatcaatacccccgaaggaatcattcctgctctattcgagccggaacgggagaaatcagccgcaatagacggcgagtataggccaaagggggaaagtcgcaaaacatttgtcgagctgatgcgtagaggagatttgcccgtgtggttagcgcataaggtagccagcgaaggtatcaagtacaccgaccggaaatggtgcttcgatggcgagaggaacaatcagattctggaagagaacatggacgtggagatctggactaaggaaggggagaaaaagaaactccgccctcgatggctggatgctagaacgtattccgacccccttgccctgaaggaatttaaggatttcgcagctggacggaaatctattgccctcgacttggttaccgagatcggcagggtcccatcgcacctggcacaccgcacaagaaatgccctagataacctggtgatgctccatactagcgaacacggtgggagggcttaccggcatgcggtggaggagcttcctgaaaccatggagacactgttattgctgggcctcatgatactgcttaccggaggcgccatgctgtttctcatctcagggaagggagtcggtaaaacttccattggcttgatctgtgttgtggcaagttctgggatgctgtggatggctgacattcccttacagtggatcgccagcgccatagtactagagttctttatgatggtgctgctcattccagagcctgagaagcagcgtacaccgcaagataatcagcttgcatatgtcgtgatcggcattctgacgttggctgccatcgttgcggctaacgaaatgggcctgctcgagaccactaaacgcgacctgggtatgtccaaggaacccggggtggtctcaccaacatcttaccttgacgtagatctccaccctgccagcgcatggaccctgtacgccgtggctaccacagttataactcccatgttgcgacacacgatcgagaatagtaccgcaaacgtgtccctggccgcgattgctaaccaggccgtcgtgttaatgggcctagacaagggatggccaatcagcaaaatggatctgggcgtccctctccttgcactggggtgctattctcaagtgaatcccttgacactgactgccgctgttctcctgcttgtgacccattacgccattatcggaccgggcttacaggcaaaggctacaagagaagcccagaaaaggaccgcggccggtataatgaagaacccaactgtagacgggattatgacgatcgatctggaccctgtgatctatgattcaaaattcgagaagcagctcggacaagtcatgttgctggttctatgtgcagtgcagctgctccttatgcggacatcctgggctttttgcgaggccctgaccttggcaactggccccattaccacactgtgggaaggtagtccaggcaagttctggaatactaccatcgctgtcagcatggccaacatatttcgcgggtcgtacctcgccggagcgggcctggctttctctattatgaaatccgtggggacaggaaagagaggcacgggtagccagggggagaccttaggagaaaaatggaagaagaaacttaatcagctgtcaaggaaagagtttgacctctataaaaagagtggcatcactgaagtagatcggacagaggcaaaagagggtctaaagcgaggcgaaattacccaccatgccgtgtctagagggtccgctaaactgcaatggttcgttgagcgcaacatggtgatccccgaaggaagggtcatagacttgggctgtgggcggggaggctggagctactattgcgccggtctgaagaaagtgactgaggtccgtgggtacacaaagggaggccctggccacgaagaaccggtgcccatgtcaacctacgggtggaatatcgttaagctcatgagtggaaaagatgtattctatcttccacctgagaagtgtgacacgctgttgtgcgatattggtgaaagctccccctctcctaccgtggaggaaagcagaacaatcagggtcctgaaaatggtggagccatggctcaagaacaatcagttttgtattaaagttttaaacccctacatgcctactgtgatcgagcatctggaacgccttcagcggaagcacggcgggatgctggtccgaaatccactatccagaaactcaacccacgagatgtattggatttctaatggaacaggcaacatcgtgagttcggtaaatatggtgagcaggctcctgttgaaccgcttcactatgacctaccggagacccacaatagaaaaggacgttgacctgggtgcagggacccgtcatgtcaacgccgagccggaaactcctaatatggatgtgattggagagaggatccggcgcatcaaagaggaacactcctctacgtggcattatgacgatgagaacccatacaagacatgggcttatcacggctcatacgaagtgaaagcgaccggcagcgcctccagtatgattaatggggtcgttaagctccttactaaaccctgggacgtggtacctaccgtgacacagatggcaatgacggataccactccatttggacaacagcgagtcttcaaggagaaggtggacacaagaacccccaaaccgatgcctggtactaggaaggttatggaaataacagctgagtggctgtggcggaccttaggccgcaacaaaagacccaggctgtgcacacgagaggaatttactaagaaagtgcggaccaatgccgcaatgggggccgtcttcacggaggaaaaccagtgggattctgctcgtgccgcggtggaggacgaagagttttggaagttggtagatagagagcgcgaactccacaaactgggaaagtgtggcagctgcgtttacaatatgatgggtaagagggagaaaaagctaggggagttcggaaaagcaaagggctcacgggccatctggtatatgtggcttggcgctagatacctggagtttgaggccctcgggttcctgaacgaagaccattggttttcccgcgagaatagttatagcggagtggaaggtgagggcttgcacaaactggggtacattctcagggatatctctaagattccaggaggcgcaatgtatgctgacgacaccgccggttgggatacacgaatcactgaagacgatcttcataacgaggagaagataacccaacagatggaacctgagcaccggcagctggctaatgccatcttcaaattaacataccagaacaaggtcgtgaaagtgcaaagacccactccaaaggggaccgtcatggacattatctccaggaaagatcagcgcggatcaggccaggttggcacgtatgggctgaatacatttaccaacatggaagcacagttgattcgtcaaatggagggagaagacgtgctcagcaagactgatctggagaatccccatctacttgagaagaaaatcacacagtggctggaaaccaagggtgtagagcggctcaaaagaatggcgatatcgggcgacgattgcgtggtcaagcctattgacgataggttcgccaacgctctgttggccttaaacgacatggggaaagtgcgcaaggatatcccacagtggcagccgtctaagggatggcacgactggcaacaggttcccttctgtagtcaccattttcacgaactgatcatgaaagacggccgaaagctcgtggtcccttgccggccacaggatgagcttattggtagagcaaggatatcccagggggctggatggagcctgaaagaaactgcctgtctaggcaaggcatacgcccaaatgtgggcgctgatgtacttccatcgcagagacctccggttggcttcaaatgccatctgctccgcagtgcccgtacactgggttcctacctctaggacaacgtggagcattcacgcccatcaccagtggatgaccactgaggatatgctgacagtgtggaaccgtgtctggatcgaggacaatccatggatggaagataaaacccccgtgactacatgggaggacgttccttatcttggcaagcgagaagatcagtggtgtgggagtctgattggactcacctcccgcgctacgtgggcccaaaacatcttaacagcaatacaacaggtgagaagcctgatcggtaatgaggagtttttggactacatgccgtctatgaagcggttcaggaaagaagaggaatcagagggcgctatttggtga

SEQ ID NO: 15654 - RNA, 9873 nt, synthetic construct
  misc_feature 1..9873: note = derived and/or modified CDS sequence (opt3) from DENV-3__AY858041__SS-prME
  source 1..9873: mol_type = other RNA
accagcctgtgcctcatgatgatgcttcccgcaacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccacacgtgggcatgggtttggataccagagcacagacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtcaggcacataacgggcggttgatcaccgccaaccctgtggtaactaagaaggaggaaccagtcaatatagaggctgaaagcccctttggcgagagtaacattatcatcggaattggcgataaagccctgaagatcaattggtacaagaaagggtcttccattggaaagatgttcgaagcaactgcccgtggtgctcgcagaatggccatactcggcgacaccgcatgggattttgggagcgtgggaggcgttctgaactcgcttggtaaaatggtgcaccagatcttcgggtctgcgtatacagctctgttttccggcgtctcatggattatgaagatcggaatcggcgtgttgctcacttggattgggctgaatagtaaaaacaccagcatgtccttctcttgcatagtaatcggaattatcacgttatacctgggcgccgtggttcaggcagacatgggttgtgtcattaattggaaggggaaggagctaaaatgcggaagcggcatctttgtgacaaacgaggtgcatacctggactgaacaatataagttccaggccgattcaccgaaaaggctcgctacagccatagccggtgcttgggagaatggcgtctgtgggatccggagtaccactcgaatggaaaacctgctttggaagcagattgccaatgagttgaactacatcctgtgggaaaataacattaaactcaccgttgtggtgggagacatcataggcgtactggagcaggggaagcgcacattaacgcctcaacccatggagctgaaatattcctggaagacctggggaaaggcgaaaattgtcactgccgaaatccagaatagctcttttattatcgatggcccaaacacacctgagtgccccaacgcttcaagagcatggaatgtgtgggaagttgaggactacggtttcggggtgtttaccacaaacatatggcttaagttgagggaaatgtatactcagctctgtgaccaccggctgatgagtgccgctgtcaaagatgagcgcgccgtgcacgcagacatgggatactggatcgagagccagaagaatggctcctggaaactagaaaaggcgtctctgattgaggttaagacctgcacgtggccaaaatcgcatacactctggagcaacggtgtgctggaatccgatatgatcattcccaagtcacttgccggccctatcagtcaacacaattacagaccagggtatcatacccagactgctggaccgtggcacttgggcaaactggagttagacttcaactactgcgaggggaccacagtagtcataactgaaaattgtggaaccaggggcccctctctccgtacaacgaccgtgagcggtaagctgattcacgagtggtgctgtcggtcctgcactcttcctccactgcgatatatgggggatgacggatgttggtacggcatggaaatcagacccatcaacgagaaagaagagaatatggtgaagtcattggtcagcgccggttctggcaaggttgataactttacaatgggggtgctctgcctggcaattctattcgaggaagtaatgaggggaaaattcggcaagaaacatatgatcgctggggtgctgtttatgttcgtcctcctgctttccggacagattacctggcgcgacatggcccggactttgataatgatcggcagtaatgcaagcgatagaatgggtatgggggtgacatatctggccttaattgctacctttaagatccaacctttcctcgcgctgggatttttccttaggaaactgacgtctcgcgagaacctactcctgggcgttggcttggccatggcaactaccctgcagttaccagaagacattgagcagatggctaatgggatcgccctcggactgatggcccttaagctgataacacagtttgaaacctaccaattgtggactgctctcgtgtccctgacatgttcaaacaccatcttcacactaactgtcgcatggcgaaccgccacgctgattcttgcgggtatcagtctcctgcccgtgtgccagagctcgtccatgcggaagacagattggttgccgatgaccgttgctgccatgggcgtgcctccactgcccttatttattttctctctcaaagacactctgaagcgtagaagctggcctcttaatgagggggtcatggcagtaggactggtgtcaatcttggccagttccctcctgaggaacgatgttcccatggctggccccctagtggccggtgggctgcttatagcctgttatgtcattaccggaacatctgcggacctcactgtggagaaagctgccgacgtaacctgggaagaggaagcagagcagacgggcgtgagccacaacctgatgatcacagtcgatgacgatggcaccatgcgcatcaaggacgatgaaactgagaatattttgacagttttactgaaaaccgccctcctgatagtgtccgggatctttccttactcaattcccgctactcttctggtgtggcatacatggcagaagcaaacccagcggagcggagtcttgtgggacgtgccaagtccgcctgagacgcagaaagccgaactagaggaaggtgtttacagaatcaagcagcaaggcattttcgggaagactcaggtaggagtgggcgtccagaaagagggtgtgtttcacaccatgtggcatgttacaagaggggcagtgctgacctataacggaaagcgactcgagcccaattgggcttctgtcaaaaaggatctgatctcctacggcggcgggtggcgccttagcgcccaatggaaaaagggagaagaggtgcaggtaatagcggtcgaaccaggtaagaaccccaaaaatttccagacaatgcctggcatcttccagactaccacgggggagattggagccatcgcattagactttaagccaggcacatcgggttcacccattatcaaccgggaagggaaagtggttggactgtatggcaatggcgtggtcactaagaacgggggatacgtgtctggtatagctcaaaccaatgccgagcctgatggcccgacaccagagctcgaagaggaaatgttcaaaaagagaaacttgaccattatggacctgcaccccgggagtggaaagactaggaaatatctccctgctatcgttcgtgaggcaatcaagcgccggctgagaacccttattctggccccaacaagggtggtcgccgctgaaatggaggaggcgttgaaaggcctacccatccgataccagacgactgcaaccaagtccgaacacacaggtaaagagatagtggatctgatgtgccatgccacctttactatgcggctcttaagccctgtacgcgtgccgaattataacctgattatcatggacgaagctcacttcacagatcccgcctctattgcagccagagggtacatcagcaccagggttggaatgggcgaggctgcggccatatttatgacggcaactccacctggcacagctgacgccttcccccagtccaatgcaccaattcaggacgaggaacgggatatccctgagcgatcatggaacagtgggaatgactggatcaccgattttgccggaaagaccgtctggttcgtgcccagcattaaggctggtaacgacatcgccaactgtcttaggaaaaatggcaagaaagtgattcaactgtctcgcaagacttttgatacagaataccagaaaaccaagctcaacgactgggatttcgtcgtaacaactgacatatccgagatgggggcgaattttaaggcagatagggtgatcgacccacgtcggtgcttgaaaccggttattctgacggatggacctgaaagagtgatcctcgccggccccatgccagtcaccgtggcttcagccgctcagaggcgcggtcgagttgggagaaacccccagaaggagaatgaccaatatatcttcacaggccagcctctgaacaatgacgaggatcatgcacactggactgaagccaaaatgcttctagacaacattaataccccagagggaataatccccgctctgttcgaacctgagcgggaaaagagtgccgcaattgatggcgagtacaggttgaaaggggagagccgcaagacatttgtggaattaatgcgtagaggagacctgccggtctggctcgcgcataaagtggcctccgagggtatcaagtataccgatcggaagtggtgcttcgacggcgaaaggaacaatcagattctggaggaaaacatggatgtagagatctggactaaagagggggaaaagaagaaacttcgcccacgatggctggacgctagaacgtactctgatcccctcgccttgaaagagtttaaagacttcgcagctggacggaagtcgatagccctggatctagtgaccgaaatcggcagggttcctagccacctggcacaccgcacaagaaatgccctcgacaaccttgtcatgctgcatacttcagagcacggtgggagggcttatcggcatgcggtggaagagttacccgagaccatggaaacattgctgctcctgggccttatgattctgctcaccggaggcgccatgttgtttctgatctccgggaaaggagtgggtaagacaagtattggcttaatctgtgtcgttgcatctagcgggatgctatggatggctgatataccactgcagtggattgcctccgccatcgtgctcgagttctttatgatggtacttctgattcctgaacccgagaaacaacgtacaccacaggacaatcagttggcatacgtggtcatcggaatactgacgctcgctgccatcgtggcggctaacgagatgggcctgcttgaaaccactaagcgcgacctcggtatgtcaaaagagcctggggttgtgtctagcacaagttatctggatgtcgacttgcacccggcctccgcatggaccctgtacgccgtagctaccacagtgattactcccatgttacgacacacgatcgaaaatagcaccgcaaacgtttctctagccgcgattgctaaccaagccgtggtcctgatgggcctcgataagggatggccaatctcaaagatggaccttggcgtgcctctgttggcactggggtgctactcccaggtcaatcccctcacactgactgccgctgtgcttttactggttacccattatgccataattggaccaggcctccaggcaaaagctacaagagaggcccagaagaggaccgcggccggtatcatgaaaaaccctactgtggatgggatcatgacgattgacttggatcccgtaatctacgacagtaagttcgaaaaacaactgggacaggtgatgctactggtcctctgtgcagttcagcttctgttgatgcggacaagctgggctttttgcgaggccctgaccctcgcaactggcccgataaccacactgtgggagggttcgccaggcaagttctggaatactaccattgctgtgtctatggccaacatctttcgcgggtcctatttagccggagcgggccttgctttcagcattatgaagtcagtcgggacaggaaaaagaggcacgggtagtcagggggaaaccctgggagagaagtggaaaaagaaactcaatcaactatctaggaaggaatttgatctgtacaaaaagtccggcatcactgaggtggaccggacagaagcaaaggagggtttgaaacgaggcgagataacccaccatgccgtaagcagagggtcagctaagctgcagtggttcgtggaacgcaacatggttatccctgagggaagggtgattgatctcggctgtgggcggggaggctggagttattactgcgccggtcttaaaaaggtcactgaagtgcgtgggtatacaaaaggaggccccggccacgaggaaccagtccccatgagcacctacgggtggaatatcgtgaagctgatgtccggaaaggacgttttctacttgcctccggagaaatgtgatacgctgctctgcgacattggtgagtctagcccctccccaaccgtagaagagtcaagaacaatcagggtgttaaagatggtcgaaccttggctgaaaaacaatcagttttgtattaaggtgcttaacccctatatgcctactgttatcgagcatctggagcgcctacagcggaaacacggcgggatgctcgtgcgaaatccactgtctagaaacagtacccacgaaatgtactggatatcgaatggaacaggcaacattgtcagctccgtgaatatggtatctaggttgctgctcaaccgcttcactatgacctatcggagacccacaatcgagaaggacgtggatcttggtgcagggacccgtcatgttaacgccgaacctgagactccaaatatggacgtcatcggagaaaggattcggcgcataaaggaggagcactcaagcacgtggcattacgatgacgaaaacccctataaaacatgggcttaccacggctcctatgaggtgaaggcgaccggcagtgcctctagcatgatcaatggggtggtcaaactgttaactaagccgtgggatgttgtgcctaccgtaacacaaatggcaatgacggacaccactccatttggacagcagcgagtgttcaaagaaaaggtcgatacaagaacccccaagcctatgccaggtactaggaaagtgatggagattacagctgaatggctgtggcggaccttgggccgcaacaagagacccaggctctgcacacgagaggagtttactaaaaaggttcggaccaatgccgcaatgggggccgtgttcacggaagagaaccaatgggactcagctcgtgccgcggtcgaagatgaggaattttggaaactggtggacagagagcgcgagctacacaagcagggaaaatgtggctcctgcgtatacaatatgatgggtaagagggaaaagaaacttggggagttcggaaaggcaaaaggcagtcgggccatctggtacatgtggctgggcgctagatatctcgaatttgaggccctggggttcttgaacgaggatcattggtttagccgcgaaaattcttactccggagttgagggtgaaggcctgcacaagctcgggtatattcttagggacatctcaaaaataccgggaggcgcaatgtacgctgacgataccgccggttgggacacacgaatcactgaggatgacctgcataacgaagagaagattacccagcagatggatcctgagcaccggcaattagctaatgccatcttcaagctgacatatcagaacaaagtggtcaaggtgcagagacccactccaaaagggaccgtgatggacattatcagcaggaaggatcagcgcggatcgggccaagtcggcacgtacgggttgaatacatttaccaacatggaagcacagctcatacgtcagatggagggagaaggtgttctgtctaaaactgacctagagaatcctcatcttctggaaaagaagattacacagtggctcgagaccaaaggcgtggagcggctgaagagaatggcgatcagtggggatgactgcgtagtgaaacccatcgatgacaggttcgccaacgctttgttagccctgaacgatatgggaaaggtccgcaaagacattccacaatggcagccctccaagggctggcacgactggcaacaggtgcctttctgtagccaccattttcacgaactcataatgaaggatggtcgaaaacttgttgtgccatgccggccgcaagacgagctgatcgggagagcaaggatttcacagggagctggctggtccctaaaggaaactgcctgtctgggcaaagcatatgcccagatgtgggcgctcatgtacttccatcgcagagatttgcggctggcttctaatgccatctgcagcgcagtccccgtgcactgggtacctaccagtaggacaacgtggtccattcacgcccatcaccaatggatgaccactgaggacatgcttacagtttggaaccgtgtgtggatcgaagataatccatggatggaggacaagacccccgtcactacatgggaggatgtgccttacctggggaaacgagaagaccagtggtgtggaagcctcataggtttaacctctcgcgctacgtgggcccagaacatcctgacagcaattcagcaagttagatcattgatcggcaatgaggaatttctggattatatgccaagtatgaagcggttcaggaaggaggaggaatccgagggggctatttggtga
